United States Patent 12,508,308 (INFLUENZA mRNA VACCINES) - sequence listing, part 48

SEQ ID NO: 186601 - RNA, 1701 nt, Artificial Sequence
  derived and/or modified sequence opt5 from hemagglutinin__InfluenzaA__ACZ05050
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguagccaugccggcgcgaaaucuuuuuauaagaaucugaucuggcucguuaaaaagggcaacuccuaccccaaacugagcaaguccuauauuaaugacaaggggaaagaagugcuuguccuguggggaauccaccacccuucuaccagcgccgaucaacagucccucuaccagaacgcugacgccuacguguucgugggcagcucuagauauuccaagaaauuuaagcccgagauugcuauccggccuaaaguccgcgaucaggaggggagaaugaauuacuauuggacacugguugaaccgggagacaagauuaccuucgaggccacgggcaaccugguggugccccgguacgcguuugccauggaacgcaacgcugggagcggaaucauuaucucugauacaccuguccaugacugcaauaccacaugucaaacccccaaaggcgccaucaacaccagccucccuuuccagaauauucaccccaucacaauuggcaagugcccgaaguaugugaaauccacgaagcugagacuugcuaccgggcugcggaacguuccuucuauccagagccgcggacucuuuggcgccauugccggguucaucgagggaggcuggacagggaugguggacggaugguacggcuaucaucaccagaaugaacaaggcuccggguacgcugcggaucugaaaagcacccagaacgccaucgacgagauuacaaauaaggucaacucugugaucgagaaaaugaauacccaguuuacggcuguuggaaaggaguucaaccaccuugagaagagaauugaaaaucugaacaaaaagguggaugacggcuuccucgauaucuggacauacaaugccgagcugcugguccuccuggaaaacgagcggacccuugacuaucaugauuccaaugugaaaaaccuguacgagaagguccgcagccagcucaaaaacaaugccaaggaaauugggaacggauguuuugaguucuaucacaagugcgacaauaccuguauggaaucugugaaaaacggcacauacgauuaucccaaguacuccgaggaagcuaaacugaauagagaggagaucgacgggguuaaacuugaaagcacccggaucuaucaaauucuggccaucuacuccacaguggcgucuagccucguccuggugguuucccugggcgcuauuucuuuuuggaugugcagcaacggaucccuccagugccgcaucuguauuuga

SEQ ID NO: 186602 - RNA, 1701 nt, Artificial Sequence
  derived and/or modified sequence opt5 from hemagglutinin__InfluenzaA__ACZ05061
auggaggccauccuggugguccuccuguacaccuucacaacggcuaacgccgacacccuuugcauuggcuaucacgcgaauaacagcacagauaccguugacacagugcuggaaaagaaugugaccgucacacauuccgugaaccuccuggaggauaaacacaaugggaaacuuuguaagcugagaggaguugcuccccuccaucugggcaagugcaacaucgccggguggauucugggaaauccugaaugugagucucucagcaccgccuccucuuggagcuacaucguggaaacguccucuagcgacaacgggaccugcuauccgggcgauuuuauugacuacgaggagcugcgggaacagcuuuccagcgucucuuccuucgagcgcuuugaaaucuuccccaaaacaagcucuuggccuaaucacgauuccaacaagggagugaccgcugccuguccccaugcuggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccacaucugcggaucaacagagccucuaccagaacgccgacgcuuacguguucgugggcuccagcagauauucuaaaaaguuuaaaccugagauugccauccggccgaagguccgcgaucaggaagggagaaugaauuacuauuggacccugguugagcccggagacaaaauuacguucgaagcuacaggcaaccugguggugccucgguacgccuuugcgauggagcgcaacgccggguccggaaucauuaucagcgauacccccguccaugacugcaauacaaccugucaaacccucaagggcgcuaucaacacaucucugccuuuccagaauauucaccccaucacgauuggcaaaugcccgaaguauguuaagagcaccaaacuuagacuggccacagggcuccggaacgugccuuccauccagucucgcggacuguuuggcgcuauugccggguucaucgaaggaggcuggaccgggaugguggacggaugguacggcuaucaucaccagaaugagcaaggcagcggguacgccgcugaucuuaaguccacacagaacgcgaucgacgagauuaccaauaaagucaacagcgugaucgaaaagaugaauacgcaguuuacagccguuggaaaagaguucaaccaccuggaaaagagaauugagaaucucaacaagaaaguggaugacggcuuccuggauaucuggaccuacaaugcugaacugcucguccugcuugagaacgagcggacccuggacuaucaugauucuaaugugaagaaccucuacgaaaaaguccgcucccagcugaagaacaaugccaaagagauugggaacggauguuuugaguucuaucacaagugcgacaauacauguauggaaagcgugaagaacggcaccuacgauuaucccaaauacucugaagaggccaaacuuaauagagaggaaaucgacgggguuaagcuggaguccacacggaucuaucaaauucucgcuaucuacagcacgguggccuccucucugguccuggugguuagccucggcgcgauuuccuuuuggaugugcucuaacggaagccugcagugccgcaucuguauuuga

SEQ ID NO: 186603 - RNA, 1701 nt, Artificial Sequence; identical to SEQ ID NO: 185680
  derived and/or modified sequence opt5 from hemagglutinin__InfluenzaA__ACZ05071

SEQ ID NO: 186604 - RNA, 1701 nt, Artificial Sequence; identical to SEQ ID NO: 185680
  derived and/or modified sequence opt5 from hemagglutinin__InfluenzaA__ACZ05081

SEQ ID NO: 186605 - RNA, 1701 nt, Artificial Sequence; identical to SEQ ID NO: 185680
  derived and/or modified sequence opt5 from hemagglutinin__InfluenzaA__ACZ05091

SEQ ID NO: 186606 - RNA, 1701 nt, Artificial Sequence; identical to SEQ ID NO: 185680
  derived and/or modified sequence opt5 from hemagglutinin__InfluenzaA__ACZ05101

SEQ ID NO: 186607 - RNA, 1701 nt, Artificial Sequence; identical to SEQ ID NO: 185680
  derived and/or modified sequence opt5 from hemagglutinin__InfluenzaA__ACZ05111

SEQ ID NO: 186608 - RNA, 1701 nt, Artificial Sequence
  derived and/or modified sequence opt5 from hemagglutinin__InfluenzaA__ACZ05121
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaauaaccugaucuggcucguuaagaaaggcaauagcuacccuaagcuguccaaaagcuauauuaacgacaaggggaaggaagugcuuguccuguggggaauccaccaccccuccaccucugccgaucaacagagccucuaccagaaugcugacgccuacguguucgugggcuccagcagauauucuaaaaaguuuaaaccugagauugcuauccggccgaagguccgcgaucaggaggggagaaugaacuacuauuggacacugguugaacccggagacaaaauuaccuucgaggccacgggcaaccugguggugccucgguacgcguuugccauggaacgcaaugcuggguccggaaucauuaucagcgauacacccguccaugacugcaacaccacaugucaaaccccuaagggcgccaucaauaccucucuccccuuccagaacauucacccgaucacaauuggcaaaugcccuaaguauguuaagagcacgaaacugagacuugcuaccgggcugcggaaugugcccuccauccagucucgcggacucuuuggcgccauugccggguucaucgagggaggcuggacagggaugguggacggaugguacggcuaucaucaccagaacgaacaaggcagcggguacgcugcggaucugaaguccacccagaaugccaucgacgagauuacaaacaaagucaauagcgugaucgagaagaugaacacccaguuuacggcuguuggaaaagaguucaaucaccuugagaagagaauugaaaaccugaauaagaaaguggaugacggcuuccucgauaucuggacauacaacgccgagcugcugguccuccuggaaaaugagcggacccuugacuaucaugauucuaacgugaagaaccuguacgagaaaguccgcucccagcucaagaauaacgccaaagaaauugggaauggauguuuugaguucuaucacaagugcgacaacaccuguaugggcagcgugaagaaugggacauacgauuauccuaaauacucugaagaggcuaagcugaacagagaagagaucgacggcguuaaacuugaguccacccggaucuaucaaauucuggccaucuacagcacaguggcguccucucucguccuggugguuagccugggagcuauuuccuuuuggaugugcucuaauggcagccuccagugccgcaucuguauuuga

SEQ ID NO: 186609 - RNA, 1701 nt, Artificial Sequence; identical to SEQ ID NO: 185680
  derived and/or modified sequence opt5 from hemagglutinin__InfluenzaA__ACZ05131

SEQ ID NO: 186610 - RNA, 1701 nt, Artificial Sequence; identical to SEQ ID NO: 185680
  derived and/or modified sequence opt5 from hemagglutinin__InfluenzaA__ACZ05141

SEQ ID NO: 186611 - RNA, 1701 nt, Artificial Sequence; identical to SEQ ID NO: 185680
  derived and/or modified sequence opt5 from hemagglutinin__InfluenzaA__ACZ05151

SEQ ID NO: 186612 - RNA, 1701 nt, Artificial Sequence
  derived and/or modified sequence opt5 from hemagglutinin__InfluenzaA__ACZ05172
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacaggacggcaccuccagcgcuugcauccgcagaucuaaaaauuccuuuuucagccggcugaacuggcucacacaucugaauuuuaaauauccugcccuuaacgucaccaugcccaauaacgagcaguucgauaagcuguacauuuggggcgugcaccauccugggacggacaaagaucagaucuuucucuaugcgcaagccucuggacgcauuacaguuuccaccaagagaagccagcagacagcuaucccgaacauuggcucccggccccgcgugagaaauaucccuucucggaucagcauuuacuggaccaucgucaaacccggggacauucugcugaucaacuccaccggaaaucucauugccccucgcggcuacuucaagaucagaagcgggaagucuuccaucaugcggagcgacgcucccauuggaaaauguaacucugagugcaucacaccgaauggcagcauuccuaacgauaagcccuuucagaaugugaaccgcaucacguauggcgccuguccuagauacgugaaacaaaauacccugaaacuugcgacagggaugcggaacguccccgaaaagcagacccgcggaauuuucggcgccaucgcuggguuuaucgagaauggaugggaaggcaugguugacgggugguauggauucagacaccagaacuccgagggccggggccaagccgcugaucugaagucuacacaggccgccauugaccagaucaaugggaaacucaacagacugauuggaaagaccaaugagaaguuccaccagaucgaaaaagaguuuagcgaaguggagggccgcauucaagaucuugaaaaguacguggaggacacgaaaaucgaucugugguccuauaacgcugagcuccuggucgcgcuggaaaaccagcauacaauugaccucaccgauagcgagaugaauaagcuguucgaaaagaccaagaagcagcuucgggagaacgccgaagacauggggaauggaugcuuuaaaaucuaccacaagugugauaacgcuugcaucggcucuauuagaaaugggacauaugaccaugacguguaccgcgaugaggcccugaacaaucgguuccagaucaaaggcguugagcucaaguccggauacaaagacuggauucuguggaucagcuuugccauuucuugcuuccuucuguguguggcucuccugggcuuuaucaugugggccugccaaaaggggaacaucagauguaauauuugcaucuga

SEQ ID NO: 186613 - RNA, 1698 nt, Artificial Sequence; identical to SEQ ID NO: 186155
  derived and/or modified sequence opt5 from hemagglutinin__InfluenzaA__ACZ05194

SEQ ID NO: 186614 - RNA, 1701 nt, Artificial Sequence; identical to SEQ ID NO: 186612
  derived and/or modified sequence opt5 from hemagglutinin__InfluenzaA__ACZ05205

SEQ ID NO: 186615 - RNA, 1701 nt, Artificial Sequence
  derived and/or modified sequence opt5 from hemagglutinin__InfluenzaA__ACZ05216
augaagaccaucauugcccugagcuacauccucugccugguguucgcucagaaaauucccggcaacgacaauaacacagccacgcuuugucuggggcaccaugcggucccuaauggaaccaucguuaagacaauuaccaacgaucaaaucgaggugacaaaugcuaccgaacucgugcaguccucuagcacaggcgagaucugcgacuccccgcaccagauucuggauggggaaaacuguacccuuaucgacgcccugcucggagauccccagugcgacggcuuucaaaauaaaaagugggaucuguucgucgagagaucuaaagccuauagcaacuguuacccuuaugacgugcccgauuacgcuucccugcggucucucguugccagcuccgggacgcuggaauuuaauaacgagagcuucaauuggaccggagugacacagaacggcaccucuuccgcuugcauucgcagaagcaauaacucuuucuucucccggcuuaauuggcugacacaucucaaguuuaaguauccugcccugaacgucaccaugcccaacaaugagcaguucgacaaacuuuacaucuggggcgugcaccauccugggacggauaacgaccagauuuuucuguaugcgcaagccagcggacgcaucacaguuucuaccaagagaucccagcagacagugauuccgaauaucggcagccggccccgcgucagaaacaucccuucccggauuucuaucuacuggaccauugugaaacccggggauauccuccugauuaauagcaccggaaaccugaucgcuccucgcggcuacuucaagaucagauccgggaaaagcucuauuaugcgguccgacgcccccaucggaaaguguaauagcgaaugcauuacaccgaacggcucuaucccuaaugacaagcccuuucagaacgugaaucgcauuacguauggcgcuuguccuagauacgucaaacaaaacacccucaagcuggccacagggaugcggaauguucccgagaaacagacccgcggaaucuucggcgcgaucgccggguuuauugaaaacggaugggagggcaugguggaugggugguauggauucagacaccagaauagcgagggccggggccaagcugccgaccuuaaguccacacaggcugccaucgaucagauuaacgggaaacugaacagacucaucggaaagaccaaugaaaaauuccaccagauugagaaggaauuuucugagguggaaggccgcauccaagaccuggagaaguacgucgaggauacgaaaauugaccuuuggagcuauaacgccgaacugcucguggcucuggagaaucagcauacaaucgaucugaccgacuccgaaaugaacaagcucuuugagaaaaccaagaaacagcugcgggaaaaugcggaggauauggggaacggaugcuuuaagaucuaccacaagugugacaaugccugcauuggcagcaucagaaacgggacauaugaucaugacguuuaccgcgacgaggcucuuaauaaccgguuccagauuaaaggcguggaacugaagucuggauacaaagauuggauccucuggauuuccuuugccaucagcugcuuccugcuuugugucgcccugcucggcuuuaucaugugggcuugccaaaaggggaauauuagauguaacaucugcauuuga

SEQ ID NO: 186616 - RNA, 1701 nt, Artificial Sequence; identical to SEQ ID NO: 186612
  derived and/or modified sequence opt5 from hemagglutinin__InfluenzaA__ACZ05227

SEQ ID NO: 186617 - RNA, 1701 nt, Artificial Sequence
  derived and/or modified sequence opt5 from hemagglutinin__InfluenzaA__ACZ05238
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacugggcuggagugacccagaauggcacauccagcgccugcauccgcagaucuaagaacuccuuuuucagccggcugaauuggcucacccaucugaacuuuaaauauccugcgcuuaaugucacaaugcccaacaacgagcaguucgacaagcuguacauuuggggcgugcaccauccugggaccgauaaagaccagaucuuucucuaugcccaggcuucuggacgcauuacgguuuccacaaagagaagccagcagaccgccaucccgaauauuggcucccggccccgcgugagaaacaucccuucucggaucagcauuuacuggacaaucgucaaacccggggauauucugcugaucaauuccaccggaaaccucauugcuccucgcggcuacuucaagaucagaagcgggaagucuuccaucaugcggagcgacgcccccauuggaaaauguaauucugagugcaucaccccgaacggcagcauuccuaaugacaagcccuuucagaacgugaaucgcaucacauauggcgcguguccuagauacgugaaacaaaacacgcugaaacuugccaccgggaugcggaauguccccgaaaaacagacacgcggaauuuucggcgcuaucgccggguuuaucgagaacggaugggaaggcaugguugaugggugguauggauucagacaccaaaauuccgagggccggggccaagcugccgaccugaagucuacccaggccgcuauugaucagaucaacgggaaacucaauagacugauuggaaagacaaacgagaaguuccaccagaucgaaaaagaguuuagcgaaguggagggccgcauucaagaccuugaaaaguacguggaggauaccaaaaucgaccugugguccuauaacgcggagcuccuggucgcccuggaaaaucagcauacgauugaucucacagacagcgagaugaacaagcuguucgaaaagaccaagaagcagcuucgggagaaugcugaagauauggggaacggaugcuuuaaaaucuaccacaagugugacaaugccugcaucggcucuauuagaaacgggaccuaugaucaugacguguaccgcgacgaggcccugaauaaccgguuccagaucaaaggcguugagcucaaguccggauacaaagauuggauucuguggaucagcuuugcuauuucuugcuuccuucuguguguggcccuccugggcuuuaucaugugggcgugccaaaaggggaauaucagauguaacauuugcaucuga

SEQ ID NO: 186618 - RNA, 1701 nt, Artificial Sequence; identical to SEQ ID NO: 186612
  derived and/or modified sequence opt5 from hemagglutinin__InfluenzaA__ACZ05249

SEQ ID NO: 186619 - RNA, 1701 nt, Artificial Sequence; identical to SEQ ID NO: 186612
  derived and/or modified sequence opt5 from hemagglutinin__InfluenzaA__ACZ05260

SEQ ID NO: 186620 - RNA, 1701 nt, Artificial Sequence
  derived and/or modified sequence opt5 from hemagglutinin__InfluenzaA__ACZ05271
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccucuggacgcauuacaguuuccaccaagagaagccagcagacagugaucccgaacauuggcucccggccccgcgucagaaauaucccuucucggaucagcauuuacuggaccaucgugaaacccggggauauucugcugaucaacuccaccggaaaucucauugcuccucgcggcuacuucaagaucagaagcgggaaaucuuccaucaugcggagcgacgcccccauuggaaaguguaacucugaaugcaucacaccgaauggcagcauuccuaacgacaagcccuuucagaaugugaaccgcaucacguauggcgcuuguccuagauacgucaaacaaaauacccugaaacuugccacagggaugcggaacguucccgagcgccagaccagaggaauuuucggcgcgaucgccggguuuaucgaaaauggaugggagggcaugguggaugggugguauggauuccggcaccagaacuccgagggcagaggccaagcugccgaccugaagucuacacaggcugccauugaucagaucaaugggaagcucaaccgccugauuggaaaaaccaacgaaaaguuccaccagaucgagaaagaauuuagcgagguggaaggccggauucaagaccuugagaaguacgucgaggauacgaagaucgaccugugguccuauaaugccgaacuccugguggcucuggagaaccagcauacaauugaucucaccgacagcgaaaugaauaaacuguucgagaagaccaaaaagcagcuuagagaaaacgcggaggauauggggaauggaugcuuuaaaaucuaccacaagugugacaacgccugcaucggcucuauucgcaaugggacauaugaucaugacguuuaccgggacgaggcucugaacaauagauuccagaucaagggcguggaacucaaauccggauacaaggauuggauucuguggaucagcuuugccauuucuugcuuccuucugugugucgcccuccugggcuuuaucaugugggcuugccaaaaagggaacauccgcuguaauauuugcaucuga

SEQ ID NO: 186621 - RNA, 1701 nt, Artificial Sequence
  derived and/or modified sequence opt5 from hemagglutinin__InfluenzaA__ACZ05282
augaagaccacaaucgcccugagcuacauucucugccugguguucgcucagaaacuucccggcaacgacaauuccacggccacccugugucucgggcaccaugcggucccuaacggaacaaucguuaagaccauuacaaaugaucaaaucgaggugaccaacgcuacagaacuggugcagucuagcuccaccggcgagauuugcgacucuccgcaccagauccuugauggggaaaauuguacgcugaucgacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacccuugaauuuaacaaugagucuuucaacuggacaggagugacccagaauggcacauccagcgcuugcauucgcagaucuaacaauuccuuuuucagccggcugaacuggcucacccaucugaaguuuaaguauccugcccuuaaugucacgaugcccaacaacgagcaguucgacaaacuguacaucuggggcgugcaccauccugggacagauaaugaccagauuuuucucuaugcgcaagccucuggacgcaucaccguuuccacaaagagaagccagcagaccgugauuccgaacaucggcucccggccccgcgucagaaauauuccuucucggaucagcaucuacuggaccauugugaaacccggggauauccugcugauuaacuccacaggaaaucucaucgcuccucgcggcuacuucaagauucagagcgggaaaucuuccaucaugagaagcgacgcccccaucggaaaguguaacucugaaugcauuacgccgaauggcagcaucccuaacgacaagcccuuucaaaaugugaaccggauuaccuauggcgcuuguccucgcuacgucaaacagaauacacugaaacuugccaccgggaugagaaacguucccgagaagcagacacggggaaucuucggcgcgauugccggguuuaucgaaaauggaugggagggcaugguggaugggugguauggauuccgccaccaaaacuccgagggcagaggccaggcugccgaccugaagucuacccaggcugccaucgaucagauuaaugggaaacucaaccggcugaucggaaagacgaacgaaaaauuccaccaaauugagaaggaauuuagcgagguggaaggcagaauccaggaccuugagaaguacgucgaggauacaaaaauugaccugugguccuauaaugccgaacuccugguggcucuggagaaccagcauaccaucgaucucaccgacagcgaaaugaauaagcuguucgagaaaacaaagaaacagcuucgcgaaaacgcggaggauauggggaauggaugcuuuaagauuuaccacaagugugacaacgccugcaucggcucuauccggaaugggaccuaugaucaugacguuuacagagacgaggcucugaacaaucgcuuccaaauuaaaggcguggaacucaaguccggauacaaagauuggauccuguggauuagcuuugccaucucuugcuuccuucugugugucgcccuccugggcuuuauuaugugggcuugccagaaggggaacauccgguguaauaucugcauuuga

SEQ ID NO: 186622 - RNA, 1701 nt, Artificial Sequence; identical to SEQ ID NO: 186612
  derived and/or modified sequence opt5 from hemagglutinin__InfluenzaA__ACZ05304

SEQ ID NO: 186623 - RNA, 1701 nt, Artificial Sequence; identical to SEQ ID NO: 186435
  derived and/or modified sequence opt5 from hemagglutinin__InfluenzaA__ACZ05315

SEQ ID NO: 186624 - RNA, 1701 nt, Artificial Sequence; identical to SEQ ID NO: 186612
  derived and/or modified sequence opt5 from hemagglutinin__InfluenzaA__ACZ05326

SEQ ID NO: 186625 - RNA, 1701 nt, Artificial Sequence
  derived and/or modified sequence opt5 from hemagglutinin__InfluenzaA__ACZ05337
augaagaccaucauugcccugagcuacauccucugccugguguucacacagaaacuucccggcaacgacaauuccacggcuacccugugucucgggcaccaugccgucccuaacggaacaauuguuaagaccaucacaaaugaucaaauugaggugaccaacgcgacagaacuggugcagucuagcuccaccggcgagaucugcgacucuccgcaccagauccuugaugggaaaaauuguacgcugauugacgcucuccugggagauccccagugcgacggcuuucaaaacaagaaaugggaucuguucgucgaaagaagcaaggccuauuccaauuguuacccuuaugacgugcccgauuacgccucucuccggagccugguugcuuccagcgggacccuugaguuuaacaaugaacgcuucaacuggacaggagugacccagaauggcacaucuuccgccugcaucagacggagcaagaacuccuuuuucucucgccugaauuggcucacccaucugaacuuuaaauauccugcucuuaaugucacgaugcccaacaacgagcaguucgacaagcuguacauuuggggcgugcaccauccugggacagauaaagaccagaucuuucucuaugcccaagcgagcggaagaauuaccguuucuacaaagcggucccagcagaccgugaucccgaauauuggcagccgccccagaguccggaacaucccuucccgcaucucuauuuacuggaccaucgugaaacccggggauauucugcugaucagcuccacaggaaaucucauugccccuagaggcuacuucaagauccggagcgggaagucuuccaucaugcgcagcgacgcucccauuggaaaauguaacucugagugcaucacgccgaauggcagcauuccuaacgacaagcccuuucagaaugugaacagaaucaccuauggcgccuguccucgguacgucaaacaaaauacacugaaacuugcuaccgggaugcgcaacguucccgaaaaacagacaagaggaauuuucggcgccaucgcgggguuuaucgagaauggaugggaaggcaugguggaugggugguauggauuccggcaccagaacuccgagggcagaggccaagccgcugaccugaagucuacccaggccgcuauugaucagaucaaugggaaacucaaccgccugauuggaaagacgaaugagaaguuccaccagaucgaaaaagaguuuagcgaaguggagggccggauucaagaccuugaaaaguacgucgaggauacaaaaaucgaccugugguccuauaacgccgagcuccugguggcccuggaaaaccagcauaccauugaucucaccgacagcgagaugaauaagcuguucgaaaagacaaagaagcagcuuagagagaacgcugaagauauggggaauggaugcuuuaaaaucuaccacaagugugacaacgcgugcaucggcucuauucgcaaugggaccuaugaucaugacguuuaccgggacgaggcccugaacaauagauuccagaucaaaggcguggagcucaaguccggauuuaaagauuggauucuguggaucagcuucgcuauuucuugcuuucuucugugugucgcccuccugggcuucaucaugugggccugccaaaaggggaacauccgcuguaauauuugcaucuga

SEQ ID NO: 186626 - RNA, 1701 nt, Artificial Sequence; identical to SEQ ID NO: 186612
  derived and/or modified sequence opt5 from hemagglutinin__InfluenzaA__ACZ05348

SEQ ID NO: 186627 - RNA, 1701 nt, Artificial Sequence; identical to SEQ ID NO: 186617
  derived and/or modified sequence opt5 from hemagglutinin__InfluenzaA__ACZ05359

SEQ ID NO: 186628 - RNA, 1701 nt, Artificial Sequence; identical to SEQ ID NO: 186612
  derived and/or modified sequence opt5 from hemagglutinin__InfluenzaA__ACZ05370

SEQ ID NO: 186629 - RNA, 1701 nt, Artificial Sequence
  derived and/or modified sequence opt5 from hemagglutinin__InfluenzaA__ACZ05392
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcgcuuccagcgccugcauccgcagaucuaagaacuccuuuuucagccggcugaauuggcucacccaucugaacuuuaaauauccugcgcuuaaugucacaaugcccaacaacgagcaguucgacaagcuguacauuuggggcgugcaccauccugggaccgauaaagaccagaucuuucucuaugcccaggcuucuggacgcauuacgguuuccacaaagagaagccagcagaccgccaucccgaauauuggcucccggccccgcgugagaaacaucccuucucggaucagcauuuacuggacaaucgucaaacccggggauauucugcugaucaauuccaccggaaaccucauugcuccucgcggcuacuucaagaucagaagcgggaagucuuccaucaugcggagcgacgcccccauuggaaaauguaauucugagugcaucaccccgaacggcagcauuccuaaugacaagcccuuucagaacgugaaucgcaucacauauggcgcguguccuagauacgugaaacaaaacacgcugaaacuugccaccgggaugcggaauguccccgaaaaacagacacgcggaauuuucggcgcuaucgccggguuuaucgagaacggaugggaaggcaugguugaugggugguauggauucagacaccaaaauuccgagggccggggccaagcugccgaccugaagucuacccaggccgcuauugaucagaucaacgggaaacucaauagacugauuggaaagacaaacgagaaguuccaccagaucgaaaaagaguuuagcgaaguggagggccgcauucaagaccuugaaaaguacguggaggauaccaaaaucgaccugugguccuauaacgcggagcuccuggucgcccuggaaaaucagcauacgauugaucucacagacagcgagaugaacaagcuguucgaaaagaccaagaagcagcuucgggagaaugcugaagauauggggaacggaugcuuuaaaaucuaccacaagugugacaaugccugcaucggcucuauuagaaacgggaccuaugaucaugacguguaccgcgacgaggcccugaauaaccgguuccagaucaaaggcguugagcucaaguccggauacaaagauuggauucuguggaucagcuuugcuauuucuugcuuccuucuguguguggcccuccugggcuuuaucaugugggcgugccaaaaggggaauaucagauguaacauuugcaucuga

SEQ ID NO: 186630 - RNA, 1701 nt, Artificial Sequence; identical to SEQ ID NO: 186612
  derived and/or modified sequence opt5 from hemagglutinin__InfluenzaA__ACZ05403

SEQ ID NO: 186631 - RNA, 1701 nt, Artificial Sequence
  derived and/or modified sequence opt5 from hemagglutinin__InfluenzaA__ACZ05436
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaagcuguacccugauugacgcccuccugggagauccccagugcgacggcuuucaaaauaagaaaugggaucuguucgucgaaagauccaaggccuauucuaacuguuacccuuaugacgugcccgauuacgcuagccuccggucccugguugccagcucugggacgcuugaguuuaauaacgaauccuucaauuggaccggagugacacagaacggcaccagcucugcuugcauccgcagauccaagaauagcuuuuucucucggcugaacuggcucacacaucugaauuuuaaauauccugcccuuaacgucaccaugcccaauaacgagcaguucgacaagcuguacauuuggggcgugcaccauccugggacggauaaagaccagaucuuucucuaugcgcaagccuccggacgcauuacaguuagcaccaagagaucccagcagacagcuaucccgaacauuggcucucggccccgcgugagaaauaucccuagccggaucuccauuuacuggaccaucgucaaacccggggauauucugcugaucaacagcaccggaaaucucauugccccucgcggcuacuucaagaucagaucugggaaguccagcaucaugcggucugacgcucccauuggaaaauguaacagcgagugcaucacaccgaauggcuccauuccuaacgacaagcccuuucagaaugugaaccgcaucacguauggcgccuguccuagauacgugaaacaaaauacccugaaacuugcgacagggaugcggaacguccccgaaaaacagacccgcggaauuuucggcgccaucgcuggguuuaucgagaauggaugggaaggcaugguugaugggugguauggauucagacaccagaacucugagggccggggccaagccgcugaccucaagagcacacaggccgccauugaucagaucaaugggaaacugaacagacugauuggaaagaccaaugagaaguuccaccagaucgaaaaagaguuuuccgaaguggagggccgcauucaagaccuugaaaaguacguggaggauacgaaaaucgaccuguggagcuauaacgcugagcuccuggucgcgcuggaaaaccagcauacaauugaucucaccgacucugagaugaauaagcuguucgaaaagaccaagaagcagcuucgggagaacgccgaagauauggggaauggaugcuuuaaaaucuaccacaagugugacaacgcuugcaucggcuccauuagaaaugggacauaugaucaugacguguaccgcgacgaggcccugaacaaucgguuccagaucaaaggcguugagcucaagagcggauacaaagauuggauucuguggaucucuuuugccauuuccugcuuccuucuguguguggcucuccugggcuuuaucaugugggccugccaaaaggggaacaucagauguaauauuugcaucuga

SEQ ID NO: 186632 - RNA, 1701 nt, Artificial Sequence; identical to SEQ ID NO: 186612
  derived and/or modified sequence opt5 from hemagglutinin__InfluenzaA__ACZ05458

SEQ ID NO: 186633 - RNA, 1701 nt, Artificial Sequence; identical to SEQ ID NO: 186612
  derived and/or modified sequence opt5 from hemagglutinin__InfluenzaA__ACZ05469

SEQ ID NO: 186634 - RNA, 1701 nt, Artificial Sequence; identical to SEQ ID NO: 186631
  derived and/or modified sequence opt5 from hemagglutinin__InfluenzaA__ACZ05480

SEQ ID NO: 186635 - RNA, 1701 nt, Artificial Sequence; identical to SEQ ID NO: 186435
  derived and/or modified sequence opt5 from hemagglutinin__InfluenzaA__ACZ05513

SEQ ID NO: 186636 - RNA, 1701 nt, Artificial Sequence; identical to SEQ ID NO: 186612
  derived and/or modified sequence opt5 from hemagglutinin__InfluenzaA__ACZ05524

SEQ ID NO: 186637 - RNA, 1701 nt, Artificial Sequence
  derived and/or modified sequence opt5 from hemagglutinin__InfluenzaA__ACZ05535
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauccgcagaucuaagaacuccuuuuucagccggcugaauuggcucacacaucugaacuuuaaauauccugcccuuaaugucaccaugcccaacaacgagcaguucgacaagcuguacauuuggggcgugcaccauccugggacggauaaagaccagaucuuucucuaugcgcaagccucuggacgcauuacaguuuccaccaagagaagccagcagacagcuaucccgaauauuggcucccggccccgcgugagaaacaucccuucucggaucagcauuuacuggaccaucgucaaacccggggauauucugcugaucaauuccaccggaaaccucauugccccucgcggcuacuucaagaucagaagcgggaagucuuccaucaugcggagcgacgcucccauuggaaaauguaauucugagugcaucacaccgaacggcagcauuccuaaugacaagcccuuucagaacgugaaucgcaucacguauggcgccuguccuagauacgugaaacaaaacacccugaaacuugcgacagggaugcggaauguccccgaaaaacagacccgcggaauuuucggcgccaucgcuggguuuaucgagaacggaugggaaggcaugguugaugggugguauggauucagacaccaaaauuccgagggccggggccaggccgcugaccugaagucuacacaggccgccauugaucagaucaacgggaaacucaauagacugauuggaaagaccaacgagaaguuccaccagaucgaaaaagaguuuagcgaaguggagggccgcauucaagaccuugaaaaguacguggaggauacgaaaaucgaccugugguccuauaacgcugagcuccuggucgcgcuggaaaaucagcauacaauugaucucaccgacagcgagaugaacaagcuguucgaaaagaccaagaagcagcuucgggagaaugccgaagauauggggaacggaugcuuuaaaaucuaccacaagugugacaaugcuugcaucggcucuauuagaaacgggacauaugaucaugacguguaccgcgacgaggcccugaauaaccgguuccagaucaaaggcguugagcucaaguccggauacaaagauuggauucuguggaucagcuuugccauuucuugcuuccuucuguguguggcucuccugggcuuuaucaugugggccugccaaaaggggaauaucagauguaacauuugcaucuga

SEQ ID NO: 186638 - RNA, 1701 nt, Artificial Sequence; identical to SEQ ID NO: 186637
  derived and/or modified sequence opt5 from hemagglutinin__InfluenzaA__ACZ05546

SEQ ID NO: 186639 - RNA, 1701 nt, Artificial Sequence; identical to SEQ ID NO: 186612
  derived and/or modified sequence opt5 from hemagglutinin__InfluenzaA__ACZ05557

SEQ ID NO: 186640 - RNA, 1698 nt, Artificial Sequence
  derived and/or modified sequence opt5 from hemagglutinin__InfluenzaA__ACZ05579
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacagugaaaaauggccucuaccccaaccugucuaaguccuaugcuaauaacaaagagaaggaaguccuggugcucuggggagugcaccacccuccgaacaucgucgaccagaaaacccuguacagaacagagaaugccuacguuagcgugguguccucucauuauagccggaaguucacccccgaaauugcuaagcgcccuaaagucagagaucaggaggggcggaucaacuacuauuggacgcuucuggagcccggcgacacaauuaucuuugaagccaaugggaaccucauugcgccucgcuacgccuucgcucuguccagaggauuuggcagcgggaucauuaauucuaacgcccccauggauaagugugacgcuaaaugccagaccccgcggggagccaucaauuccagccuuccuuuccaaaacgugcaccccguuacaaucggcgaguguccuaaguaugugcgcucugcgaaacugagaauggucaccggccuccggaauauucccagcauccagucccgcgggcuguuuggagccauugcuggcuucaucgaagggggauggaccggcaugguggaugggugguacggauaucaucaccagaacgagcagggcucuggcuacgccgcugaccaaaagagcacacagaaugccauuaacgggaucacgaauaaaguuaacuccgugaucgaaaagaugaauacccaguuuacagccgucggaaaggaguucaacaaacuggagagacggauggaaaaccucaauaagaaaguggaugacggcuucauugauaucuggaccuacaacgcugagcugcuuguccugcucgaaaaugagcgcacacuggacuuucacgacagcaacgugaagaaucuuuaugaaaaaguuaagucucagcugaagaacaaugcgaaagagauugggaacggaugcuucgaguuuuaccauaaguguaaugaugaaugcauggaguccgugaaaaacggcaccuaugacuaccccaaguauagcgaagagucuaaacucaauagagagaagaucgauggggucaagcuggaauccaugggcguguaccaaauucuggccaucuauagcacgguugcuuccucucucgugcugcuugucagccugggagccaucuccuucuggaugugcucuaacggcagccuccagugucggauuugcaucuga

SEQ ID NO: 186641 - RNA, 1698 nt, Artificial Sequence
  derived and/or modified sequence opt5 from hemagglutinin__InfluenzaA__ACZ05590
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgagcaucuccgaccagaaaacccuguaccauacagaggaugccuacgugucugucguuagcucccacuauagcagaaaguucacccccgaaauugcuaagcggccuaaagugcgcgaccaggagggcagaaucaacuacuauuggacgcuucuggagcccggggauacaauuaucuuugaagccaauggaaaccucauugcgccucgguacgccuucgcucugucucgcggcuuuggguccggaaucauuaauagcaacgcccccaugggcaagugugacgcuaaaugccagaccccgcaaggcgccaucaauucuagccuuccuuuccagaacgugcaucccgucacaaucggggaguguccuaaguaugugagauccgcgaaacugcggaugguuaccggacuccgcaauauucccucuauccagagcagaggccuguuuggggccauugcuggauucaucgaaggcggguggaccggaaugguggauggcugguacggcuaucaccaccagaacgagcaaggguccggauacgccgcugaccaaaagagcacacagaaugccauuaacggcaucacgaauaaagucaacucugugaucgaaaagaugaauacccaguuuacagccguugggaaggaguucaacaaacuggagcggcgcauggaaaaucucaacaagaaaguggaugacggauucauugauaucuggaccuacaacgcugagcugcuuguccugcucgaaaaugagagaacacuggacuuucaugacuccaacgugaagaaucuuuaugaaaaagucaagagccagcugaagaacaaugcgaaagagauuggcaacgggugcuucgaguuuuaccacaaguguaaugaugaaugcauggagucugugaaaaacggcaccuaugacuaccccaaguauuccgaagagagcaaacucaaucgggagaagaucgauggaguuaagcuggaauccaugggcguguaccagauucuggccaucuauucuacggucgcuagcucccucgugcugcuuguuucucugggggccaucagcuucuggaugugcuccaacggaagccuccagugucgcauuugcaucuga

SEQ ID NO: 186642 - RNA, 1701 nt, Artificial Sequence; identical to SEQ ID NO: 186637
  derived and/or modified sequence opt5 from hemagglutinin__InfluenzaA__ACZ05950

SEQ ID NO: 186643 - RNA, 1701 nt, Artificial Sequence; identical to SEQ ID NO: 186612
  derived and/or modified sequence opt5 from hemagglutinin__InfluenzaA__ACZ05961

SEQ ID NO: 186644 - RNA, 1701 nt, Artificial Sequence
  derived and/or modified sequence opt5 from hemagglutinin__InfluenzaA__ACZ05972
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauccgcagaucuaagaacuccuuuuucagccggcugaauuggcucacacaucugaacuuuaaauauccugcccuuaaugucaccaugcccaacaacgagcaguucgacaagcuguacauuuggggcgugcaccauccugggacggauaaagaccagaucuuucucuaugcgcaagccucuggacgcauuacaguuuccaccaagagaagccagcagacagcuaucccgaauauuggcucccggccccgcgugagaaacaucccuucucggaucagcauuuacuggaccaucgucaaacccggggauauucugcugaucaauuccaccggaaaccucauugccccucgcggcuacuucaagaucagaagcgggaagucuuccaucaugcggagcgacgcucccauuggaaaauguaauucugagugcaucacaccgaacggcagcauuccuaaugacaagcccuuucagaacgugaaucgcaucacguauggcgccuguccuagauacgugaaacaaaacacccugaaacuugcgacagggaugcggaauguccccgaaaaacagacccgcggaauuuucggcgccaucgcuggguuuaucgagaacggaugggaaggcaugguugaugggugguauggauucagacaccaaaauuccgagggccggggccaggccgcugaccugaagucuacacaggccgccauugaucagaucaacgggaaacucaauagacugauuggaaagaccaacgagaaguuccaccagaucgaaaaagaguuuagcgaaguggagggccgcauucaagaccuugaaaaguacguggaggauacgaaaaucgaccugugguccuauaacgcugagcuccuggucgcgcuggaaaaucagcauacaauugaucucaccgacagcgagaugaacaagcuguucgaaaagaccaagaagcagcuucgggagaaugccgaagauauggggaacggaugcuuuaaaaucuaccacaagugugacaaugcuugcaucggcucuauuagaaacgggacauaugaucaugacguguaccgcgacgaggcccugaauaaccgguuccagaucaaaggcguugagcucaaguccggauacaaagauuggauucuguggaucagcuuugccauuucuugcucccuucuguguguggcucuccugggcuucaucaugugggccugccaaaaggggaauaucagauguaacauuugcaucuga

SEQ ID NO: 186645 - RNA, 1701 nt, Artificial Sequence
  derived and/or modified sequence opt5 from hemagglutinin__InfluenzaA__ACZ05983
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauccgcagaucuaagaacuccuuuuucagccggcugaauuggcucacacaucugaacuuuaaauauccugcccuuaaugucaccaugcccaacaacgagcaguucgacaagcuguacauuuggggcgugcaccauccugggacggauaaagaccagaucuuucucuaugcgcaagccucuggacgcauuacaguuuccaccaagagaagccagcagacagcuaucccgaauauuggcucccggccccgcgugagaaacaucccuucucggaucagcauuuacuggaccaucgucaaacccggggauauucugcugaucaauuccaccggaaaccucauugccccucgcggcuacuucaagaucagaagcgggaagucuuccaucaugcggagcgacgcucccauuggaaaauguaauucugagugcaucacaccgaacggcagcauuccuaaugacaagcccuuucagaacgugaaucgcaacacguauggcgccuguccuagauacgugaaacaaaauacccugaaacuugcgacagggaugcggaacguccccgaaaaacagacccgcggaaucuucggcgccauugcuggguuuaucgagaauggaugggaaggcaugguugaugggugguauggauucagacaccagaacuccgagggccggggccaagccgcugaccugaagucuacacaggccgccaucgaucagauuaaugggaaacucaacagacugaucggaaagaccaacgagaaguuccaccagauugaaaaagaguuuagcgaaguggagggccgcauccaagaccuugaaaaguacguggaggauacgaaaauugaccugugguccuauaaugcugagcuccuggucgcgcuggaaaaccagcauacaaucgaucucaccgacagcgagaugaauaagcuguucgaaaagaccaagaagcagcuucgggagaacgccgaagauauggggaauggaugcuuuaaaauuuaccacaagugugacaacgcuugcaucggcucuaucagaaaugggacauaugaucaugacguguaccgcgacgaggcccugaacaaucgguuccagauuaaaggcguugagcucaaguccggauacaaagauuggauccuguggauuagcuuugccaucucuugcuuccuucuguguguggcucuccugggcuuuauuaugugggccugccaaaaggggaacaucagauguaauaucugcauuuga

SEQ ID NO: 186646 - RNA, 1701 nt, Artificial Sequence
  derived and/or modified sequence opt5 from hemagglutinin__InfluenzaA__ACZ05994
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauccgcagaucuaagaacuccuuuuucagccggcugaauuggcucacacaucugaacuuuaaauauccugcccuuaaugucaccgugcccaacaacgagcaguucgacaagcuguacauuuggggcguucaccauccugggacggauaaagaccagaucuuucucuaugcgcaagccucuggacgcauuacaguguccaccaagagaagccagcagacagcuaucccgaauauuggcucccggccccgcgucagaaacaucccuucucggaucagcauuuacuggaccaucgugaaacccggggauauucugcugaucaauuccaccggaaaccucauugccccucgcggcuacuucaagaucagaagcgggaagucuuccaucaugcggagcgacgcucccauuggaaaauguaauucugagugcaucacaccgaacggcagcauuccuaaugacaagcccuuucagaacgugaaucgcaucacguauggcgccuguccuagauacgucaaacaaaacacccugaaacuugcgacagggaugcggaauguucccgaaaaacagacccgcggaauuuucggcgccaucgcuggguuuaucgagaacggaugggaaggcaugguggaugggugguauggauucagacaccaaaauuccgagggccggggccaggccgcugaccugaagucuacacaggccgccauugaucagaucaacgggaaacucaauagacugauuggaaagaccaacgagaaguuccaccagaucgaaaaagaguuuagcgaaguggagggccgcauucaagaccuugaaaaguacgucgaggauacgaaaaucgaccugugguccuauaacgcugagcuccugguggcgcuggaaaaucagcauacaauugaucucaccgacagcgagaugaacaagcuguucgaaaagaccaagaagcagcuucgggagaaugccgaagauauggggaacggaugcuuuaaaaucuaccacaagugugacaaugcuugcaucggcucuauuagaaacgggacauaugaucaugacguuuaccgcgacgaggcccugaauaaccgguuccagaucaaaggcguggagcucaaguccggauacaaagauuggauucuguggaucagcuuugccauuucuugcuuccuucugugugucgcucuccugggcuuuaucaugugggccugccaaaaggggaauaucagauguaacauuugcaucuga

SEQ ID NO: 186647 - RNA, 1701 nt, Artificial Sequence; identical to SEQ ID NO: 186612
  derived and/or modified sequence opt5 from hemagglutinin__InfluenzaA__ACZ06005

SEQ ID NO: 186648 - RNA, 1701 nt, Artificial Sequence; identical to SEQ ID NO: 186612
  derived and/or modified sequence opt5 from hemagglutinin__InfluenzaA__ACZ06016

SEQ ID NO: 186649 - RNA, 1698 nt, Artificial Sequence
  derived and/or modified sequence opt5 from hemagglutinin__InfluenzaA__ACZ16013
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaaaacuccuuuuaucgcaaucugcuuuggcugacaggcaaaaacgggcucuaccccaaucugagcaagucuuaugcuaacaacaaagagaaggaagugcugguccucuggggagugcaccacccuccgaauaucgccgaccagaaaacccuguaccauacagagaaggcuuacguguccgucguuagcucccacuauucuagaaaguucacccccgaaauugccaaacggccuaaggugcgcgaucaggagggcagaaucaacuacuauuggacgcuucuggagcccggggacacaauuaucuuugaagcgaauggaaaccucauugccccucgguacgcuuucgcccugagccgcggcuuuggguccggaaucauuaauagcaacgcucccauggauaaaugugacgccaagugccagaccccgcaaggcgcgaucaauucuucccuuccuuuccagaacgugcaucccgucacaaucggcgaguguccuaaauaugugagaagcgccaagcugcggaugguuaccgggcuccgcaauauucccucuauccagagcagaggacuguuuggcgcuauugccggguucaucgaaggaggcuggaccgggaugguggauggaugguacggcuaucaccaccagaacgagcaaggcuccggguacgcugccgaccagaaaucuacacagaaugccauuaacggaaucacgaauaaggucaacagcgugaucgaaaagaugaauacccaguuuacagcuguuggcaaagaguucaacaagcuggagcggcgcauggaaaaccucaauaaaaagguggaugacggguucauugauaucuggaccuacaacgcggagcugcuuguccugcucgaaaaugagagaacacuggacuuucaugacuccaacgugaaaaaucuuuaugaaaaggucaagagccaacugaaaaacaaugccaaggagauuggaaacggcugcuucgaguuuuaccacaaauguaaugaugaaugcauggagucugugaagaacgggaccuaugacuaccccaaauauuccgaagagagcaagcucaaucgggagaagaucgauggcguuaaacuggaaucuaugggaguguaccagauucuggcuaucuauuccacggucgccagcucccucgugcugcuuguuucucugggcgccaucagcuucuggaugugcuccaacgggucucuccagugucgcauuugcaucuga

SEQ ID NO: 186650 - RNA, 1698 nt, Artificial Sequence
  derived and/or modified sequence opt5 from hemagglutinin__InfluenzaA__ACZ16023
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaaaacuccuuuuaucgcaaucugcuuuggcugacaggcaaaaacgggcucuaccccaaucugagcaagucuuaugcuaacaacaaagagaaggaagugcugguccucuggggagugcaccacccuccgaauaucgccgaccagaaaacccuguaccauacagagaacgcuuacguguccgucguuagcucccacuauucuagaaaguucacccccgaaauugccaagcggccuaaagugcgcgaucaggagggcagaaucaauuacuauuggacgcuucuggagcccggggacacaauuaucuuugaagcgaacggaaaucucauugccccucgguacgcuuucgcccugagccgcggcuuuggguccggaaucauuaacagcaaugcucccauggauaagugugacgccaaaugccagaccccgcaaggcgcgaucaacucuucccuuccuuuccagaaugugcaucccgucacaaucggcgaguguccuaaguaugugagaagcgccaaacugcggaugguuaccgggcuccgcaacauucccucuauccagagcagaggacuguuuggcgcuauugccggguucaucgaaggaggcuggaccgggaugguggauggaugguacggcuaucaccaccagaaugagcaaggcuccggguacgcugccgaccagaagucuacacagaacgccauuaauggaaucacgaacaaagucaauagcgugaucgaaaagaugaacacccaguuuacagcuguuggcaaggaguucaacaaacuggagcggcgcauggaaaaucucaacaagaaaguggaugacggguucauugauaucuggaccuacaaugcggagcugcuuguccugcucgaaaacgagagaacacuggacuuucaugacuccaaugugaagaaccuuuaugaaaaagucaagagccaacugaagaauaacgccaaagagauuggaaauggcugcuucgaguuuuaccacaaguguaacgaugaaugcauggagucugugaaaaaugggaccuaugacuaccccaaguauuccgaagagagcaaacucaaccgggagaagaucgauggcguuaagcuggaaucuaugggaguguaccagauucuggcuaucuauuccacggucgccagcucccucgugcugcuuguuucucugggcgccaucagcuucuggaugugcuccaaugggucucuccagugucgcauuugcaucuga

SEQ ID NO: 186651 - RNA, 1698 nt, Artificial Sequence
  derived and/or modified sequence opt5 from hemagglutinin__InfluenzaA__ACZ16033
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggagccuccgcuagcugcucucauaauggcgaaaacuccuuuuaucgcaaucugcuuuggcugacaggcaaaaacgggcucuaccccaaucugagcaagucuuaugccaacaacaaagagaaggaaguucuggugcucuggggaguccaccacccuccgaauaucgcugaccagaaaacccuguaccauacagagaacgccuacguguccguggucagcucccacuauucuagaaaguucacccccgaaauugcgaagcggccuaaaguucgcgaucaggagggcagaaucaauuacuauuggacgcuucuggagcccggggacacaauuaucuuugaagccaacggaaaucucauugcuccucgguacgccuucgcucugagccgcggcuuuggguccggaaucauuaacagcaaugcccccauggauaagugugacgcgaaaugccagaccccgcaaggcgccaucaacucuucccuuccuuuccagaauauccaucccgugacaauuggcgaguguccuaaguaugugagaagcgcuaaacugcggauggucaccgggcuccgcaacauccccucuauucagagcagaggacuguuuggcgccaucgcuggguucauugaaggaggcuggaccgggaugguggauggaugguacggcuaucaccaccagaaugagcaaggcuccggguacgccgccgaccagaagucuacacagaacgcuaucaauggaaucacgaacaaaguuaauagcgugauugaaaagaugaacacccaguuuacagcggucggcaaggaguucaacaaacuggagcggcgcauggaaaaucucaacaagaaaguggaugacggguucaucgauauuuggaccuacaaugccgagcugcuuguucugcucgaaaacgagagaacacuggacuuucaugacuccaaugugaagaaccuuuaugaaaaagucaagagccaacugaagaauaacgcuaaagagaucggaaauggcugcuucgaguuuuaccacaaguguaacgaugaaugcauggagucugugaaaaaugggaccuaugacuaccccaaguauuccgaagagagcaaacucaacaaggagaagauugauggcgucaaacuggaaucuaugggaguguaccagauccuggccaucuauuccacgguugccagcucccucgugcugcuugucucucugggcgcuauuagcuucuggaugugcuccaaugggucucuccagugucggaucugcauuuga

SEQ ID NO: 186652 - RNA, 1701 nt, Artificial Sequence; identical to SEQ ID NO: 185680
  derived and/or modified sequence opt5 from hemagglutinin__InfluenzaA__ACZ16040

SEQ ID NO: 186653 - RNA, 1701 nt, Artificial Sequence; identical to SEQ ID NO: 185680
  derived and/or modified sequence opt5 from hemagglutinin__InfluenzaA__ACZ16050

SEQ ID NO: 186654 - RNA, 1701 nt, Artificial Sequence; identical to SEQ ID NO: 185680
  derived and/or modified sequence opt5 from hemagglutinin__InfluenzaA__ACZ16060

SEQ ID NO: 186655 - RNA, 1701 nt, Artificial Sequence
  derived and/or modified sequence opt5 from hemagglutinin__InfluenzaA__ACZ16070
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugucucuccuggaagauaagcacaacgggaaacuuuguaagcugagaggaguugcuccccuccaucugggcaaaugcaauaucgccggguggauucugggaaacccugagugugaaagccucuccacagccucuagcugguccuacaucguggagaccucuagcuccgacaauggcacgugcuauccgggggauuuuauugacuacgaagaacugcgggagcagcuuagcucugucuccagcuucgaacgcuuugagaucuuccccaagaccucuuccuggccuaaccacgauagcaauaagggagugacagccgcuuguccccaugccggcgcgaaaucuuuuuauaagaaccugaucuggcucguuaaaaagggcaauuccuacccuaaacugagcaaguccuauauuaacgacaaggggaaagaagugcuuguccuguggggaauccaccaccccucuaccagcgccgaucaacagucccucuaccagaaugcugacgccuacguguucgugggcagcucuagauauuccaagaaauuuaagccugagauugcuauccggccgaaaguccgcgaucaggaggggagaaugaacuacuauuggacacugguugaacccggagacaagauuaccuucgaggccacgggcaaucugguggugccucgguacgcguuugccauggaacgcaacgcugggagcggaaucauuaucucugauacacccguccaugacugcaacaccacaugucaaaccccuaaaggcgccaucaauaccagccuccccuuccagaacauucacccgaucacaauuggcaagugcccuaaguaugugaaauccacgaagcugagacuugcuaccgggcugcggaauguucccucuauccagagccgcggacucuuuggcgccauugccggguucaucgagggaggcuggacagggaugguggacggaugguacggcuaucaucaccagaacgaacaaggcuccggguacgcugcggaucugaaaagcacccagaaugccaucgacgagauuacaaacaaggucaauucugugaucgagaaaaugaacacccaguuuacggcuguuggaaaggaguucaaucaccuugagaagagaauugaaaaccugaauaaaaagguggaugacggcuuccucgauaucuggacauacaacgccgagcugcugguccuccuggaaaaugagcggacccuugacuaucaugauuccaacgugaaaaaucuguacgagaagguccgcagccagcucaaaaacaacgccaaggaaauugggaauggauguuuugaguucuaucacaagugcgacaacaccuguauggaaucugugaaaaauggcacauacgauuauccuaaguacuccgaggaagcuaaacugaacagagaggagaucgacgggguuaaacuugaaagcacccggaucuaucaaauucuggccaucuacuccacaguggcgucuagccucguccuggugguuucccugggcgcuauuucuuuuuggaugugcagcaauggaucccuccagugccgcaucuguauuuga

SEQ ID NO: 186656 - RNA, 1701 nt, Artificial Sequence
  derived and/or modified sequence opt5 from hemagglutinin__InfluenzaA__ACZ16080
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgauggguccggaaucauuaucagcgacacacccguccaugacugcaauaccacaugucaaaccccuaaaggcgcuaucaacaccucucuccccuuccagaauauucacccgaucacaauuggcaagugcccuaaguaugugaaaagcacgaagcugagacuugccaccgggcugcggaacguucccuccauccagucucgcggacucuuuggcgcuauugccggguucaucgagggaggcuggacagggaugguggauggaugguacggcuaucaucaccagaaugaacaaggcagcggguacgccgcugaccugaaauccacccagaacgcgaucgaugagauuacaaauaaggucaacagcgugaucgagaaaaugaauacccaguuuacggccguuggaaaggaguucaaccaccuugagaagagaauugaaaaucugaacaaaaagguggacgauggcuuccucgacaucuggacauacaaugcugagcugcugguccuccuggaaaacgagcggacccuugauuaucaugacucuaaugugaaaaaccuguacgagaagguccgcucccagcucaaaaacaaugccaaggaaauugggaacggauguuuugaguucuaucacaagugcgauaauaccuguauggaaagcgugaaaaacggcacauacgacuauccuaaguacucugaggaagccaaacugaauagagaggagaucgaugggguuaaacuugaauccacccggaucuaucaaauucuggcuaucuacagcacaguggccuccucucucguccuggugguuagccugggcgcgauuuccuuuuggaugugcucuaacggaagccuccagugccgcaucuguauuuga

SEQ ID NO: 186657 - RNA, 1701 nt, Artificial Sequence
  derived and/or modified sequence opt5 from hemagglutinin__InfluenzaA__ACZ16090
augaaggccauccugcucgugcugcuuuacaccuucgcuacagccaacgcggacacgcugugcauuggcuaucacgcuaauaacagcaccgauacagucgacaccguucucgagaaaaaugugacagugacccauuccgucaaccugcuugaagauaagcacaaugggaaacuguguaagcucagaggaguggcuccccugcaucugggcaaaugcaacaucgccggguggauucucggaaauccugagugugaaucucugagcacagccuccucuuggagcuacaucguugagaccuccucuagcgacaacggcacgugcuauccgggggauuuuauugacuacgaagaacuucgggagcagcuguccagcaugucuuccuucgaacgcuuugagaucuuccccaagaccagcucuuggccuaaucacgauuccaacaagggagugacagccgcuuguccccaugccggcgcgaaaucuuuuuauaagaaucucaucuggcuggucaaaaagggcaacagcuacccuaaacuuuccaagagcuauauuaaugacaaggggaaagaagugcugguucucuggggaauccaccaccccuccaccucugccgaucaacagagccuguaccagaacgcugacgccuacguguucgucggcuccagcagauauucuaagaaauuuaagccugagauugcuauccggccgaaagugcgcgaucaggaggggagaaugaauuacuauuggacacugguggaacccggagacaagauuaccuucgaggccacgggcaaccucgucguuccucgguacgcguuugccauggaacgcaacgcuggguccggaaucauuaucagcgauacacccgugcaugacugcaauaccacaugucaaaccccuaaaggcgccaucaacaccucucugcccuuccagaauauucacccgaucacaauuggcaagugcccuaaguaugugaaaagcacgaaacuuagacuggcuaccgggcuccggaacguccccuccauccagucucgcggacuguuuggcgccauugccggguucaucgagggaggcuggacagggaugguggacggaugguacggcuaucaucaccagaaugaacaaggcagcggguacgcugcggaucuuaaguccacccagaacgccaucgacgagauuacaaauaagguuaacagcgugaucgagaaaaugaauacccaguuuacggcugucggaaaggaguucaaccaccuggagaagagaauugaaaaucucaacaaaaagguggaugacggcuuccuggauaucuggacauacaaugccgagcugcucguucugcuugaaaacgagcggacccuggacuaucaugauucuaaugugaaaaaccucuacgagaagguccgcucccagcugaaaaacaaugccaaggaaauugggaacggauguuuugaguucuaucacaagugcgacaauaccuguauggaaagcgugaaaaacggcacauacgauuauccuaaguacucugaggaagcuaaacuuaauagagaggagaucgacggggucaagcuggaauccacccggaucuaucaaauucucgccaucuacagcacaguggcguccucucugguucugguggucagccucggcgcuauuuccuuuuggaugugcucuaacggaagccugcagugccgcaucuguauuuga

SEQ ID NO: 186658 - RNA, 1701 nt, Artificial Sequence; identical to SEQ ID NO: 185680
  derived and/or modified sequence opt5 from hemagglutinin__InfluenzaA__ACZ16100

SEQ ID NO: 186659 - RNA, 1701 nt, Artificial Sequence; identical to SEQ ID NO: 185680
  derived and/or modified sequence opt5 from hemagglutinin__InfluenzaA__ACZ16110

SEQ ID NO: 186660 - RNA, 1701 nt, Artificial Sequence; identical to SEQ ID NO: 185680
  derived and/or modified sequence opt5 from hemagglutinin__InfluenzaA__ACZ16120

SEQ ID NO: 186661 - RNA, 1701 nt, Artificial Sequence; identical to SEQ ID NO: 186428
  derived and/or modified sequence opt5 from hemagglutinin__InfluenzaA__ACZ16130

SEQ ID NO: 186662 - RNA, 1701 nt, Artificial Sequence; identical to SEQ ID NO: 185680
  derived and/or modified sequence opt5 from hemagglutinin__InfluenzaA__ACZ16140

SEQ ID NO: 186663 - RNA, 1701 nt, Artificial Sequence; identical to SEQ ID NO: 185680
  derived and/or modified sequence opt5 from hemagglutinin__InfluenzaA__ACZ16150

SEQ ID NO: 186664 - RNA, 1701 nt, Artificial Sequence; identical to SEQ ID NO: 185680
  derived and/or modified sequence opt5 from hemagglutinin__InfluenzaA__ACZ16160

SEQ ID NO: 186665 - RNA, 1701 nt, Artificial Sequence; identical to SEQ ID NO: 185873
  derived and/or modified sequence opt5 from hemagglutinin__InfluenzaA__ACZ16170

SEQ ID NO: 186666 - RNA, 1701 nt, Artificial Sequence
  derived and/or modified sequence opt5 from hemagglutinin__InfluenzaA__ACZ16180
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucuacacagccagcuccuggucuuauaucguggagaccagcuccucugacaacggcacgugcuacccgggggauuuuauugacuaugaagaacugcgggagcagcuuagcuccgucagcucuuucgaacgcuuugagaucuuccccaagaccuccagcuggccuaaucacgauucuaacaagggagugacagccgcuuguccccaugccggcgcgaaauccuuuuacaagaaucugaucuggcucguuaaaaagggcaacagcuauccuaaacugucuaaguccuacauuaaugacaaggggaaagaagugcuuguccuguggggaauccaccaccccagcaccuccgccgaucaacagucucucuaccagaacgcugacgccuauguguucgugggcagcuccagauacagcaagaaauuuaagccugagauugcuauccggccgaaaguccgcgaucaggaggggagaaugaauuauuacuggacacugguugaacccggagacaagauuaccuucgaggccacgggcaaccugguggugccucgguaugcguuugccauggaacgcaacgcugggucuggaaucauuaucuccgauacacccguccaugacugcaauaccacaugucaaaccccuaaaggcgccaucaacaccagccuccccuuccagaauauucacccgaucacaauuggcaagugcccuaaguacgugaaaucuacgaagcugagacuugcuaccgggcugcggaacguucccagcauccagucccgcggacucuuuggcgccauugccggguucaucgagggaggcuggacagggaugguggacggaugguauggcuaccaucaccagaaugaacaaggcucuggguacgcugcggaucugaaaagcacccagaacgccaucgacgagauuacaaauaaggucaacuccgugaucgagaaaaugaauacccaguuuacggcuguuggaaaggaguucaaccaccuugagaagagaauugaaaaucugaacaaaaagguggaugacggcuuccucgauaucuggacauauaaugccgagcugcugguccuccuggaaaacgagcggacccuugacuaccaugauagcaaugugaaaaaccuguaugagaagguccgcucucagcucaaaaacaaugccaaggaaauugggaacggauguuuugaguucuaccacaagugcgacaauaccuguauggaauccgugaaaaacggcacauaugauuacccuaaguauagcgaggaagcuaaacugaauagagaggagaucgacgggguuaaacuugaaucuacccggaucuaccaaauucuggccaucuacuccacaguggcgagcucccucguccuggugguuucucugggcgcuauuagcuuuuggaugugcuccaacggaucucuccagugccgcaucuguauuuga

SEQ ID NO: 186667 - RNA, 1701 nt, Artificial Sequence; identical to SEQ ID NO: 185680
  derived and/or modified sequence opt5 from hemagglutinin__InfluenzaA__ACZ16190

SEQ ID NO: 186668 - RNA, 1701 nt, Artificial Sequence
  derived and/or modified sequence opt5 from hemagglutinin__InfluenzaA__ACZ16200
augaaggccauccuggugguccuccuguacaccuucgcuacagccaaccccgacacgcuuugcauuggcuaucacgcgaauaacagcaccgauacaguugacaccgugcuggagaaaaaugugacagucacccauuccgugaaccuccuggaagauaagcacaaugggaaacuuuguaagcugagaggaguugcuccucuccaucugggcaaaugcaacaucgccggguggauucugggaaauccggagugugaaucucucagcacagccuccucuuggagcuacaucguggagaccuccucuagcgacaacggcacgugcuaucccggggauuuuauugacuacgaagaacugcgggagcagcuuuccagcgucucuuccuucgaacgcuuugagaucuucccuaagaccagcucuuggcccaaucacgauuccaacaagggagugacagcugccuguccucaugcuggcgccaagagcuuuuauaagaaucugaucuggcucguuaaaaagggcaacucuuaccccaaacuguccaagagcuauauuaaugacaaggggaaagaagugcuuguccuguggggaauccaccacccuuccaccucugcggaucaacagagccucuaccagaacgccgacgcuuacguguucgugggcuccagcagauauucuaagaaauuuaagccggagauugccauccggcccaaaguccgcgaucaggaggggagaaugaauuacuauuggacacugguugaaccuggagacaagauuaccuucgaggcuacgggcaaccugguggugccccgguacgccuuugcgauggaacgcaacgccggguccggaaucauuaucagcgauacaccuguccaugacugcaauaccacaugucaaacccccaaaggcgcuaucaacaccucucucccguuccagaauauucacccuaucacaauuggcaagugccccaaguaugugaaaagcacgaagcugagacuugccaccgggcugcggaacguuccuuccauccagucucgcggacucuuuggcgcuauugccggguucaucgagggaggcuggacagggaugguggacggaugguacggcuaucaucaccagaaugaacaaggcagcggguacgccgcugaucugaaauccacccagaacgcgaucgacgagauuacaaauaaggucaacagcgugaucgagaaaaugaauacccaguuuacggccguuggaaaggaguucaaccaccuugagaagagaauugaaaaucugaacaaaaagguggaugacggcuuccucgauaucuggacauacaaugcugagcugcugguccuccuggaaaacgagcggacccuugacuaucaugauucuaaugugaaaaaccuguacgagaagguccgcucccagcucaaaaacaaugccaaggaaauugggaacggauguuuugaguucuaucacaagugcgacaauaccuguauggaaagcgugaaaaacggcacauacgauuaucccaaguacucugaggaagccaaacugaauagagaggagaucgacgggguuaaacuugaauccacccggaucuaucaaauucuggcuaucuacagcacaguggccuccucucucguccuggugguuagccugggcgcgauuuccuuuuggaugugcucuaacggaagccuccagugccgcaucuguauuuga

SEQ ID NO: 186669 - RNA, 1701 nt, Artificial Sequence; identical to SEQ ID NO: 185680
  derived and/or modified sequence opt5 from hemagglutinin__InfluenzaA__ACZ16210

SEQ ID NO: 186670 - RNA, 1701 nt, Artificial Sequence; identical to SEQ ID NO: 185680
  derived and/or modified sequence opt5 from hemagglutinin__InfluenzaA__ACZ16220

SEQ ID NO: 186671 - RNA, 1701 nt, Artificial Sequence; identical to SEQ ID NO: 186428
  derived and/or modified sequence opt5 from hemagglutinin__InfluenzaA__ACZ16230

SEQ ID NO: 186672 - RNA, 1701 nt, Artificial Sequence
  derived and/or modified sequence opt5 from hemagglutinin__InfluenzaA__ACZ16240
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggauccagcagauauucuaagaaauuuaagccugagaucgcuauucggccgaaaguccgcgaucaggaggggagaaugaauuacuauuggacacucguugaacccggagacaagaucaccuucgaggccacgggcaaccugguggugccucgguacgcguuugccauggaacgcaacgcuggguccggaauuaucaucagcgauacacccguccaugacugcaauaccacaugucaaaccccuaaaggcgccauuaacaccucucugcccuuccagaauauccacccgauuacaaucggcaagugcccuaaguaugugaaaagcacgaagcucagacuggcuaccgggcuucggaacguucccuccauucagucucgcggacuguuuggcgccaucgccggguucaucgagggaggcuggacagggaugguggacggaugguacggcuaucaucaccagaaugaacaaggcagcggguacgcugcggaucucaaauccacccagaacgcccuggacgagauuacaaauaaggucaacagcgugaucgagaaaaugaauacccaguuuacggcuguuggaaaggaguucaaccaccuugagaagagaauugaaaaucugaacaaaaagguggaugacggcuuccucgauaucuggacauacaaugccgagcugcugguccuccuggaaaacgagcggacccuugacuaucaugauucuaaugugaaaaaccuguacgagaagguccgcucccagcucaaaaacaaugccaaggaaauugggaacggauguuuugaguucuaucacaagugcgacaauaccuguauggaaagcgugaaaaacggcacauacgauuauccuaaguacucugaggaagcuaaacugaauagagaggagaucgacgggguuaaacuugaauccacccggaucuaucaaauucuggccaucuacagcacaguggcguccucucucguccuggugguuagccugggcgcuauuuccuuuuggaugugcucuaacggaagccuccagugccgcaucuguauuuga

SEQ ID NO: 186673 - RNA, 1701 nt, Artificial Sequence; identical to SEQ ID NO: 185680
  derived and/or modified sequence opt5 from hemagglutinin__InfluenzaA__ACZ16260

SEQ ID NO: 186674 - RNA, 1701 nt, Artificial Sequence
  derived and/or modified sequence opt5 from hemagglutinin__InfluenzaA__ACZ16270
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagaaccucuaccagaaugcugacgccuacguguucgugggcagcuccagauauagcaagaaauuuaagccugagauugcuauccggccgaaaguccgcgaucaggaggggagaaugaacuacuauuggacacugguugaacccggagacaagauuaccuucgaggccacgggcaaccugguggugccucgguacgcguuugccauggaacgcaaugcugggucuggaaucauuaucuccgauacacccguccaugacugcaacaccacaugucaaaccccuaaaggcgccaucaauaccagccuccccuuccagaacauucacccgaucacaauuggcaagugcccuaaguaugugaaaucuacgaagcugagacuugcuaccgggcugcggaauguucccagcauccagucccgcggacucuuuggcgccauugccggguucaucgagggaggcuggacagggaugguggacggaugguacggcuaucaucaccagaacgaacaaggcucuggguacgcugcggaucugaaaagcacccagaaugccaucgacgagauuacaaacaaggucaauuccgugaucgagaaaaugaacacccaguuuacggcuguuggaaaggaguucaaucaccuugagaagagaauugaaaaccugaauaaaaagguggaugacggcuuccucgauaucuggacauacaacgccgagcugcugguccuccuggaaaaugagcggacccuugacuaucaugauagcaacgugaaaaaccuguacgagaagguccgcucucagcucaaaaauaacgccaaggaaauugggaauggauguuuugaguucuaucacaagugcgacaacaccuguauggaauccgugaaaaauggcacauacgauuauccuaaguacagcgaggaagcuaaacugaacagagaggagaucgacgggguuaaacuugaaucuacccggaucuaucaaauucuggccaucuacuccacaguggcgagcucccucauucuggucgugucucugggcgcuaucagcuuuuggaugugcuccaauggaucucuccagugccgcauuuguaucuga

SEQ ID NO: 186675 - RNA, 1701 nt, Artificial Sequence; identical to SEQ ID NO: 186355
  derived and/or modified sequence opt5 from hemagglutinin__InfluenzaA__ACZ16280

SEQ ID NO: 186676 - RNA, 1701 nt, Artificial Sequence; identical to SEQ ID NO: 185680
  derived and/or modified sequence opt5 from hemagglutinin__InfluenzaA__ACZ16290

SEQ ID NO: 186677 - RNA, 1701 nt, Artificial Sequence
  derived and/or modified sequence opt5 from hemagglutinin__InfluenzaA__ACZ16300
augaaggccauccuggugguccuccuguacaccuucgcuacagccaacgcggacacgcuuugcauuggcuaucacgcuaauaacagcaccgauacaguugacaccgugcuggagaaaaaugugaucgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacauccucuagcgacaacggaaccugcuauccgggggauuuuaucgacuacgaagaacugcgggagcagcuuuccagcgucucuuccuucgaacgcuuugagaucuuccccaagacgagcucuuggccuaaucacgauuccaacaagggagugaccgccgcuuguccccaugccggcgcgaaaucuuuuuauaagaaucugauuuggcucguuaaaaagggcaacagcuacccuaaacuguccaagagcuauaucaaugacaaggggaaagaagugcuuguccuguggggcauucaccaccccuccacaucugccgaucaacagagccucuaccagaacgcugacgccuacguguucgugggcuccagcagauauucuaagaaauuuaagccugagaucgcuauucggccgaaaguccgcgaucaggaggggagaaugaauuacuauuggacccugguugaacccggagacaagaucacauucgaggccaccggcaaccugcucgugccucgguacgcguuugccauggaacgcaacgcuggguccggaauuaucaucagcgauacgcccgugcaugacugcaauacaaccugucaaacaccuaaaggcgccauuaacaccucucugcccuuccagaauauccacccgauuaccaucggcaagugcccuaaguaugucaaaagcacaaaacuuagacuggcuacggggcuccggaacgugcccuccauucagucucgcggacuguuuggcgccaucgccggguucaucgagggaggcuggaccgggaugguugacggaugguacggcuaucaucaccagaaugaacaaggcagcggguacgcugcggaucuuaaguccacacagaacgccauugacgagaucaccaauaaggugaacagcgucauugagaaaaugaauacacaguuuaccgcugugggaaaggaguucaaccaccuggagaagagaaucgaaaaucucaacaaaaagguugaugacggcuuccuggauauuuggacguacaaugccgagcugcucgugcugcuugaaaacgagcggacacuggacuaucaugauucuaaugucaaaaaccucuacgagaaggugcgcucccagcugaaaaacaaugccaaggaaaucgggaacggauguuuugaguucuaucacaagugcgacaauaccuguauggaaagcgucaaaaacggcaccuacgauuauccuaaguacucugaggaagcuaaacuuaauagagaggagaucgacggggugaagcuggaauccacacggauuuaucaaauccucgccauuuacagcaccguugcguccucucuggugcuggucgugagccucggcgcuaucuccuuuuggaugugcucuaacggaagccugcagugccgcauuuguaucuga

SEQ ID NO: 186678 - RNA, 1701 nt, Artificial Sequence; identical to SEQ ID NO: 186423
  derived and/or modified sequence opt5 from hemagglutinin__InfluenzaA__ACZ16310

SEQ ID NO: 186679 - RNA, 1701 nt, Artificial Sequence
  derived and/or modified sequence opt5 from hemagglutinin__InfluenzaA__ACZ16320
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucuccccuuccagaauauucacccgaucacaauuggcaagugcccuaaguaugugaaaagcacgagacugcggcuugcuaccgggcugcgcaacguucccuccauccagucuagaggacucuuuggcgccauugccggguucaucgagggaggcuggacagggaugguggacggaugguacggcuaucaucaccagaaugaacaaggcagcggguacgcugcggaucugaaguccacccagaacgccaucgacgagauuacaaauaaagucaacagcgugaucgagaagaugaauacccaguuuacggcuguuggaaaagaguucaaccaccuugagaagcggauugaaaaucugaacaagaaaguggaugacggcuuccucgauaucuggacauacaaugccgagcugcugguccuccuggaaaacgagcgcacccuugacuaucaugauucuaaugugaagaaccuguacgagaaagucagaucccagcucaagaacaaugccaaagaaauugggaacggauguuuugaguucuaucacaagugcgacaauaccuguauggaaagcgugaagaacggcacauacgauuauccuaaauacucugaggaagcuaagcugaaucgggaggagaucgacgggguuaaacuugaauccacccgcaucuaucaaauucuggccaucuacagcacaguggcguccucucucguccuggugguuagccugggcgcuauuuccuuuuggaugugcucuaacggaagccuccagugcagaaucuguauuuga

SEQ ID NO: 186680 - RNA, 1701 nt, Artificial Sequence; identical to SEQ ID NO: 186423
  derived and/or modified sequence opt5 from hemagglutinin__InfluenzaA__ACZ16330

SEQ ID NO: 186681 - RNA, 1701 nt, Artificial Sequence; identical to SEQ ID NO: 185873
  derived and/or modified sequence opt5 from hemagglutinin__InfluenzaA__ACZ16340

SEQ ID NO: 186682 - RNA, 1701 nt, Artificial Sequence; identical to SEQ ID NO: 185680
  derived and/or modified sequence opt5 from hemagglutinin__InfluenzaA__ACZ16350

SEQ ID NO: 186683 - RNA, 1701 nt, Artificial Sequence; identical to SEQ ID NO: 185680
  derived and/or modified sequence opt5 from hemagglutinin__InfluenzaA__ACZ16360

SEQ ID NO: 186684 - RNA, 1701 nt, Artificial Sequence; identical to SEQ ID NO: 185873
  derived and/or modified sequence opt5 from hemagglutinin__InfluenzaA__ACZ16370

SEQ ID NO: 186685 - RNA, 1701 nt, Artificial Sequence; identical to SEQ ID NO: 185680
  derived and/or modified sequence opt5 from hemagglutinin__InfluenzaA__ACZ16380

SEQ ID NO: 186686 - RNA, 1701 nt, Artificial Sequence; identical to SEQ ID NO: 185680
  derived and/or modified sequence opt5 from hemagglutinin__InfluenzaA__ACZ16390

SEQ ID NO: 186687 - RNA, 1701 nt, Artificial Sequence; identical to SEQ ID NO: 185680
  derived and/or modified sequence opt5 from hemagglutinin__InfluenzaA__ACZ16400

SEQ ID NO: 186688 - RNA, 1701 nt, Artificial Sequence; identical to SEQ ID NO: 185680
  derived and/or modified sequence opt5 from hemagglutinin__InfluenzaA__ACZ16410

SEQ ID NO: 186689 - RNA, 1701 nt, Artificial Sequence; identical to SEQ ID NO: 186317
  derived and/or modified sequence opt5 from hemagglutinin__InfluenzaA__ACZ16420

SEQ ID NO: 186690 - RNA, 1701 nt, Artificial Sequence; identical to SEQ ID NO: 185680
  derived and/or modified sequence opt5 from hemagglutinin__InfluenzaA__ACZ16430

SEQ ID NO: 186691 - RNA, 1701 nt, Artificial Sequence; identical to SEQ ID NO: 185680
  derived and/or modified sequence opt5 from hemagglutinin__InfluenzaA__ACZ16440

SEQ ID NO: 186692 - RNA, 1701 nt, Artificial Sequence
  derived and/or modified sequence opt5 from hemagglutinin__InfluenzaA__ACZ16450
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguuaagcccggagacaaaauuaccuucgaagccacgggcaaccugguggugccucgguacgcguuugccauggagcgcaacgcuggguccggaaucauuaucagcgauacacccguccaugacugcaauaccacaugucaaaccccuaagggcgccaucaacaccucucuccccuuccagaauauucacccgaucacaauuggcaagugcccuaaauaugugaaaagcacgaaacugagacuugcuaccgggcugcggaacguucccuccauccagucucgcggacucuuuggcgccauugccggguucaucgaaggaggcuggacagggaugguggacggaugguacggcuaucaucaccagaaugagcaaggcagcggguacgcugcggaucugaaguccacccagaacgccaucgacgaaauuacaaauaaagucaacagcgugaucgagaagaugaauacccaguuuacggcuguuggaaaggaguucaaccaccuugaaaagagaauugagaaucugaacaagaaaguggaugacggcuuccucgauaucuggacauacaaugccgaacugcugguccuccuggagaacgaacggacccuugacuaucaugauucuaaugugaagaaccuguacgagaaaguccgcucccagcucaagaacaaugccaaggagauugggaacggauguuuugaguucuaucacaaaugcgacaauaccuguauggagagcgugaagaacggcacauacgauuauccuaaauacucugaagaggcuaagcugaauagagaagagaucgacgggguuaaacuugaguccacccggaucuaucaaauucuggccaucuacagcacaguggcguccucucucguccuggugguuagccugggcgcuauuuccuuuuggaugugcucuaacggaagccuccagugccgcaucuguauuuga

SEQ ID NO: 186693 - RNA, 1701 nt, Artificial Sequence; identical to SEQ ID NO: 185873
  derived and/or modified sequence opt5 from hemagglutinin__InfluenzaA__ACZ16460

SEQ ID NO: 186694 - RNA, 1701 nt, Artificial Sequence; identical to SEQ ID NO: 185680
  derived and/or modified sequence opt5 from hemagglutinin__InfluenzaA__ACZ16470

SEQ ID NO: 186695 - RNA, 1701 nt, Artificial Sequence; identical to SEQ ID NO: 185680
  derived and/or modified sequence opt5 from hemagglutinin__InfluenzaA__ACZ16480

SEQ ID NO: 186696 - RNA, 1701 nt, Artificial Sequence; identical to SEQ ID NO: 186428
  derived and/or modified sequence opt5 from hemagglutinin__InfluenzaA__ACZ16490

SEQ ID NO: 186697 - RNA, 1701 nt, Artificial Sequence; identical to SEQ ID NO: 185680
  derived and/or modified sequence opt5 from hemagglutinin__InfluenzaA__ACZ16500

SEQ ID NO: 186698 - RNA, 1701 nt, Artificial Sequence; identical to SEQ ID NO: 185873
  derived and/or modified sequence opt5 from hemagglutinin__InfluenzaA__ACZ16510

SEQ ID NO: 186699 - RNA, 1701 nt, Artificial Sequence; identical to SEQ ID NO: 185680
  derived and/or modified sequence opt5 from hemagglutinin__InfluenzaA__ACZ16530

SEQ ID NO: 186700 - RNA, 1701 nt, Artificial Sequence
  derived and/or modified sequence opt5 from hemagglutinin__InfluenzaA__ACZ16540
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaggaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggauccagcagauauucuaagaaauuuaagccugagaucgcuauucggccgaaaguccgcgaucaggaggggagaaugaauuacuauuggacacucguugaacccggagacaagaucaccuucgaggccacgggcaaccugguggugccucgguacgcguuugccauggaacgcaacgcuggguccggaauuaucaucagcgauacacccguccaugacugcaauaccacaugucaaaccccuaaaggcgccauuaacaccucucugcccuuccagaauauccacccgauuacaaucggcaagugcccuaaguaugugaaaagcacgaagcucagacuggcuaccgggcuucggaacguucccuccauucagucucgcggacugcucggcgccaucgccggguuuaucgagggaggcuggacagggaugguggacggaugguacggcuaucaucaccagaaugaacaaggcagcggguacgcugcggaucugaaauccacccagaacgccauugacgagaucacaaauaaggucaacagcgugauugagaaaaugaauacccaguucacggcuguuggaaaggaauuuaaccaccuugagaagagaaucgaaaaucugaacaaaaagguggaugacggcuuccucgauauuuggacauacaaugccgagcugcugguccuccuggaaaacgagcggacccuugacuaucaugauucuaaugugaaaaaccuguacgagaagguccgcucccagcucaaaaacaaugccaaggaaaucgggaacggauguuucgaguuuuaucacaagugcgacaauaccuguauggaaagcgugaaaaacggcacauacgauuauccuaaguacucugaggaagcuaaacugaauagagaggagaucgacgggguuaaacuugaauccacccggauuuaucaaauccuggccauuuacagcacaguggcguccucucucguccuggugguuagccugggcgcuaucuccuucuggaugugcucuaacggaagccuccagugccgcauuuguaucuga

SEQ ID NO: 186701 - RNA, 1701 nt, Artificial Sequence; identical to SEQ ID NO: 186423
  derived and/or modified sequence opt5 from hemagglutinin__InfluenzaA__ACZ16550

SEQ ID NO: 186702 - RNA, 1701 nt, Artificial Sequence; identical to SEQ ID NO: 185680
  derived and/or modified sequence opt5 from hemagglutinin__InfluenzaA__ACZ16583

SEQ ID NO: 186703 - RNA, 1701 nt, Artificial Sequence; identical to SEQ ID NO: 186423
  derived and/or modified sequence opt5 from hemagglutinin__InfluenzaA__ACZ16593

SEQ ID NO: 186704 - RNA, 1701 nt, Artificial Sequence; identical to SEQ ID NO: 185680
  derived and/or modified sequence opt5 from hemagglutinin__InfluenzaA__ACZ16603

SEQ ID NO: 186705 - RNA, 1701 nt, Artificial Sequence; identical to SEQ ID NO: 186423
  derived and/or modified sequence opt5 from hemagglutinin__InfluenzaA__ACZ16630

SEQ ID NO: 186706 - RNA, 1701 nt, Artificial Sequence; identical to SEQ ID NO: 185680
  derived and/or modified sequence opt5 from hemagglutinin__InfluenzaA__ACZ16640

SEQ ID NO: 186707 - RNA, 1701 nt, Artificial Sequence; identical to SEQ ID NO: 185680
  derived and/or modified sequence opt5 from hemagglutinin__InfluenzaA__ACZ16650

SEQ ID NO: 186708 - RNA, 1701 nt, Artificial Sequence; identical to SEQ ID NO: 185680
  derived and/or modified sequence opt5 from hemagglutinin__InfluenzaA__ACZ16660

SEQ ID NO: 186709 - RNA, 1701 nt, Artificial Sequence; identical to SEQ ID NO: 185680
  derived and/or modified sequence opt5 from hemagglutinin__InfluenzaA__ACZ16670

SEQ ID NO: 186710 - RNA, 1701 nt, Artificial Sequence; identical to SEQ ID NO: 185680
  derived and/or modified sequence opt5 from hemagglutinin__InfluenzaA__ACZ16680

SEQ ID NO: 186711 - RNA, 1701 nt, Artificial Sequence; identical to SEQ ID NO: 185680
  derived and/or modified sequence opt5 from hemagglutinin__InfluenzaA__ACZ16690

SEQ ID NO: 186712 - RNA, 1701 nt, Artificial Sequence; identical to SEQ ID NO: 185680
  derived and/or modified sequence opt5 from hemagglutinin__InfluenzaA__ACZ16700

SEQ ID NO: 186713 - RNA, 1701 nt, Artificial Sequence; identical to SEQ ID NO: 185680
  derived and/or modified sequence opt5 from hemagglutinin__InfluenzaA__ACZ16710

SEQ ID NO: 186714 - RNA, 1701 nt, Artificial Sequence; identical to SEQ ID NO: 185680
  derived and/or modified sequence opt5 from hemagglutinin__InfluenzaA__ACZ16720

SEQ ID NO: 186715 - RNA, 1701 nt, Artificial Sequence; identical to SEQ ID NO: 186423
  derived and/or modified sequence opt5 from hemagglutinin__InfluenzaA__ACZ16730

SEQ ID NO: 186716 - RNA, 1701 nt, Artificial Sequence; identical to SEQ ID NO: 186423
  derived and/or modified sequence opt5 from hemagglutinin__InfluenzaA__ACZ16740

SEQ ID NO: 186717 - RNA, 1701 nt, Artificial Sequence; identical to SEQ ID NO: 185680
  derived and/or modified sequence opt5 from hemagglutinin__InfluenzaA__ACZ16750

SEQ ID NO: 186718 - RNA, 1701 nt, Artificial Sequence; identical to SEQ ID NO: 185680
  derived and/or modified sequence opt5 from hemagglutinin__InfluenzaA__ACZ16760

SEQ ID NO: 186719 - RNA, 1701 nt, Artificial Sequence; identical to SEQ ID NO: 185873
  derived and/or modified sequence opt5 from hemagglutinin__InfluenzaA__ACZ16770

SEQ ID NO: 186720 - RNA, 1701 nt, Artificial Sequence; identical to SEQ ID NO: 185680
  derived and/or modified sequence opt5 from hemagglutinin__InfluenzaA__ACZ16780

SEQ ID NO: 186721 - RNA, 1701 nt, Artificial Sequence; identical to SEQ ID NO: 185680
  derived and/or modified sequence opt5 from hemagglutinin__InfluenzaA__ACZ16790

SEQ ID NO: 186722 - RNA, 1701 nt, Artificial Sequence; identical to SEQ ID NO: 185680
  derived and/or modified sequence opt5 from hemagglutinin__InfluenzaA__ACZ16800

SEQ ID NO: 186723 - RNA, 1701 nt, Artificial Sequence; identical to SEQ ID NO: 185680
  derived and/or modified sequence opt5 from hemagglutinin__InfluenzaA__ACZ16810

SEQ ID NO: 186724 - RNA, 1701 nt, Artificial Sequence; identical to SEQ ID NO: 186355
  derived and/or modified sequence opt5 from hemagglutinin__InfluenzaA__ACZ16820

SEQ ID NO: 186725 - RNA, 1701 nt, Artificial Sequence; identical to SEQ ID NO: 185680
  derived and/or modified sequence opt5 from hemagglutinin__InfluenzaA__ACZ16830

SEQ ID NO: 186726 - RNA, 1701 nt, Artificial Sequence
  derived and/or modified sequence opt5 from hemagglutinin__InfluenzaA__ACZ16840
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggacaaaaguccgcgaucaggaggggagaaugaauuacuauuggacccugguugaaccgggagacaagauuacguucgaggccacaggcaaccugguggugccccgguacgcguuugccauggaacgcaacgcuggguccggaaucauuaucagcgauaccccuguccaugacugcaauacaaccugucaaacccccaaaggcgccaucaacacaucucucccuuuccagaauauucaccccaucacgauuggcaagugcccgaaguaugugaaaagcaccaagcugagacuugcuacagggcugcggaacguuccuuccauccagucucgcggacucuuuggcgccauugccggguucaucgagggaggcuggaccgggaugguggacggaugguacggcuaucaucaccagaaugaacaaggcagcggguacgcugcggaucugaaauccacacagaacgccaucgacgagauuaccaauaaggucaacagcgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauucuaaugugaaaaaccuguacgagaagguccgcucccagcucaaaaacaaugccaaggaaauugggaacggauguuuugaguucuaucacaagugcgacaauacauguauggaaagcgugaaaaacggcaccuacgauuaucccaaguacucugaggaagcuaaacugaauagagaggagaucgacgggguuaaacuugaauccacacggaucuaucaaauucuggccaucuacagcacgguggcguccucucucguccuggugguuagccugggcgcuauuuccuuuuggaugugcucuaacggaagccuccagugccgcaucuguauuuga

SEQ ID NO: 186727 - RNA, 1701 nt, Artificial Sequence; identical to SEQ ID NO: 185680
  derived and/or modified sequence opt5 from hemagglutinin__InfluenzaA__ACZ16850

SEQ ID NO: 186728 - RNA, 1701 nt, Artificial Sequence
  derived and/or modified sequence opt5 from hemagglutinin__InfluenzaA__ACZ16860
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggcgccucgguacgccuuugcuauggaacgcaacgccggguccggaaucauuaucagcgauacacccgugcaugacugcaauaccacaugucaaaccccuaaaggcgcuaucaacaccucucuccccuuccagaauauucacccgaucacaauuggcaagugcccuaaguaugucaaaagcacgaagcugagacuugccaccgggcugcggaacgugcccuccauccagucucgcggacucuuuggcgccauugcuggguucaucgagggaggcuggacagggaugguugacggaugguacggcuaucaucaccagaaugaacaaggcagcggguacgcggccgaucugaaauccacccagaacgcuaucgacgagauuacaaauaaggugaacagcgucaucgagaaaaugaauacccaguuuacggccgugggaaaggaguucaaccaccuugagaagagaauugaaaaucugaacaaaaagguugaugacggcuuccucgauaucuggacauacaaugccgagcugcuggugcuccuggaaaacgagcggacccuugacuaucaugauucuaaugucaaaaaccuguacgagaaggugcgcucccagcucaaaaacaaugcuaaggaaauugggaacggauguuuugaguucuaucacaagugcgacaauaccuguauggaaagcgucaaaaacggcacauacgauuauccuaaguacucugaggaagccaaacugaauagagaggagaucgacggggugaaacuugaauccacccggaucuaucaaauucuggcgaucuacagcacaguugcuuccucucucgugcuggucgugagccugggcgccauuuccuuuuggaugugcucuaacggaagccuccagugccgcaucuguauuuga

SEQ ID NO: 186729 - RNA, 1701 nt, Artificial Sequence; identical to SEQ ID NO: 186423
  derived and/or modified sequence opt5 from hemagglutinin__InfluenzaA__ACZ16870

SEQ ID NO: 186730 - RNA, 1701 nt, Artificial Sequence
  derived and/or modified sequence opt5 from hemagglutinin__InfluenzaA__ACZ16880
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgauggguccggaaucauuaucagcgacacacccguccaugacugcaauaccacaugucaaaccccuaaaggcgcuaucaacaccucucuccccuuccagaauauucacccgaucacaauuggcaagugcccuaaguaugugaaaagcacgaagcugagacuugccaccgggcugcggaacguucccuccauccagucucgcggacucuuuggcgcuauugccggguucaucgagggaggcuggacagggaugguggauggaugguacggcuaucaucaccagaaugaacaaggcagcggguacgccgcugaccugaaauccacccagaacgcgaucgaugagauuacaaauaaggucaacagcgugaucgagaaaaugaauacccaguuuacggccguuggaaaggaguucaaccaccuugagaagagaauugaaaaucugaacaaaaagguggacgauggcuuccucgacaucuggacauacaaugcugagcugcugguccuccuggaaaacgagcggacccuugauuaucaugacucuaaugugaaaaaccuguacgagaagguccgcucccagcucaaaaacaaugccaaggaaauugggaacggauguuuugaguucuaucacaagugcaauaacaccuguauggaaagcgugaaaaauggcacauacgauuauccuaaguacucugaggaagccaaacugaacagagaggagaucgacgggguuaaacuugaauccacccggaucuaucaaauucuggcuaucuacagcacaguggccuccucucucguccuggugguuagccugggcgcgauuuccuuuuggaugugcucuaauggaagccuccagugccgcaucuguauuuga

SEQ ID NO: 186731 - RNA, 1701 nt, Artificial Sequence; identical to SEQ ID NO: 186428
  derived and/or modified sequence opt5 from hemagglutinin__InfluenzaA__ACZ16890

SEQ ID NO: 186732 - RNA, 1701 nt, Artificial Sequence; identical to SEQ ID NO: 185680
  derived and/or modified sequence opt5 from hemagglutinin__InfluenzaA__ACZ16900

SEQ ID NO: 186733 - RNA, 1701 nt, Artificial Sequence; identical to SEQ ID NO: 185680
  derived and/or modified sequence opt5 from hemagglutinin__InfluenzaA__ACZ16910

SEQ ID NO: 186734 - RNA, 1701 nt, Artificial Sequence; identical to SEQ ID NO: 185680
  derived and/or modified sequence opt5 from hemagglutinin__InfluenzaA__ACZ16920

SEQ ID NO: 186735 - RNA, 1701 nt, Artificial Sequence; identical to SEQ ID NO: 185693
  derived and/or modified sequence opt5 from hemagglutinin__InfluenzaA__ACZ16930

SEQ ID NO: 186736 - RNA, 1701 nt, Artificial Sequence; identical to SEQ ID NO: 185693
  derived and/or modified sequence opt5 from hemagglutinin__InfluenzaA__ACZ16940

SEQ ID NO: 186737 - RNA, 1701 nt, Artificial Sequence; identical to SEQ ID NO: 185680
  derived and/or modified sequence opt5 from hemagglutinin__InfluenzaA__ACZ16950

SEQ ID NO: 186738 - RNA, 1701 nt, Artificial Sequence; identical to SEQ ID NO: 185935
  derived and/or modified sequence opt5 from hemagglutinin__InfluenzaA__ACZ16960

SEQ ID NO: 186739 - RNA, 1701 nt, Artificial Sequence
  derived and/or modified sequence opt5 from hemagglutinin__InfluenzaA__ACZ16970
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaagaaggcaacagcuacccuaagcuguccaaaagcuauauuaaugacaaggggaaggaggugcuuguccuguggggaauccaccaccccuccaccucugccgaucaacagagccucuaccagaacgcugacgccuacguguucgugggcacauccagauauagcaaaaaguuuaaaccugagauugcuauccggccgaagguccgcgaucaggaagggagaaugaauuacuauuggacccugguugagcccggagacaaaauuacguucgaagccacaggcaaccugguggugccucgguacgcguuugccauggagcgcaacgcugggucuggaaucauuaucuccgauacccccguccaugacugcaauacaaccugucaaaccccuaagggcgccaucaacacaagccuccccuuccagaauauucacccgaucacgauuggcaaaugcccuaaguaugugaagucuaccaaacugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaucuuaagagcacacagaacgccaucgacgagauuaccaauaaagucaacuccgugaucgaaaagaugaauacgcaguuuacagcuguuggaaaagaguucaaccaccuggaaaagagaauugagaaucugaacaagaaaguggaugacggcuuccucgauaucuggaccuacaaugccgaacugcugguccuccuggagaacgagcggacccuugacuaucaugauagcaaugugaagaaccuguacgaaaaaguccgcucucagcucaagaacaaugccaaagagauugggaacggauguuuugaguucuaucacaagugcgacaauacauguauggaguccgugaagaacggcaccuacgauuauccuaaauacagcgaagaggcuaagcugaauagagaggaaaucgacgggguuaaacuugagucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 186740 - RNA, 1701 nt, Artificial Sequence; identical to SEQ ID NO: 185693
  derived and/or modified sequence opt5 from hemagglutinin__InfluenzaA__ACZ16980

SEQ ID NO: 186741 - RNA, 1701 nt, Artificial Sequence; identical to SEQ ID NO: 185693
  derived and/or modified sequence opt5 from hemagglutinin__InfluenzaA__ACZ17000

SEQ ID NO: 186742 - RNA, 1701 nt, Artificial Sequence
  derived and/or modified sequence opt5 from hemagglutinin__InfluenzaA__ACZ17010
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcaaguauucuaaaaaguuuaaaccugagauugcuaucagaccgaagguccgggaucaggaggggcgcaugaauuacuauuggacacugguugaacccggagacaaaauuaccuucgaggccacgggcaaccugguggugccuagauacgcguuugccauggaacggaacgcuggguccggaaucauuaucagcgauacacccguccaugacugcaauaccacaugucaaaccccuaagggcgccaucaacaccucucuccccuuccagaauauucacccgaucacaauuggcaagugcccuaaauauguuaagagcacgaaacugcgccuugcuaccgggcugagaaacgugcccuccauccagucucggggacucuuuggcgccauugccggguucaucgagggaggcuggacagggaugguggacggaugguacggcuaucaucaccagaaugaacaaggcagcggguacgcugcggaucugaaguccacccagaacgccaucgacaaaauuacaaauaaggucaacagcgugaucgagaagaugaauacccaguuuacggcuguuggaaaagaguucaaccaccuugaaaagcgcauugagaaucugaacaaaaagguggaugacggcuuccucgauaucuggacauacaaugccgaacugcugguccuccuggagaacgaaagaacccuugacuaucaugauucuaaugugaaaaaccuguacgagaagguccggucccagcucaagaacaaugccaaagagauugggaacggauguuuugaguucuaucacaagugcgacaauaccuguauggagagcgugaaaaacggcacauacgauuauccuaaguacucugaagaggcuaaacugaaucgcgaagagaucgacgggguuaaacuugaguccaccagaaucuaucaaauucuggccaucuacagcacaguggcguccucucucguccuggugguuagccugggcgcuauuuccuuuuggaugugcucuaacggaagccuccagugccggaucuguauuuga

SEQ ID NO: 186743 - RNA, 1701 nt, Artificial Sequence; identical to SEQ ID NO: 185693
  derived and/or modified sequence opt5 from hemagglutinin__InfluenzaA__ACZ17020

SEQ ID NO: 186744 - RNA, 1701 nt, Artificial Sequence
  derived and/or modified sequence opt5 from hemagglutinin__InfluenzaA__ACZ17030
augaaggccacccuggugguccuccuguacacauucgcuacggccaacgcggacacccuuugcaucggcuaucacgcuaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggaggccuccucuagcgacaacggcacgugcuauccgggggauuuuaucgacuacgaagaacugcgggagcagcuuuccagcgucucuuccuucgaacgcuuugagauuuuccccaagaccagcucuuggccuaaucacgauuccaacaagggagugacagcugccuguccccaugcgggcgccaagagcuuuuauaagaaucugaucuggcucguuaaaaagggcaacucuuacccuaaacuguccaagagcuauaucaaugacaaggggaaagaagugcuuguccuguggggcauucaccaccccuccaccucugcugaucaacagagccucuaccagaacgccgacgcuuacguguucgugggaacauccagauauagcaagaaauuuaagccugagaucgccauucggccgaaaguccgcgaucaggaggggagaaugaauuacuauuggacccugguugaacccggagacaagaucacguucgaggcgacaggcaaccugguggugccucgguacgccuuugcuauggaacgcaacgccgggucuggaauuaucauuuccgauacccccguccaugacugcaauacaaccugucaaaccccuaaaggcgcuaucaacacaagccuccccuuccagaauauccacccgauuacgaucggcaagugcccuaaguaugugaaaucuaccaagcugagacuugccacagggcugcggaacguucccagcauucagucccgcggacucuuuggcgccaucgcuggguucauugagggaggcuggaccgggaugguggacggaugguacggcuaucaucaccagaaugaacaaggcucuggguacgcggccgaucugaaaagcacacagaacgcuaucgacgagaucaccaauaaggucaacuccgugauugagaaaaugaauacgcaguuuacagccguuggaaaggaguucaaccaccuugagaagagaaucgaaaaucugaacaaaaagguggaugacggcuuccucgauauuuggaccuacaaugccgagcugcugguccuccuggaaaacgagcggacccuugacuaucaugauagcaaugugaaaaaccuguacgagaagguccgcucucagcucaaaaacaaugcuaaggaaaucgggaacggauguuuugaguucuaucacaagugcgacaauacauguauggaauccgugaaaaacggcaccuacgauuauccuaaguacagcgaggaagccaaacugaauagagaggagauugacgggguuaaacuugaaucuacacggaucuaucaaauccuggcgauuuacuccacgguggcuagcucccucguccuggugguuucucugggcgccaucagcuuuuggaugugcuccaacggaucucuccagugccgcauuuguaucuga

SEQ ID NO: 186745 - RNA, 1701 nt, Artificial Sequence
  derived and/or modified sequence opt5 from hemagglutinin__InfluenzaA__ACZ17040
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcaaagaggcuaagcugaauagagaagagaucgacgggguuaaacuugagucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 186746 - RNA, 1701 nt, Artificial Sequence; identical to SEQ ID NO: 185693
  derived and/or modified sequence opt5 from hemagglutinin__InfluenzaA__ACZ17050

SEQ ID NO: 186747 - RNA, 1701 nt, Artificial Sequence; identical to SEQ ID NO: 185693
  derived and/or modified sequence opt5 from hemagglutinin__InfluenzaA__ACZ17060

SEQ ID NO: 186748 - RNA, 1701 nt, Artificial Sequence; identical to SEQ ID NO: 185693
  derived and/or modified sequence opt5 from hemagglutinin__InfluenzaA__ACZ17070

SEQ ID NO: 186749 - RNA, 1701 nt, Artificial Sequence; identical to SEQ ID NO: 185873
  derived and/or modified sequence opt5 from hemagglutinin__InfluenzaA__ACZ17080

SEQ ID NO: 186750 - RNA, 1701 nt, Artificial Sequence
  derived and/or modified sequence opt5 from hemagglutinin__InfluenzaA__ACZ17090
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccugggggauaagcacaauggaaaacuuuguaagcugagaggcguugcuccccuccaucuggggaaaugcaacaucgccggauggauucugggcaauccugaaugugagucucucagcacagccuccucuuggagcuacaucguggaaaccuccucuagcgacaacgggacgugcuauccgggagauuuuauugacuacgaggaacugcgggagcagcuuuccagcgucucuuccuucgagcgcuuugaaaucuuccccaagaccagcucuuggccuaaucacgauuccaacaagggcgugacagccgcuuguccccaugccggcgcgaaaucuuuuuauaagaaucugaucuggcucguuaaaaaggggaacagcuacccuaaacuguccaagagcuauauuaaugacaagggaaaagaggugcuuguccuguggggcauccaccaccccuccaccucugccgaucaacagagccucuaccagaacgcugacgccuacguguucguggggacauccagauauagcaagaaauuuaagccugaaauugcuauccggccgaaaguccgcgaucaggagggaagaaugaauuacuauuggacccugguugagcccggcgacaagauuacguucgaagccacagggaaccugguggugccucgguacgcguuugccauggagcgcaacgcuggaucuggcaucauuaucuccgauacccccguccaugacugcaauacaaccugucaaaccccuaaaggcgccaucaacacaagccuccccuuccagaauauucacccgaucacgauugggaagugcccuaaguaugugaaaucuaccaagcugagacuugcuacaggacugcggaacguucccagcauccagucccgcggccucuuuggggccauugccggauucaucgaaggcggguggaccggaaugguggacggcugguacggcuaucaucaccagaaugagcaagggucuggauacgcugcggaucugaaaagcacacagaacgccaucgacgaaauuaccaauaaggucaacuccgugaucgagaaaaugaauacgcaguuuacagcuguuggcaaggaguucaaccaccuugaaaagagaauugagaaucugaacaaaaagguggaugacggguuccucgauaucuggaccuacaaugccgaacugcugguccuccuggagaacgaacggacccuugacuaucaugauagcaaugugaaaaaccuguacgagaaggucaaaucucagcucaagaacaaugccaaggagauuggaaacggcuguuuugaguucuaucacaaaugcgacaauacauguauggaauccgugaagaacgggaccuacgauuauccuaaauacagcgaagaggcuaagcugaaucgcgaagagaucgacggcguuaaacuugagucuacaagaaucuaucaaauucuggccaucuacuccacgguggcgagcucccucguccuggugguuucucugggagcuauuagcuuuuggaugugcuccaacggcucucuccagugccggaucuguauuuga

SEQ ID NO: 186751 - RNA, 1701 nt, Artificial Sequence; identical to SEQ ID NO: 185680
  derived and/or modified sequence opt5 from hemagglutinin__InfluenzaA__ACZ17100

SEQ ID NO: 186752 - RNA, 1701 nt, Artificial Sequence
  derived and/or modified sequence opt5 from hemagglutinin__InfluenzaA__ACZ17110
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccugaacuguccaaaagcuauauuaaugacaaggggaaggaggugcuuguccuguggggaauccaccaccccuccaccucugccgaucaacagagccucuaccagaacgcugacgccuacguguucgugggcacauccagauauagcaaaaaguuuaaaccugagauugcuauccggccgaagguccgcgaucaggaagggagaaugaauuacuauuggacccugguugagcccggagacaaaauuacguucgaagccacaggcaaccugguggugccucgguacgcguuugccauggagcgcaacgcugggucuggaaucauuaucuccgauacccccguccaugacugcaauacaaccugucaaaccccuaagggcgccaucaacacaagccuccccuuccagaauauucacccgaucacgauuggcaaaugcccuaaguaugugaagucuaccaaacugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaucuuaagagcacacagaacgccaucgacgagauuaccaauaaagucaacuccgugaucgaaaagaugaauacgcaguuuacagcuguuggaaaagaguucaaccaccuggaaaagagaauugagaaucugaacaagaaaguggaugacggcuuccucgauaucuggaccuacaaugccgaacugcugguccuccuggagaacgagcggacccuugacuaucaugauagcaaugugaagaaccuguacgaaaaaguccgcucucagcucaagaacaaugccaaagagauugggaacggauguuuugaguucuaucacaagugcgacaauacauguauggaguccgugaagaacggcaccuacgauuauccuaaauacagcgaagaggcuaagcugaauagagaggaaaucgacgggguuaaacuugagucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 186753 - RNA, 1701 nt, Artificial Sequence
  derived and/or modified sequence opt5 from hemagglutinin__InfluenzaA__ACZ17120
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaacaaacgccaaggaaauugggaauggauguuuugaguucuaucacaagugcgacaacaccuguauggaauccgugaaaaauggcacauacgauuauccuaaguacagcgaggaagcuaaacugaacagagaggagaucgacgggguuaaacuugaaucuacgcggaucuaucaaauucuggccaucuacuccaccguggcgagcucccucguccuggugguuucucugggcgcuauuagcuuuuggaugugcuccaauggaucucuccagugccgcaucuguauuuga

SEQ ID NO: 186754 - RNA, 1701 nt, Artificial Sequence
  derived and/or modified sequence opt5 from hemagglutinin__InfluenzaA__ACZ17130
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaaugcucaguuuacggccguuggaaaggaguucaaccaccuugagaagagaauugaaaaucugaacaaaaagguggaugacggcuuccucgauaucuggacauacaaugccgagcugcugguccuccuggaaaacgagcggacccuugacuaucaugauagcaaugugaaaaaccuguacgagaagguccgcucucagcucaaaaacaaugcuaaggaaauugggaacggauguuuugaguucuaucacaagugcgacaauaccuguauggaauccgugaaaaacggcacauacgauuauccuaaguacagcgaggaagccaaacugaauagagaggagaucgacgggguuaaacuugaaucuacccggaucuaucaaauucuggcgaucuacuccacaguggcuagcucccucguccuggugguuucucugggcgccauuagcuuuuggaugugcuccaacggaucucuccagugccgcaucuguauuuga

SEQ ID NO: 186755 - RNA, 1701 nt, Artificial Sequence; identical to SEQ ID NO: 186491
  derived and/or modified sequence opt5 from hemagglutinin__InfluenzaA__ACZ17140

SEQ ID NO: 186756 - RNA, 1701 nt, Artificial Sequence; identical to SEQ ID NO: 186322
  derived and/or modified sequence opt5 from hemagglutinin__InfluenzaA__ACZ17150

SEQ ID NO: 186757 - RNA, 1701 nt, Artificial Sequence; identical to SEQ ID NO: 186322
  derived and/or modified sequence opt5 from hemagglutinin__InfluenzaA__ACZ17160

SEQ ID NO: 186758 - RNA, 1701 nt, Artificial Sequence; identical to SEQ ID NO: 186322
  derived and/or modified sequence opt5 from hemagglutinin__InfluenzaA__ACZ17170

SEQ ID NO: 186759 - RNA, 1701 nt, Artificial Sequence
  derived and/or modified sequence opt5 from hemagglutinin__InfluenzaA__ACZ17190
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcagcacaaccugucaaaccccugagggcgccaucaauacaucucuccccuuccagaacauucacccgaucacgauuggcaaaugcccuaaguauguuaagagcaccaaacugagacuugcuacagggcugcggaaugugcccuccauccagucucgcggacucuuuggcgccauugccggguucaucgaaggaggcuggaccgggaugguggacggaugguacggcuaucaucaccagaacgagcaaggcagcggguacgcugcggaucugaaguccacacagaaugccaucgacgagauuaccaacaaagucaauagcgugaucgaaaagaugaacacgcaguuuacagcuguuggaaaagaguucaaucaccuugaaaagagaauugagaaccugaauaagaaaguggaugacggcuuccucgauaucuggaccuacaacgccgaacugcugguccuccuggagaaugagcggacccuugacuaucaugauucuaacgugaagaaucuguacgaaaaaguccgcucccagcucaagaacaacgccaaagagauugggaauggauguuuugaguucuaucacaagugcgacaacacauguauggagagcgugaagaauggcaccuacgauuauccuaaauacucugaagaggcuaagcugaacagagaggaaaucgacgggguuaaacuugaguccacacggaucuaucaaauucuggccaucuacagcacgguggcguccucucucguccuggugguuagccugggcgcuauuuccuuuuggaugugcucuaauggaagccuccagugccgcaucuguauuuga

SEQ ID NO: 186760 - RNA, 1701 nt, Artificial Sequence; identical to SEQ ID NO: 186759
  derived and/or modified sequence opt5 from hemagglutinin__InfluenzaA__ACZ17200

SEQ ID NO: 186761 - RNA, 1701 nt, Artificial Sequence; identical to SEQ ID NO: 185693
  derived and/or modified sequence opt5 from hemagglutinin__InfluenzaA__ACZ17220

SEQ ID NO: 186762 - RNA, 1701 nt, Artificial Sequence
  derived and/or modified sequence opt5 from hemagglutinin__InfluenzaA__ACZ17230
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaaaugcaacaucgccggguggauucugggaaauccugagugugaaucucucagcacagcuuccucuuggagcuacaucguggagaccuccucuagcgacaacggcacgugcuauccgggggauuuuauugacuacgaagaacugaaggagcagcuuuccagcgucucuuccuucgaacgguuugagaucuuccccaagaccagcucuuggccuaaucacgauuccaacaaaggagugacagccgcuuguccccaugccggcgccaagagcuuuuauaaaaaucugaucuggcucguuaagaaaggcaacucuuacccuaagcuguccaagagcuauauuaaugacaaagggaaggaagugcuuguccuguggggaauccaccaccccuccaccucugccgaucaacagagccucuaccagaacgcugacgccuacguguucgugggcacaucccgcuauagcaaaaaguuuaaaccugagauugcuaucagaccgaagguccgggaucaggaggggcgcaugaauuacuauuggacccugguugaacccggagacaaaauuacguucgaggccacaggcaaccugguggugccuagauacgcguuugccauggaacggaacgcugggucuggaaucauuaucuccgauacccccguccaugacugcaauacaaccugucaaaccccuaagggcgccaucaacacaagccuccccuuccagaauauucacccgaucacgauuggcaagugcccuaaauaugugaagucuaccaaacugcgccuugcuacagggcugagaaacguucccagcauccagucccggggacucuuuggcgccauugccggguucaucgagggaggcuggaccgggaugguggacggaugguacggcuaucaucaccagaaugaacaaggcucuggguacgcugcggaucuuaagagcacacagaacgccaucgacgagauuaccaauaaagucaacuccgugaucgagaagaugaauacgcaguuuacagcuguuggaaaggaguucaaccaccuggagaaacgcauugaaaaucugaacaagaaaguggaugacggcuuccucgauaucuggaccuacaaugccgagcugcugguccuccuggaaaacgagagaacccuugacuaucaugauagcaaugugaagaaccuguacgagaaaguccggucucagcucaagaacaaugccaaggaaauugggaacggauguuuugaguucuaucacaaaugcgacaauacauguauggaauccgugaagaacggcaccuacgauuauccuaaauacagcgaggaagcuaagcugaaucgcgaggagaucgacgggguuaaacuugaaucuacaagaaucuaucaaauucuggccaucuacuccacgguggcgagcucccucguccuggugguuucucugggcgcuauuagcuuuuggaugugcuccaacggaucucuccagugccggaucuguauuuga

SEQ ID NO: 186763 - RNA, 1701 nt, Artificial Sequence; identical to SEQ ID NO: 185693
  derived and/or modified sequence opt5 from hemagglutinin__InfluenzaA__ACZ17240

SEQ ID NO: 186764 - RNA, 1701 nt, Artificial Sequence; identical to SEQ ID NO: 185693
  derived and/or modified sequence opt5 from hemagglutinin__InfluenzaA__ACZ17250

SEQ ID NO: 186765 - RNA, 1701 nt, Artificial Sequence; identical to SEQ ID NO: 185693
  derived and/or modified sequence opt5 from hemagglutinin__InfluenzaA__ACZ17260

SEQ ID NO: 186766 - RNA, 1701 nt, Artificial Sequence
  derived and/or modified sequence opt5 from hemagglutinin__InfluenzaA__ACZ17270
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggccggugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgcgagcagcuuuccagcgucucuuccuucgaaagauuugagaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaagugcuuguccuguggggaauccaccaccccuccaccucugccgaucaacagagccucuaccagaacgcugacgccuacguguucgugggcacaucccgguauagcaaaaaguuuaaaccugagauugcuauccgcccgaaggucagagaucaggaggggcggaugaauuacuauuggacccugguugaacccggagacaaaauuacguucgaggccacaggcaaccugguggugccucgcuacgcguuugccauggaaagaaacgcugggucuggaaucauuaucuccgauacccccguccaugacugcaauacaaccugucaaaccccuaagggcgccaucaacacaagccuccccuuccagaauauucacccgaucacgauuggcaaaugcccuaaguaugugaagucuaccaaacugcggcuugcuacagggcugcgcaacguucccagcauccaguccagaggacucuuuggcgccauugccggguucaucgagggaggcuggaccgggaugguggacggaugguacggcuaucaucaccagaaugaacaaggcucuggguacgcugcggaucuuaagagcacacagaacgccaucgacgagauuaccaauaaagucaacuccgugaucgagaagaugaauacgcaguuuacagcuguuggaaaagaguucaaccaccuugagaagcggauugaaaaucugaacaagaaaguggaugacggcuuccucgauaucuggaccuacaaugccgagcugcugguccuccuggaaaacgagcgcacccuugacuaucaugauagcaaugugaagaaacuguacgagaaggucagaucucagcucaaaaacaacgccaaggaaauugggaauggauguuuugaguucuaucacaagugcgacaacacauguauggaauccgugaaaaauggcaccuacgauuauccuaaguacagcgaggaagcuaaacugaaccgggaggagaucgacgggguuaagcuggaaucuacacgcguguaucaaauccuggccauuuacuccacggucgcgagcucccucgugcugguugugucucugggcgcuaucagcuuuuggaugugcuccaauggaucucuccagugcagaauuuguaucuga

SEQ ID NO: 186767 - RNA, 1701 nt, Artificial Sequence; identical to SEQ ID NO: 185873
  derived and/or modified sequence opt5 from hemagglutinin__InfluenzaA__ACZ17290

SEQ ID NO: 186768 - RNA, 1701 nt, Artificial Sequence; identical to SEQ ID NO: 185873
  derived and/or modified sequence opt5 from hemagglutinin__InfluenzaA__ACZ17300

SEQ ID NO: 186769 - RNA, 1701 nt, Artificial Sequence; identical to SEQ ID NO: 185873
  derived and/or modified sequence opt5 from hemagglutinin__InfluenzaA__ACZ17310

SEQ ID NO: 186770 - RNA, 1701 nt, Artificial Sequence; identical to SEQ ID NO: 185693
  derived and/or modified sequence opt5 from hemagglutinin__InfluenzaA__ACZ17398

SEQ ID NO: 186771 - RNA, 1701 nt, Artificial Sequence; identical to SEQ ID NO: 185693
  derived and/or modified sequence opt5 from hemagglutinin__InfluenzaA__ACZ17408

SEQ ID NO: 186772 - RNA, 1701 nt, Artificial Sequence; identical to SEQ ID NO: 185693
  derived and/or modified sequence opt5 from hemagglutinin__InfluenzaA__ACZ17418

SEQ ID NO: 186773 - RNA, 1701 nt, Artificial Sequence
  derived and/or modified sequence opt5 from hemagglutinin__InfluenzaA__ACZ17438
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacuccuacguguucgugggcagcucuagauauuccaagaaauuuaagccugagauugccauccggccgaaaguccgcgaucaggaggggagaaugaauuacuauuggacacugguugaacccggagacaagauuaccuucgaggcuacgggcaaccugguggugccucgguacgccuuugcgauggaacgcaacgccgggagcggaaucauuaucucugauacacccguccaugacugcaauaccacaugucaaaccccuaaaggcgcuaucaacaccagccuccccuuccagaauauucacccgaucacaauuggcaagugcccuaaguaugugaaauccacgaagcugagacuugccaccgggcugcggaacguucccucuauccagagccgcggacucuuuggcgcuauugccggguucaucgagggaggcuggacagggaugguggacggaugguacggcuaucaucaccagaaugaacaaggcuccggguacgccgcugaucugaaaagcacccagaacgcgaucgacgagauuacaaauaaggucaacucugugaucgagaaaaugaauacccaguuuacggccguuggaaaggaguucaaccaccuugagaagagaauugaaaaucugaacaaaaagguggaugacggcuuccucgauaucuggacauacaaugcugagcugcugguccuccuggaaaacgagcggacccuugacuaucaugauuccaaugugaaaaaccuguacgagaagguccgcagccagcucaaaaacaaugccaaggaaauugggaacggauguuuugaguucuaucacaagugcgacaauaccuguauggaaucugugaaaaacggcacauacgauuauccuaaguacuccgaggaagccaaacugaauagagaggagaucgacgggguuaaacuugaaagcacccggaucuaucaaauucuggcuaucuacuccacaguggccucuagccucguccuggugguuucccugggcgcgauuucuuuuuggaugugcagcaacggaucccuccagugccgcaucuguauuuga

SEQ ID NO: 186774 - RNA, 1701 nt, Artificial Sequence; identical to SEQ ID NO: 185680
  derived and/or modified sequence opt5 from hemagglutinin__InfluenzaA__ACZ17448

SEQ ID NO: 186775 - RNA, 1701 nt, Artificial Sequence; identical to SEQ ID NO: 185693
  derived and/or modified sequence opt5 from hemagglutinin__InfluenzaA__ACZ17458

SEQ ID NO: 186776 - RNA, 1701 nt, Artificial Sequence; identical to SEQ ID NO: 185680
  derived and/or modified sequence opt5 from hemagglutinin__InfluenzaA__ACZ17478

SEQ ID NO: 186777 - RNA, 1701 nt, Artificial Sequence; identical to SEQ ID NO: 185693
  derived and/or modified sequence opt5 from hemagglutinin__InfluenzaA__ACZ17488

SEQ ID NO: 186778 - RNA, 1701 nt, Artificial Sequence
  derived and/or modified sequence opt5 from hemagglutinin__InfluenzaA__ACZ18240
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacaaccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgaucccaacaagggagugaccgccgccuguccucaugcuggcgccaaauccuuuuauaagaaucugaucuggcucguuaaaaagggcaacagcuaccccaaacugucuaaguccuauauuaaugacaaggggaaagaagugcuuguccuguggggaauccaccacccuagcacauccgcggaucaacagucucucuaccagaacgccgacgcuuacguguucgugggcaccagcagauauuccaagaaauuuaagccggagauugccauccggcccaaaguccgcgaucaggaggggagaaugaauuacuauuggacgcugguugaaccuggagacaagauuacauucgaggcuaccggcaaccugguggugccccgguacgccuuugcgauggaacgcaacgccgggagcggaaucauuaucucugauacaccuguccaugacugcaauaccaccugucaaacacccaaaggcgcuaucaacacgucccucccguuccagaauauucacccuaucaccauuggcaagugccccaaguaugugaaaagcacaaagcugagacuugccaccgggcugcggaacguuccuucuauccagagccgcggacucuuuggcgcuauugccggguucaucgagggaggcuggacagggaugguggacggaugguacggcuaucaucaccagaaugaacaaggcuccggguacgccgcugaucugaaaucuacccagaacgcgaucgacgagauuacgaauaaggucaacagcgugaucgagaaaaugaauacacaguuuaccgccguuggaaaggaguucaaccaccuugagaagagaauugaaaaucugaacaaaaagguggaugacggcuuccucgauaucuggaccuacaaugcugagcugcugguccuccuggaaaacgagcggacacuugacuaucaugauuccaaugugaaaaaccuguacgagaagguccgcagccagcucaaaaacaaugccaaggaaauugggaacggauguuuugaguucuaucacaagugcgacaauaccuguauggaaucugugaaaaacggcacauacgauuaucccaaguacuccgaggaagccaaacugaauagagaggagaucgacgggguuaaacuugaaagcacgcggaucuaucaaauucuggcuaucuacucuaccguggccuccagccucguccuggugguuucccugggcgcgauuucuuuuuggaugugcagcaacggaucccuccagugccgcaucuguauuuga

SEQ ID NO: 186779 - RNA, 1701 nt, Artificial Sequence; identical to SEQ ID NO: 185693
  derived and/or modified sequence opt5 from hemagglutinin__InfluenzaA__ACZ18241

SEQ ID NO: 186780 - RNA, 1701 nt, Artificial Sequence
  derived and/or modified sequence opt5 from hemagglutinin__InfluenzaA__ACZ27800
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaaggaguuuaaaccugagauugcuauccggccgaagguccgcgggcaggaaggaagaaugaauuacuauuggacacugguugagcccggcgauaaaauuaccuucgaagccacggggaaccugguggugccucgguacgcguuugccauggagcgcaacgcuggauccggcaucauuaucagcgacacacccguccaugauugcaauaccacaugucaaaccccuaagggcgccaucaacaccucucuccccuuccagaauauucacccgaucacaauugggaaaugcccuaaguauguuaagagcacgaaacugagacuugcuaccggacugcggaacgugcccuccauccagucucgcggccucuuuggggccauugccggauucaucgaaggcggguggacaggaaugguggacggcugguacggcuaucaucaccagaaugagcaagggagcggauacgcugcggaccugaaguccacccagaacgccaucgaugagauuacaaauaaagucaacagcgugaucgaaaagaugaauacccaguuuacggcuguuggcaaagaguucaaccaccuugaaaagagaauugagaaucugaacaagaaaguggacgauggguuccucgacaucuggacauacaaugccgaacugcugguccuccuggagaacgagcggacccuugauuaucaugacucuaaugugaagaaccuguacgaaaaaguccgcucccagcucaagaacaaugccaaagagauuggaaacggcuguuuugaguucuaucacaagugcgauaauaccuguauggagagcgugaagaacgggacauacgacuauccuaaauacucugaagaggcuaagcugaauagagaggaaaucgauggcguuaaacuugaguccacccggaucuaucaaauucuggccaucuacagcacaguggcguccucucucguccuggugguuagccugggagcuauuuccuuuuggaugugcucuaacggcagccuccagugccgcaucuguauuuga

SEQ ID NO: 186781 - RNA, 1701 nt, Artificial Sequence; identical to SEQ ID NO: 185693
  derived and/or modified sequence opt5 from hemagglutinin__InfluenzaA__ACZ27810

SEQ ID NO: 186782 - RNA, 1701 nt, Artificial Sequence; identical to SEQ ID NO: 185693
  derived and/or modified sequence opt5 from hemagglutinin__InfluenzaA__ACZ27820

SEQ ID NO: 186783 - RNA, 1701 nt, Artificial Sequence; identical to SEQ ID NO: 185693
  derived and/or modified sequence opt5 from hemagglutinin__InfluenzaA__ACZ27830

SEQ ID NO: 186784 - RNA, 1701 nt, Artificial Sequence; identical to SEQ ID NO: 186046
  derived and/or modified sequence opt5 from hemagglutinin__InfluenzaA__ACZ27840

SEQ ID NO: 186785 - RNA, 1701 nt, Artificial Sequence; identical to SEQ ID NO: 185680
  derived and/or modified sequence opt5 from hemagglutinin__InfluenzaA__ACZ45006

SEQ ID NO: 186786 - RNA, 1701 nt, Artificial Sequence
  derived and/or modified sequence opt5 from hemagglutinin__InfluenzaA__ACZ45007
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggggaugcugcggaccugaaaagcacacagaacgccaucgaugagauuaccaauaaggucaacuccgugaucgagaaaaugaauacgcaguuuacagcuguuggaaaggaguucaaccaccuugagaagagaauugaaaaucugaacaaaaagguggacgauggcuuccucgacaucuggaccuacaaugccgagcugcugguccuccuggaaaacgagcggacccuugauuaccaugacagcaaugugaaaaaccuguaugagaagguccgcucucagcucaaaaacaaugccaaggaaauugggaacggauguuuugaguucuaccacaagugcgauaauacauguauggaauccgugaaaaacggcaccuaugacuacccuaaguauagcgaggaagcuaaacugaauagagaggagaucgaugggguuaaacuugaaucuacacggaucuaccaaauucuggccaucuauuccacgguggcgagcucccucguccuggugguuucucugggcgcuauuagcuuuuggaugugcuccaacggaucucuccagugccgcaucuguauuuga

SEQ ID NO: 186787 - RNA, 1701 nt, Artificial Sequence; identical to SEQ ID NO: 186046
  derived and/or modified sequence opt5 from hemagglutinin__InfluenzaA__ACZ45008

SEQ ID NO: 186788 - RNA, 1701 nt, Artificial Sequence; identical to SEQ ID NO: 186046
  derived and/or modified sequence opt5 from hemagglutinin__InfluenzaA__ACZ45009

SEQ ID NO: 186789 - RNA, 1701 nt, Artificial Sequence; identical to SEQ ID NO: 185935
  derived and/or modified sequence opt5 from hemagglutinin__InfluenzaA__ACZ45010

SEQ ID NO: 186790 - RNA, 1701 nt, Artificial Sequence; identical to SEQ ID NO: 185693
  derived and/or modified sequence opt5 from hemagglutinin__InfluenzaA__ACZ45012

SEQ ID NO: 186791 - RNA, 1701 nt, Artificial Sequence
  derived and/or modified sequence opt5 from hemagglutinin__InfluenzaA__ACZ45013
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccagcaagggagugacagccgcuuguccccaugccggcgcgaaaucuuuuuauaagaaccugaucuggcucguuaaaaagggcaauuccuacccuaaacugagcaaguccuauauuaacgacaaggggaaagaagugcuuguccuguggggaauccaccaccccucuaccagcgccgaucaacagucccucuaccagaaugcugacgccuacguguucgugggcacaagcagauauucuaagaaauuuaagccugagauugcuauccggccgaaaguccgcgagcaggaagggagaaugaacuacuauuggacccugguugagcccggagauaagauuacguucgaagccacaggcaaucugguggugccucgguacgcguuugccauggagcgcaacgcuggguccggaaucauuaucagcgacacccccguccaugauugcaacacaaccugucaaaccccuaaaggcgccaucaauacaucucuccccuuccagaacauucacccgaucacgauuggcaagugcccuaaguaugugaaaagcaccaagcugagacuugcuacagggcugcggaauguucccuccauccagucucgcggacucuuuggcgccauugccggguucaucgaaggaggcuggaccgggaugguggacggaugguacggcuaucaucaccagaacgagcaaggcagcggguacgcugcggaccugaaauccacacagaaugccaucgaugagauuaccaacaaggucaauagcgugaucgaaaagaugaacacgcaguuuacagcuguuggaaaggaguucaaucaccuugaaaagagaauugagaaccugaauaaaaagguggacgauggcuuccucgacaucuggaccuacaacgccgaacugcugguccuccuggagaaugagcggacccuugauuaucaugacucuaacgugaaaaaucuguacgaaaagguccgcucccagcucaaaaacaacgccaaggagauugggaauggauguuuugaguucuaucacaagugcgauaacacauguauggagagcgugaaaaauggcaccuacgacuauccuaaguacucugaagaggcuaaacugaacagagaggaaaucgaugggguuaaacuugaguccacacggaucuaucaaauucuggccaucuacagcacgguggcguccucucucguccuggugguuagccugggcgcuauuuccuuuuggaugugcucuaauggaagccuccagugccgcaucuguauuuga

SEQ ID NO: 186792 - RNA, 1701 nt, Artificial Sequence; identical to SEQ ID NO: 185693
  derived and/or modified sequence opt5 from hemagglutinin__InfluenzaA__ACZ45014

SEQ ID NO: 186793 - RNA, 1701 nt, Artificial Sequence; identical to SEQ ID NO: 185693
  derived and/or modified sequence opt5 from hemagglutinin__InfluenzaA__ACZ45016

SEQ ID NO: 186794 - RNA, 1701 nt, Artificial Sequence
  derived and/or modified sequence opt5 from hemagglutinin__InfluenzaA__ACZ45028
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacauccccagcauucagucccgcggacucuuuggcgccaucgccggguucaucgagggaggcuggaccgggaugguugacggaugguacggcuaucaucaccagaaugaacaaggcucuggguacgcugcggaucugaaaagcacacagaacgccauugacgagaucaccaauaaggugaacuccgucauugagaaaaugaauacgcaguuuacagcugugggaaaggaguucaaccaccuugagaagagaaucgaaaaucugaacaaaaagguugaugacggcuuccucgauauuuggaccuacaaugccgagcugcuggugcuccuggaaaacgagcggacccuugacuaucaugauagcaaugucaaaaaccuguacgagaaggugcgcucucagcucaaaaacaaugccaaggaaaucgggaacggauguuuugaguucuaucacaagugcgacaauacauguauggaauccgucaaaaacggcaccuacgauuauccuaaguacagcgaggaagcuaaacugaauagagaggagaucgacggggugaaacuugaaucuacacggauuuaucaaauccuggccauuuacuccacgguugcgagcucccucgugcuggucgugucucugggcgcuaucagcuuuuggaugugcuccaacggaucucuccagugccgcauuuguaucuga

SEQ ID NO: 186795 - RNA, 1701 nt, Artificial Sequence
  derived and/or modified sequence opt5 from hemagglutinin__InfluenzaA__ACZ45029
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcggcaacgggacgugcuauccgggagacuuuauugauuacgaagaacugcgggagcagcuuuccagcgucucuuccuucgaacgcuuugagaucuuccccaagaccagcucuuggccuaaucacgacuccaacaagggcgugacagccgcuuguccccaugccggcgcgaaaucuuuuuauaagaaucugaucuggcucguuaaaaaggggaacagcuacccuaaacuguccaagagcuauauuaaugauaagggaaaagaagugcuuguccuguggggcauccaccaccccuccaccucugccgaccaacagagccucuaccagaacgcugaugccuacguguucguggggacauccagauauagcaagaaauuuaagccugagauugcuauccggccgaaaguccgcgaccaggagggaagaaugaauuacuauuggacccugguugaacccggcgauaagauuacguucgaggccacagggaaccugguggugccucgguacgcguuugccauggaacgcaacgcuggaucuggcaucauuaucuccgacacccccguccaugauugcaauacaaccugucaaaccccuaaaggcgccaucaacacaagccuccccuuccagaauauucacccgaucacgauugggaagugcccuaaguaugugaaaucuaccaagcugagacuugcuacaggacugcggaacguucccagcauccagucccgcggccucuuuggggccauugccggauucaucgagggcggguggaccggaaugguggacggcugguacggcuaucaucaccagaaugaacaagggucuggauacgcugcggaccugaaaagcacacagaacgccaucgaugagauuaccaauaaggucaacuccgugaucgagaaaaugaauacgcaguuuacagcuguuggcaaggaguucaaccaccuugagaagagaauugaaaaucugaacaaaaagguggacgauggguuccucgacaucuggaccuacaaugccgagcugcugguccuccuggaaaacgagcggacccuugauuaucaugacagcaaugugaaaaaccuguacgagaagguccgcucucagcucaaaaacaaugccaaggaaauuggaaacggcuguuuugaguucuaucacaagugcgauaauacauguauggaauccgugaaaaacgggaccuacgacuauccuaaguacagcgaggaagcuaaacugaauagagaggagaucgauggcguuaaacuugaaucuacacggaucuaucaaauucuggccaucuacuccacgguggcgagcucccucguccuggugguuucucugggagcuauuagcuuuuggaugugcuccaacggcucucuccagugccgcaucuguauuuga

SEQ ID NO: 186796 - RNA, 1701 nt, Artificial Sequence
  derived and/or modified sequence opt5 from hemagglutinin__InfluenzaA__ACZ45030
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccaccuauagcaagaaauuuaagccugagauugcuaucagaccgaaaguccgggaucaggaggggcgcaugaauuacuauuggacgcugguugaacccggagacaagauuacauucgaggccaccggcaaccugguggugccuagauacgcguuuacaauggaacggaacgccgggucuggaaucauuaucuccgauacccccguccaugacugcaauaccacaugucaaacgccuaaaggcgcuaucaacaccagccuccccuuccagaauauucacccgaucacaauuggcaagugcccuaaguaugugaaaucuaccaagcugcgccuugccacagggcugagaaacauccccagcauucagucccggggacucuuuggcgcuaucgccggguucaucgagggaggcuggaccgggaugguugacggaugguacggcuaucaucaccagaaugaacaaggcucuggguacgccgcugaucugaaaagcacgcagaacgcgauugacgagaucacaaauaaggugaacuccgucauugagaaaaugaauacccaguuuaccgccgugggaaaggaguucaaccaccuugagaagcgcaucgaaaaucugaacaaaaagguugaugacggcuuccucgauauuuggacauacaaugcugagcugcuggugcuccuggaaaacgagagaacccuugacuaucaugauagcaaugucaaaaaccuguacgagaaggugcggucucagcucaaaaacaaugccaaggaaaucgggaacggauguuuugaguucuaucacaagugcgacaauacauguauggaauccgucaaaaacggcacguacgauuauccuaaguacagcgaggaagccaaacugaaucgcgaggagaucgacggggugaaacuugaaucuaccagaauuuaucaaauccuggcuauuuacuccacaguugccagcucccucgugcuggucgugucucugggcgcgaucagcuuuuggaugugcuccaacggaucucuccagugccggauuuguaucuga

SEQ ID NO: 186797 - RNA, 1701 nt, Artificial Sequence
  derived and/or modified sequence opt5 from hemagglutinin__InfluenzaA__ACZ45031
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugguggugccucgguacgcguuuaccauggagcgcaacgucgggucuggaaucauuaucuccgacacacccgugcaugauugcaauaccaccugucaaacaccuaaaggcgccaucaacacgagccuccccuuccagaauauucacccgaucaccauuggcaagugcccuaaguauguuaaaucuacaaagcugagacuugcuaccgggcugcggaacgugcccagcauccagucccgcggacucuuuggcgccauugcuggguucaucgaaggaggcuggacagggauggucgacggaugguacggcuaucaucaccagaaugagcaaggcucuggguacgccgccgaccugaaaagcacccagaacgcuaucgaugagauuacgaauaaggugaacuccguuaucgaaaagaugaauacacaguuuaccgcggugggaaaggaguucaaccaccuugaaaagagaauugagaaucugaacaaaaaggucgacgauggcuuccucgacaucuggaccuacaaugccgaacugcuggugcuccuggagaacgagcggacacuugauuaucaugacagcaaugucaaaaaccuguacgaaaaggugcgcucucagcucaaaaacaaugcuaaggagauugggaacggauguuuugaguucuaucacaagugcgauaauaccuguauggaguccguuaaaaacggcacauacgacuauccuaaguacagcgaagaggccaaacugaauagagaggaaaucgauggggugaaacuugagucuacgcggaucuaucaaauucuggccaucuacuccaccgucgcuagcucccucgugcugguugugucucugggcgccauuagcuuuuggaugugcuccaacggaucucuccagugccgcaucuguauuuga

SEQ ID NO: 186798 - RNA, 1701 nt, Artificial Sequence
  derived and/or modified sequence opt5 from hemagglutinin__InfluenzaA__ACZ45034
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaaugugcacccgauuacgaucggcaagugcccuaaguauguuaaaucuaccaagcugagacuugcuacagggcugcggaacgugcccccuauucagagccgcggacucuuuggcgccaucgccggguucauugagggaggcuggaccgggauggucgacggaugguacggcuaucaucaccagaaugaacaaggcuccggguacgcugcggaucugaaaucuacacagaacgccaucgacgagaucaccaauaaggugaacagcguuauugagaaaaugaauacgcaguuuacagcugugggaaaggaguucaaccaccuugagaagagaaucgaaaaucugaacaaaaaggucgaugacggcuuccucgauauuuggaccuacaaugccgagcugcuggugcuccuggaaaacgagcggacccuugacuaucaugauuccaaugucaaaaaccuguacgagaaggugcgcagccagcucaaaaacaaugccaaggaaaucgggaacggauguuuugaguucuaucacaagugcgacaauacauguauggaaucuguuaaaaacggcaccuacgauuaucccaaguacuccgaggaagcuaaacugaauagagaggagauugacggggugaaacuugaaagcacacggaucuaucaaauccuggccauuuacucuacggucgcguccagccucgugcugguugugucccugggcgcuaucucuuuuuggaugugcagcaacggaucccuccagugccgcauuuguaucuga

SEQ ID NO: 186799 - RNA, 1701 nt, Artificial Sequence; identical to SEQ ID NO: 185693
  derived and/or modified sequence opt5 from hemagglutinin__InfluenzaA__ACZ45036

SEQ ID NO: 186800 - RNA, 1701 nt, Artificial Sequence; identical to SEQ ID NO: 185693
  derived and/or modified sequence opt5 from hemagglutinin__InfluenzaA__ACZ45037

SEQ ID NO: 186801 - RNA, 1701 nt, Artificial Sequence; identical to SEQ ID NO: 186794
  derived and/or modified sequence opt5 from hemagglutinin__InfluenzaA__ACZ45038

SEQ ID NO: 186802 - RNA, 1701 nt, Artificial Sequence; identical to SEQ ID NO: 186046
  derived and/or modified sequence opt5 from hemagglutinin__InfluenzaA__ACZ45039

SEQ ID NO: 186803 - RNA, 1701 nt, Artificial Sequence; identical to SEQ ID NO: 185693
  derived and/or modified sequence opt5 from hemagglutinin__InfluenzaA__ACZ45040

SEQ ID NO: 186804 - RNA, 1701 nt, Artificial Sequence; identical to SEQ ID NO: 185693
  derived and/or modified sequence opt5 from hemagglutinin__InfluenzaA__ACZ52567

SEQ ID NO: 186805 - RNA, 1701 nt, Artificial Sequence; identical to SEQ ID NO: 185693
  derived and/or modified sequence opt5 from hemagglutinin__InfluenzaA__ACZ52568

SEQ ID NO: 186806 - RNA, 1701 nt, Artificial Sequence; identical to SEQ ID NO: 186262
  derived and/or modified sequence opt5 from hemagglutinin__InfluenzaA__ACZ52569

SEQ ID NO: 186807 - RNA, 1701 nt, Artificial Sequence
  derived and/or modified sequence opt5 from hemagglutinin__InfluenzaA__ACZ53956
augaagaccaucauugcccugagcuacaucuucugccucgcucuggcccagaaacuucccggcaacgacaauuccacagcgacgcugugucucgggcaccaugcugugccuaacggaacccuggucaagacaauuaccaaugaucaaaucgagguuacaaacgccaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucguggagcggagcaaggcuuauuccaauuguuacccuuaugacguccccgauuacgccucucugcgcagccuuguggcuuccagcgggacgcuggaauuuaacaaugagucuuucaacuggaccggaguugcccaaaauggcacauccagcgcgugcaaaagacggucuauuaaguccuuuuucagcacccucaacuggcugcaccagcuucagaaucgcuauccugcccugaacgugacaaugcccaauaacgacaaguuugauaaacucuacaucuggggcguccaucacccuucuaccgacuccgaucagauuagcguguaugcucaagccuccgggagaguuacggugucuacaaagcggagccagcagaccgucaucccgaacauuggaucccgccccugggugagaggcgugagcucucggaucuccauuuacuggacaaucgucaaaccuggggacauccugcugauuaauagcaccggaaaccucaucgcuccccgcggcuacuucaagauuagaucugggaaaagcuccaucaugcggucugacgccccuauuggaaaguguaauagcgagugcaucacccccaacggcuccaucccgaaugauaagccuuuucagaacguuaaucgcauuacauauggcgcgugucccagauacgugaaacaaaacacgcugaaacuugccaccgggaugcggaaugugccugaaaagcagacacgcggaaucuucggcgcuauugccggguuuaucgagaacggaugggaaggcaugauggacgggugguauggauucagacaccagaauagcgagggcaccggccaagcugccgaucugaagucuacacaggccgcuauuaaccagaucaaugggaaacucaaccggcugaucgagaagaccaaugaaaaauuucaucagauugagaaggaguucuccgaagucgaaggaagaauccaagaccuugagaaguacguggaggauacgaaaauugaccuguggagcuauaacgcggaacuccugguugcccuggagaaccagcacacaaucgaucucaccgacucugaaaugaauaagcuguucgagcgcacccggaaacagcuuagagaaaacgcugaggauaugggcaaugggugcuuuaagauuuaccauaaaugugacaacgccugcaucggauccauucgcaauggcacauaugaucacgacguguaccgggacgaggcccugaacaauagauuccagaucaagggggucgaacucaagagcggcuacaaagauuggauccuguggauuuccuuugcuaucucuugcuuccuucugugugugguucuccugggauuuauuaugugggccugccaacgcggcaacauccgguguaauauuugcaucuga

SEQ ID NO: 186808 - RNA, 1701 nt, Artificial Sequence
  derived and/or modified sequence opt5 from hemagglutinin__InfluenzaA__ACZ53967
augaagaccaucauugcccugagcuacaucuucugccucgcucuggcccagaaacuucccggcaacgacaauuccacagcgacgcugugucucgggcaccaugcugugccuaacggaacccuggucaagacaauuaccaaugaucaaaucgagguuacaaacgccaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucguggagcggagcaaggcuuauuccaauuguuacccuuaugacguccccgauuacgccucucugcgcagccuuguggcuuccagcgggacgcuggaauuuaacaaugagucuuucaacuggaccggaguugcccaaaauggcacauccagcgcgugcaaaagacggucuauuaaguccuuuuucagcacccucaacuggcugcaccagcuucagaaucgcuauccugcccugaacgugacaaugcccaauaacgacaaguuugauaaacucuacaucuggggcguccaucacccuucuaccgacuccgaucagacgagccuguaugcucaagccuccgggagagugacaguuucuaccaagcggagccagcagacagugauuccgaacaucggaucccgccccugggucagaggcgugagcucucggauuuccaucuacuggaccauugugaaaccuggggacguccugguuaucaauagcaacggaaaucucaucgcuccccgcggcuacuucaagaugagaucugggaaaagcuccauuaugcggucugacgccccuaucggaaaguguaacagcgagugcauuacccccaauggcuccaucccgaacgauaagccuuuucagaaugugaaccgcauuacauauggcgcgugucccagauacgugaaacaaaauacgcugaaacuugccaccgggaugcggaacgucccugaaaagcagacacgcggaaucuucggcgcuaucgccggguuuauugagaauggaugggaaggcaugauggacgggugguauggauucagacaccagaacagcgagggcaccggccaagcugccgaucugaagucuacacaggccgcuaucaaucagauuaacgggaaacucaauaagcugaucgagaaaaccaacgaaaaguuucaucagauugagaaggaguucuccgaaguggaaggacggauccaagaccuugagaaauacguugaggauacgaagaucgaccuguggagcuauaacgcggaacuccugguggcccuggagaaucagcacacaauugaucucaccgacucugaaaugaacaaacuguucgagagaacccgcaagcagcuucgggaaaaugcugaggauaugggcaacgggugcuuuaaaaucuaccauaagugugacaaugccugcauuggauccaucagaaacggcacauaugaucacgacgucuaccgcgacgaggcccugaauaaccgguuccagauuaaggggguggaacucaaaagcggcuacaaggauuggauccuguggauuuccuuugcuaucucuugcuuccuucuguguguugugcuccugggaagcaucaugugggccugccaaagaggcaauauucgcuguaacaucugcauuuga

SEQ ID NO: 186809 - RNA, 1701 nt, Artificial Sequence
  derived and/or modified sequence opt5 from hemagglutinin__InfluenzaA__ACZ53978
augaagaccaucauugcccugagcuacaucuucugccucgcucuggcccagaaacuucccggcaacgacaauuccacagcgacgcugugucucgggcaccaugcugugccuaacggaacccuggucaagacaauuaccaaugaucaaaucgagguuacaaacgccaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucguggagcggagcaaggcuuauuccaauuguuacccuuaugacguccccgauuacgccucucugaaaagccuuauugcuuccagcgggacgcuggaauuuaacaaugagucuuucaacuggaucggagugucccaaaauggcaccagcucugccugcaagcgcauuuccaucacaguuagcuuuaacaagcucaauuggcugcaccagcuuaaauauagauacccugcgcugaacgugaccaugcccaauaacgacaaguucgauaaacucuauauuuggggcguccaucacccuucuacagacuccgaucagaccagccuguacgcccaggcuuccgggcgggugacgguuucuacaaagcgcagccaacagaccgugaucccgaacauuggauccagacccuggguccggggcgugagcucucgcaucuccaucuacuggacaauugugaaaccuggggacguccugguuaucaauagcaacggaaaucucauugcccccagaggcuauuuuaagaugcggucuggaaagagcuccaucaugcgcucugacgcuccuauugggaaauguaacagcgagugcaucacccccaauggcuccaucccgaacgauaagccuuuccagaaugugaacagaauuaccuacggcgccuguccccgguaugugaaacagaauacacugaaacuugcgacggggaugcgcaacgucccugaaaagcaaaccagaggaaucuuuggcgccauugcuggguucaucgagaauggaugggaaggcaugguggacgggugguacggauuucggcaccagaacagcgagggcacaggccaggccgcugaucugaagucuacccaagccgccauuaaucagaucacagggaaacucaacaagcugaucgagaagaccaaugaaaaauuccaucagauugagaaggaauuuuccgagguugaaggacgcauccaggaccuugagaaauauguggaggauacgaagauugaccuguggagcuacaacgcugaacuccuggucgcgcuggagaaccaacacacaaucgaucucaccgacucugaaaugaauaaacuguucgagagaacccggaagcagcuuagagaaaacgccgaggauaugggcaaugggugcuucaagauuuaucauaaaugugacaacgcuugcaucggauccauucgcaauggcacauacgaucacgacguguaccgggacgaggcccugaacaauagauuucagaucaaggggguugaacucaaaagcggcuauaaggauuggauccuguggauuuccuucgccaucucuugcuuucuucugugugugguccuccugggauucauuaugugggcuugccagcgcggcaacauccgguguaauauuugcaucuga

SEQ ID NO: 186810 - RNA, 1701 nt, Artificial Sequence
  derived and/or modified sequence opt5 from hemagglutinin__InfluenzaA__ACZ56080
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguagccaugccggcgcgaaaucuuuuuauaagaaucugaucuggcucguuaaaaagggcaacuccuaccccaaacugagcaaguccuauauuaaugacaaggggaaagaagugcuuguccuguggggaauccaccacccuucuaccagcgccgaucaacagucccucuaccagaacgcugacgccuacguguucgugggcacaagcagauauucuaagaaauuuaagcccgagauugcuauccggccuaaaguccgcgggcaggagggaagaaugaauuacuauuggacccugguugaaccgggcgauaagauuacguucgaggccacagggaaccugguggugccccgguacgcguuugccauggaacgcaacgcuggauccggcaucauuaucagcgacaccccuguccaugauugcaauacaaccugucaaacccccaaaggcgccaucaacacaucucucccuuuccagaauauucaccccaucacgauugggaagugcccgaaguaugugaaaagcaccaagcugagacuugcuacaggacugcggaacguuccuuccauccagucucgcggccucuuuggggccauugccggauucaucgagggcggguggaccggaaugguggacggcugguacggcuaucaucaccagaaugaacaagggagcggauacgcugcggaccugaaauccacacagaacgccaucgaugagauuaccaauaaggucaacagcgugaucgagaaaaugaauacgcaguuuacagcuguuggcaaggaguucaaccaccuugagaagagaauugaaaaucugaacaaaaagguggacgauggguuccucgacaucuggaccuacaaugccgagcugcugguccuccuggaaaacgagcggacccuugauuaucaugacucuaaugugaaaaaccuguacgagaagguccgcucccagcucaaaaacaaugccaaggaaauuggaaacggcuguuuugaguucuaucacaagugcgauaauacauguauggaaagcgugaaaaacgggaccuacgacuaucccaaguacucugaggaagcuaaacugaauagagaggagaucgauggcguuaaacuugaauccacacggaucuaucaaauucuggccaucuacagcacgguggcguccucucucguccuggugguuagccugggagcuauuuccuuuuggaugugcucuaacggcagccuccagugccgcaucuguauuuga

SEQ ID NO: 186811 - RNA, 1701 nt, Artificial Sequence
  derived and/or modified sequence opt5 from hemagglutinin__InfluenzaA__ACZ61118
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccaauccaccucugccgaucagcagagccucuaccagaacgcugacgccuacguguucgugggcuccagcagauauucuaagaaauuuaagcccgagauugcuauccggccuaaaguccgcgaucaagaggggagaaugaauuacuauuggacacugguugaaccgggagacaagauuaccuucgaggccacgggcaaccugguggugccccgguacgcguuugccauggaacgcaacgcuggguccggaaucauuaucagcgauacaccuguccaugacugcaauaccacaugucagacccccaaaggcgccaucaacaccucucucccuuuccagaauauucaccccaucacaauuggcaagugcccgaaguaugugaaaagcacgaagcugagacuugcuaccgggcugcggaacguuccuuccauccagucucgcggacucuuuggcgccauugccggguucaucgagggaggcuggacagggaugguggacggaugguacggcuaucaucaccaaaaugaacagggcagcggguacgcugcggaucugaaauccacccagaacgccaucgacgagauuacaaauaaggucaacagcgugaucgagaaaaugaauacccaguuuacggcuguuggaaaggaguucaaccaccuugagaagagaauugaaaaucugaacaaaaagguggaugacggcuuccucgauaucuggacauacaaugccgagcugcugguccuccuggaaaacgagcggacccuugacuaucaugauucuaaugugaaaaaccuguacgagaagguccgcucccaacucaaaaacaaugccaaggaaauugggaacggauguuuugaguucuaucacaagugcgacaauaccuguauggaaagcgugaaaaacggcacauacgauuaucccaaguacucugaggaagcuaaacugaauagagaggagaucgacgggguuaaacuugaauccacccggaucuaucagauucuggccaucuacagcacaguggcguccucucucguccuggugguuagccugggcgcuauuuccuuuuggaugugcucuaacggaagccuccagugccgcaucuguauuuga

SEQ ID NO: 186812 - RNA, 1701 nt, Artificial Sequence
  derived and/or modified sequence opt5 from hemagglutinin__InfluenzaA__ACZ61119
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagagccucuaccagaacgcugacgccuacguguucgugggcuccagcagauauucuaaaaaguuuaaaccugagauugcuauccggccgaagguccgcgaucaggaagggagaaugaauuacuauuggacacugguugagcccggagacaaaauuaccuucgaagccacgggcaaccugguggugccucgguacgcguuugccauggagcgcaacgcuggguccggaaucauuaucagcgauacacccguccaugacugcaauaccacaugucaaaccccuaagggcgccaucaacaccucucuccccuuccacaauauucauccgaucacaauuggcaaaugcccuaaguauguuaagagcacgaaacugagacuugcuaccgggcugcggaacgugcccuccauccagucucgcggacucuuuggcgccauugccggguucaucgaaggaggcuggacagggaugguggacggaugguacggcuaucaccaccagaaugagcagggcagcggguacgcugcggaucugaaguccacccaaaacgccaucgacgagauuacaaauaaagucaacagcgugaucgaaaagaugaauacccaguuuacggcuguuggaaaagaguucaaccaucuugaaaagagaauugagaaucugaacaagaaaguggaugacggcuuccucgauaucuggacauacaaugccgaacugcugauucuccuggagaacgagcggacccuugacuaucacgauucuaaugucaagaaccuguacgaaaaagugcgcucccagcucaagaacaaugccaaagagaucgggaacggauguuuugaguucuaucauaagugcgacaauaccuguauggaaagcgucaagaacggcacauacgauuauccuaaauacucugaagaggcuaagcugaauagagaggaaaucgacggggugaaacuugaguccacccggauuuaucagauccuggccauuuacagcacaguugcguccucucucgugcuggucgugagccugggcgcuaucuccuuuuggaugugcucuaacggaagccuccaaugccgcauuuguaucuga

SEQ ID NO: 186813 - RNA, 1701 nt, Artificial Sequence; identical to SEQ ID NO: 185693
  derived and/or modified sequence opt5 from hemagglutinin__InfluenzaA__ACZ61122

SEQ ID NO: 186814 - RNA, 1701 nt, Artificial Sequence; identical to SEQ ID NO: 185693
  derived and/or modified sequence opt5 from hemagglutinin__InfluenzaA__ACZ61123

SEQ ID NO: 186815 - RNA, 1701 nt, Artificial Sequence; identical to SEQ ID NO: 186491
  derived and/or modified sequence opt5 from hemagglutinin__InfluenzaA__ACZ74627

SEQ ID NO: 186816 - RNA, 1698 nt, Artificial Sequence
  derived and/or modified sequence opt5 from hemagglutinin__InfluenzaA__ACZ81554
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacaaucacaacgggaaacuuugccugcucaagggaaucgcgccccugcagcugggcaauuguaccguugcuggguggauucucggaaacccugagugcgaacugcuuaucucuaaagagagcugguccuacauuguggaaaagccgaaucccgagaacggcacguguuauccugggcauuuugccgauuacgaggaacugagagagcaacucucuagcgucuccucuuucgaacgguuugagaucuuccccaaggagagcuccuggccuaaucacaccgugacaggaguuagcgccucuugcucccauaacggcgaaaauagcuuuuaucgcaaccugcuuuggcugaccggcaaaaaugggcucuaccccaaccugucuaaguccuaugcuaacaauaaagagaaggaagugcugguccucuggggagugcaccacccuccgaacaucgccgaccagaaaacacuguaccauaccgagaaugcuuacgugagcgucguuucuucccacuauagcagaaaguucacgcccgaaauugccaagcggccuaaaauccgcgaucaggagggcagaauuaacuacuauuggacacuucuggagcccggggacaccaucauuuuugaagcgaauggaaaccucaucgccccucgguacgcuuucgcccugucccgcggcuuugggucuggaauuaucaauagcaacgcucccauggauaagugugacgccaaaugccagacaccgcaaggcgcgaucaauuccagccuuccuuuccagaacgugcaucccgugaccauuggcgaguguccuaaguaugucagaucugccaaacugcggauggugaccgggcuccgcaauauccccuccauucagagcagaggacuguuuggcgcuaucgccggguucauugaaggaggcuggacagggaugguugauggaugguacggcuaucaccaccagaacgagcaaggcucuggguacgcugccgaccaaaagagcacgcagaaugccaucaacggaaucaccaauaaagugaacuccgucauugaaaagaugaacacacaguuuaccgcugugggcaaggaguucaauaaacuggagcggcgcauggaaaaccucaauaagaaaguugaugacggguucaucgauauuuggacauacaacgcggagcugcuugugcugcucgaaaaugagagaacccuggacuuucaugacucuaacgucaagaaucuuuaugaaaaagucaagagccagcugaagaacaaugccaaagagaucggaaacggcugcuucgaguuuuaccacaaguguaaugaugaaugcauggaguccgugaaaaacgggacguaugacuaccccaaguauagcgaagagucuaaacucaaucgggagaagauugauggcgugaagcuggaauccaugggaguuuaccagauccuggcuaucuauagcacaguggccucuucccucguccugcuugugagccugggcgccauuuccuucuggaugugcucuaacgggagccuccagugucgcaucugcauuuga

SEQ ID NO: 186817 - RNA, 1698 nt, Artificial Sequence
  derived and/or modified sequence opt5 from hemagglutinin__InfluenzaA__ACZ81555
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaaaacuccuuuuaucgcaaucugcuuuggcugacaggcaaaaacgggcucuaccccaaucugagcaagucuuaugcuaacaacaaagagaaggaagugcugguccucuggggagugcaccacccuccgaauaucggcgaccagaaaacccuguaccauacagagaacgccuacguguccgucguuagcucccacuauucuagaaaguucacccccgaaauugcuaagcggccuaaagugcgcgaucaggaggggagaaucaauuacuauugggcccuucuggagcccggagacacgauuaucuuugaagcgaacggcaaucucauugccccucgguacgcuuucgcccugagccgcggguuuggauccggcaucauuaacagcaaugcucccauggauaagugugacgccaaaugccagacaccgcaaggcgcgaucaacucuucccuuccuuuccagaaugugcaucccgucaccaucggggaguguccuaaguaugugagaagcgccaaacugcggaugguuacaggacuccgcaacauucccucuauccagagcagaggccuguuuggggcuauugccggauucaucgaaggcggguggaccggaaugguggauggcugguacggcuaucaccaccagaaugagcaaggguccggauacgcugccgaccagaagucuacccagaacgccauuaauggcaucacaaacaaagucaauagcgugaucgaaaagaugaacacgcaguuuaccgcuguugggaaggaguucaacaaacuggagcggcgcauggaaaaucucaacaagaaaguggaugacggauucauugauaucuggacauacaaugcggagcugcuuguccugcucgaaaacgagagaacccuggacuuucaugacuccaaugugaagaaccuuuaugaaaaagucaagagccaacugaagaauaacgccaaagagauuggcaaugggugcuucgaguuuuaccacaaguguaacgaugaaugcauggagucugugaaaaauggcacauaugacuaccccaaguauuccgaagagagcaaacucaaccgggagaagaucgauggaguuaagcuggaaucuaugggcguguaccagauucuggcuaucuauuccaccgucgccagcucccucgugcugcuuguuucucugggggccaucagcuucuggaugugcuccaauggaucucuccagugucgcauuugcaucuga

SEQ ID NO: 186818 - RNA, 1698 nt, Artificial Sequence
  derived and/or modified sequence opt5 from hemagglutinin__InfluenzaA__ACZ81556
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggagccuccgcuagcugcucucauaauggcgaaaacuccuuuuaucgcaaucugcuuuggcugacaggcaaaaacgggcucuaccccaaucugagcaagucuuaugccaacaacaaagagaaggaaguucuggugcucuggggaguccaccacccuccgaauaucgcugaccagaaaacccuguaccauacagagaacgccuacguguccguggucagcucccacuauucuagaaaguucacccccgaaauugcgaagcggccuaaaguucgcgaucaggagggcagaaucaauuacuauuggacgcuucuggagcccggggacacaauuaucuuugaagccaacggaaaucucauugcuccucgguacgccuucgcucugagccgcggcuuuggguccggaaucauuaacagcaaugcccccauggauaagugugacgcgaaaugccagaccccgcaaggcgccaucaacucuucccuuccuuuccagaaugugcaucccgugacaaucggcgaguguccuaaguaugucagaagcgcuaaacugcggauggugaccgggcuccgcaacauucccucuauccagagcagaggacuguuuggcgccauugcuggguucaucgaaggaggcuggaccgggaugguugauggaugguacggcuaucaccaccagaaugagcaaggcuccggguacgccgccgaccagaagucuacacagaacgcuauuaauggaaucacgaacaaagugaauagcgucaucgaaaagaugaacacccaguuuacagcggugggcaaggaguucaacaaacuggagcggcgcauggaaaaucucaacaagaaaguugaugacggguucauugauaucuggaccuacaaugccgagcugcuugugcugcucgaaaacgagagaacacuggacuuucaugacuccaaugucaagaaccuuuaugaaaaagucaagagccaacugaagaauaacgcuaaagagauuggaaauggcugcuucgaguuuuaccacaaguguaacgaugaaugcauggagucugugaaaaaugggaccuaugacuaccccaaguauuccgaagagagcaaacucaacaaggagaagaucgauggcgugaaacuggaaucuaugggaguuuaccagauucuggccaucuauuccacgguggccagcucccucguccugcuugugucucugggcgcuaucagcuucuggaugugcuccaaugggucucuccagugucggauuugcaucuga

SEQ ID NO: 186819 - RNA, 1701 nt, Artificial Sequence
  derived and/or modified sequence opt5 from hemagglutinin__InfluenzaA__ACZ81557
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgggucuccgcaccagauccuugacgggaaaaauuguacccugauugaugcccuccugggcgacccccagugcgauggguuucaaaacaagaaaugggaccuguucgucgaaagaagcaaggccuauuccaauuguuacccuuaugaugugcccgacuacgcuucucuccggagccugguugccuccagcggaacgcuugaguuuaacaaugaaucuuucaacuggaccggcgugacacagaauggcaccuccagcgcuugcauccgcagaucuaagaacuccuuuuucagccggcugaauuggcucacacaucugaacuuuaaauaucaggcccuuaaugucaccaugccuaacaacgagcaguucgauaagcuguacauuuggggagugcaccaucccggaacggacaaagaucaaaucuuucucuaugcgcaggccucuggccgcauuacaguuuccaccaagagaagccagcagacagugaucccuaauauugggucccggccgcgcgucagaaacauccccucucggaucagcauuuacuggaccaucgugaaaccuggagacauucugcugaucaauuccaccggcaaccucauugcuccccgcggguacuucaagauccaaagcggaaagucuuccaucaugagaagcgaugccccuauuggcaaauguaauucugagugcaucacacccaacggcagcauuccgaaugacaagccuuuucagaacgugaaucggaucacguauggggcuuguccccgcuacgucaaacagaacacccugaaacuugccacaggaaugagaaauguuccugaaaaacaaacccggggcauuuucggggcgaucgccggauuuaucgagaacggcugggaagggaugguggacggaugguauggcuuccgccaccaaaauuccgagggcagagggcaggcugccgaucugaagucuacacaggcugccauugaccagaucaacggaaaacucaaucggcugauuggcaagaccaacgagaaguuccaccagaucgaaaaagaguuuagcgaaguggaggggcgcauucaggaucuugaaaaguacgucgaggacacgaaaaucgaucugugguccuauaacgccgagcuccugguggcucuggaaaaucagcauacaauugaccucaccgauagcgagaugaacaagcuguucgaaaagaccaagaagcaacuuagagagaaugcggaagacaugggaaacggcugcuuuaaaaucuaccacaagugugauaaugccugcaucgggucuauucggaacggcacauaugaccaugauguuuacagagacgaggcucugaauaaccgcuuccagaucaaaggaguggagcucaaguccggcuacaaagacuggauucuguggaucagcuuugccauuucuugcuuccuucugugugucgcccuccugggguuuaucaugugggcuugccagaagggaaauauccgguguaacauuugcaucuga

SEQ ID NO: 186820 - RNA, 1701 nt, Artificial Sequence
  derived and/or modified sequence opt5 from hemagglutinin__InfluenzaA__ACZ81558
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccauugcgacggcuuucagaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacaaaauggcaccuccagcgcuugcauccgcagaucuaagaacuccuuuuucagccggcugaauuggcucacacaccugaacuuuaaauauccugcccuuaaugucaccaugcccaacaacgagcaguucgacaagcuguacauuuggggcgugcaucacccugggacggauaaagaccagaucuuucucuaugcgcaggccucuggacgcauuacaguuuccaccaagagaagccaacagacagcuaucccgaauauuggcucccggccccgcgugagaaacaucccuucucggaucagcauuuacuggaccaucgucaaacccggggauauucugcugaucaauuccaccggaaaccucauugccccucgcggcuacuucaagaucagaagcgggaagucuuccaucaugcggagcgacgcucccauuggaaaauguaauucugagugcaucacaccgaacggcagcauuccuaaugacaagcccuuucagaacgugaaucgcaucacguauggcgccuguccuagauacgugaaacagaacacccugaaacuugcgacagggaugcggaauguccccgaaaagcaaacccgcggaauuuucggcgccaucgcuggguuuaucgagaacggaugggaaggcaugguugaugggugguauggauucagacaccaaaauuccgagggccggggccaggccgcugaccugaagucuacacaggccgccauugaucagaucaacgggaaacucaauagacugauugagaagaccaacgaaaaguuccaucagaucgagaaagaauuuagcgagguggaaggacgcauucaggaccuugagaaguacguggaggauacgaaaaucgaccugugguccuauaacgcugaacuccuggucgcgcuggagaaucaacacacaauugaucucaccgacagcgaaaugaacaagcuguucgagaaaaccaagaagcagcuucgggaaaaugccgaggauaugggcaacgggugcuuuaaaaucuaccauaagugugacaaugcuugcaucggaucuauuagaaacggcacauaugaucacgacguguaccgcgacgaggcccugaauaaccgguuccagaucaaagggguugaacucaaguccggcuacaaagauuggauucuguggaucagcuuugccauuucuugcuuccuucuguguguggcucuccugggauuuaucaugugggccugccagaagggcaauaucagauguaacauuugcaucuga

SEQ ID NO: 186821 - RNA, 1701 nt, Artificial Sequence
  derived and/or modified sequence opt5 from hemagglutinin__InfluenzaA__ACZ81559
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccauugcgacggcuuucagaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacaaaauggcaccuccagcgcuugcauccgcagaucuaagaacuccuuuuucagccggcugaauuggcucacacaccugaacuuuaaauauccugcccuuaaugucaccaugcccaacaacgagcaguucgacaagcuguacauuuggggcgugcaucacccugggacggauaaagaccagaucuuucucuaugcgcaggccucuggacgcauuacaguuuccaccaagagaagccaacagacagcuaucccgaauauuggcucccggccccgcgugagaaacaucccuucucggaucagcauuuacuggaccaucgucaaacccggggauauucugcugaucaauuccaccggaaaccucauugccccucgcggcuacuucaagaucagaagcgggaagucuuccaucaugcggagcgacgcucccauuggaaaauguaauucugagugcaucacaccgaacggcagcauuccuaaugacaagcccuuucagaacgugaaucgcaucacguauggcgccuguccuagauacgugaaacagaacacccugaaacuugcgacagggaugcggaauguccccgaaaaacaaacccgcggaauuuucggcgccaucgcuggguuuaucgagaacggaugggaaggcaugguugaugggugguauggauucagacaccaaaauuccgagggccggggccaggccgcugaccugaagucuacacaggccgccauugaucagaucaacgggaaacucaauagacugauuggaaagaccaacgagaaguuccaucagaucgaaaaagaguuuagcgaaguggagggccgcauucaggaccuugaaaaguacguggaggauacgaaaaucgaccugugguccuauaacgcugagcuccuggucgcgcuggaaaaucaacacacaauugaucucaccgacagcgagaugaacaagcuguucgaaaagaccaagaagcagcuucgggagaaugccgaagauauggggaacggaugcuuuaaaaucuaccauaagugugacaaugcuugcaucggcucuauuagaaacgggacauaugaucacgacguguaccgcgacgaggcccugaauaaccgguuccagaucaaaggcguugagcucaaguccggauacaaagauuggauucuguggaucagcuuugccauuucuugcuuccuucuguguguggcucuccugggcuuuaucaugugggccugccagaaggggaauaucagauguaacauuugcaucuga

SEQ ID NO: 186822 - RNA, 1701 nt, Artificial Sequence; identical to SEQ ID NO: 185693
  derived and/or modified sequence opt5 from hemagglutinin__InfluenzaA__ACZ81632

SEQ ID NO: 186823 - RNA, 1701 nt, Artificial Sequence; identical to SEQ ID NO: 185693
  derived and/or modified sequence opt5 from hemagglutinin__InfluenzaA__ACZ81642

SEQ ID NO: 186824 - RNA, 1701 nt, Artificial Sequence
  derived and/or modified sequence opt5 from hemagglutinin__InfluenzaA__ACZ81652
augaaggccauccuggugguccuccuguacaccuucgcuacagccaacgcggacacgcuuugcauuggcuaucacgcuaauaacagcaccgauacaguugacaccgugcuggagagaaaugugacagucacccauuccgugaaccuccuggaagauaaacacaaugggaagcuguguaaacugcggggaguugcgccccuccaucugggcaagugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgcgagcagcuuuccagcgucucuuccuucgaaagauuugagaucuuccccaaaaccagcucuuggccuaaucacgauuccaacaagggagugacagccgcuuguccccaugccgaagccaagagcuuuuauaaaaaucugaucuggcucguuaagaaaggcaacucuuacccuaagcuguccaaaagcuauauuaaugacaagggcaaggaggugcuuguccugugggggauccaccaccccuccaccucugccgaucaacagagccucuaccagaacgcugacgccuacguguucgugggaacaucccgguauagcaaaaaguuuaaaccugagauugcuauccgcccgaaggucagaggccaggaagggcggaugaauuacuauuggacccugguugagcccggagauaaaauuacguucgaagccacaggcaaccugguggugccucgcuacgcguuugccauggagagaaacgcugggucuggaaucauuaucuccgacacccccguccaugauugcaauacaaccugucaaaccccuaagggcgccaucaacacaagccuccccuuccagaauauucacccgaucacgauuggcaaaugcccuaaguaugugaagucuaccaaacugcggcuugcuacagggcugcgcaacguucccagcauccaguccagaggacucuuuggcgccauugccggguucaucgaaggaggcuggaccgggaugguggacggaugguacggcuaucaucaccagaaugagcaaggcucuggguacgcugcggaccuuaagagcacacagaacgccaucgaugagauuaccaauaaagucaacuccgugaucgaaaagaugaauacgcaguuuacagcuguuggaaaagaguucaaccaccuugaaaagcggauugagaaucugaacaagaaaguggacgauggcuuccucgacaucuggaccuacaaugccgaacugcugguccuccuggagaacgagcgcacccuugauuaucaugacagcaaugugaagaaccuguacgaaaaagucagaucucagcucaagaacaaugccaaagagauugggaacggauguuuugaguucuaucacaagugcgauaauacauguauggaguccgugaagaacggcaccuacgacuauccuaaauacagcgaagaggcuaagcugaaucgggaggaaaucgaugggguuaaacuugagucuacacgcaucuaucaaauucuggccaucuacuccacgguggcgagcucccucguccuggugguuucucugggcgcuauuagcuuuuggaugugcuccaacggaucucuccagugcagaaucuguauuuga

SEQ ID NO: 186825 - RNA, 1701 nt, Artificial Sequence
  derived and/or modified sequence opt5 from hemagglutinin__InfluenzaA__ACZ92130
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagagccucuaccagaacgcugacgccuacguguucgugggcuccagcagauauucuaaaaaguuuaaaccugagauugcuauccggccgaagguccgcgaucaggaagggagaaugaauuacuauuggacacugguugagcccggagacaaaauuaccuucgaagccacgggcaaccugguggugccucgguacgcguuugccauggagcgcaacgcuggguccggaaucauuaucagcgauacacccguccaugacugcaauaccacaugucaaaccccuaagggcgccaucaacaccucucuccccuuccacaauauucauccgaucacaauuggcaaaugcccuaaguauguuaagagcacgaaacugagacuugcuaccgggcugcggaacgugcccuccauccagucucgcggacucuuuggcgccauugccggguucaucgaaggaggcuggacagggaugguggacggaugguacggcuaucaccaccagaaugagcagggcagcggguacgcugcggaucugaaguccacccaaaacgccaucgacgagauuacaaauaaagucaacagcgugaucgaaaagaugaauacccaguuuacggcuguuggaaaagaguucaaccaucuugaaaagagaauugagaaucugaacaagaaaguggaugacggcuuccucgauaucuggacauacaaugccgaacugcugguccuccuggagaacgagcggacccuugacuaucacgauucuaaugugaagaaccuguacgaaaaaguccgcucccagcucaagaacaaugccaaagagauugggaacggauguuuugaguucuaucauaagugcgacaauaccuguaucgaaagcgugaagaacggcacauacgauuauccuaaauacucugaagaggcuaagcugaauagagaggaaaucgacgggguuaaacuugaguccacccggauuuaucagauccuggccauuuacagcacaguggcguccucucucguccuggugguuagccugggcgcuaucuccuuuuggaugugcucuaacggaagccuccaaugccgcauuuguaucuga

SEQ ID NO: 186826 - RNA, 1701 nt, Artificial Sequence; identical to SEQ ID NO: 185935
  derived and/or modified sequence opt5 from hemagglutinin__InfluenzaA__ACZ92131

SEQ ID NO: 186827 - RNA, 1701 nt, Artificial Sequence; identical to SEQ ID NO: 185935
  derived and/or modified sequence opt5 from hemagglutinin__InfluenzaA__ACZ92132

SEQ ID NO: 186828 - RNA, 1701 nt, Artificial Sequence; identical to SEQ ID NO: 185935
  derived and/or modified sequence opt5 from hemagglutinin__InfluenzaA__ACZ92133

SEQ ID NO: 186829 - RNA, 1701 nt, Artificial Sequence; identical to SEQ ID NO: 185693
  derived and/or modified sequence opt5 from hemagglutinin__InfluenzaA__ACZ92134

SEQ ID NO: 186830 - RNA, 1701 nt, Artificial Sequence; identical to SEQ ID NO: 185693
  derived and/or modified sequence opt5 from hemagglutinin__InfluenzaA__ACZ95465

SEQ ID NO: 186831 - RNA, 1701 nt, Artificial Sequence; identical to SEQ ID NO: 185680
  derived and/or modified sequence opt5 from hemagglutinin__InfluenzaA__ACZ95837

SEQ ID NO: 186832 - RNA, 1701 nt, Artificial Sequence; identical to SEQ ID NO: 185693
  derived and/or modified sequence opt5 from hemagglutinin__InfluenzaA__ACZ95847

SEQ ID NO: 186833 - RNA, 1701 nt, Artificial Sequence
  derived and/or modified sequence opt5 from hemagglutinin__InfluenzaA__ACZ95857
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccagcaaaggcgccaucaacacaucucucccuuuccagaauauucaccccaucacgauuggcaagugcccgaaguaugugaaaagcaccaagcugagacuugcuacagggcugcggaacguuccuuccauccagucucgcggacucuuuggcgccauugccggguucaucgagggaggcuggaccgggaugguggacggaugguacggcuaucaucaccagaaugaacaaggcagcggguacgcugcggaucugaaauccacacagaacgccaucgacgagauuaccaauaaggucaacagcgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauucuaaugugaaaaaccuguacgagaagguccgcucccagcucaaaaacaaugccaaggaaauugggaacggauguuuugaguucuaucacaagugcgacaauacauguauggaaagcgugaaaaacggcaccuacgauuaucccaaguacucugaggaagcuaaacugaauagagaggagaucgacgggguuaaacuugaauccacacggaucuaucaaauucuggccaucuacagcacgguggcguccucucucguccuggugguuagccugggcgcuauuuccuuuuggaugugcucuaacggaagccuccagugccgcaucuguauuuga

SEQ ID NO: 186834 - RNA, 1701 nt, Artificial Sequence; identical to SEQ ID NO: 185693
  derived and/or modified sequence opt5 from hemagglutinin__InfluenzaA__ACZ95867

SEQ ID NO: 186835 - RNA, 1701 nt, Artificial Sequence
  derived and/or modified sequence opt5 from hemagglutinin__InfluenzaA__ACZ95887
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagagccucuaccagaacgcugacgccuacguguucgugggcuccagcagauauucuaaaaaguuuaaaccugagauugcuauccggccgaagguccgcaaucaggaagggagaaugaacuacuauuggacacugguugagcccggagauaaaauuaccuucgaagccacgggcaaccugguggugccucgguacgcguuugccauggagcgcaaugcuggguccggaaucauuaucagcgacacacccguccaugauugcaacaccacaugucaaaccccuaagggcgccaucaauaccucucuccccuuccacaacauucauccgaucacaauuggcaaaugcccuaaguauguuaagagcacgaaacugagacuugcuaccgggcugcggaaugugcccuccauccagucucgcggacucuuuggcgccauugccggguucaucgaaggaggcuggacagggaugguggacggaugguacggcuaucaccaccagaacgagcagggcagcggguacgcugcggaccugaaguccacccaaaaugccaucgaugagauuacaaacaaagucaauagcgugaucgaaaagaugaacacccaguuuacggcuguuggaaaagaguucaaucaucuugaaaagagaauugagaaccugaauaagaaaguggacgauggcuuccucgacaucuggacauacaacgccgaacugcugguccuccuggagaaugagcggacccuugauuaucacgacucuaacgugaagaaccuguacgaaaaaguccgcucccagcucaagaauaacgccaaagagauugggaauggauguuuugaguucuaucauaagugcgauaacaccuguauggaaagcgugaagaauggcacauacgacuauccuaaauacucugaagaggcuaagcugaacagagaggaaaucgaugggguuaaacuugaguccacccggaucuaucagauucuggccaucuacagcacaguggcguccucucucguccuggugguuagccugggcgcuauuuccuuuuggaugugcucuaauggaagccuccaaugccgcaucuguauuuga

SEQ ID NO: 186836 - RNA, 1701 nt, Artificial Sequence; identical to SEQ ID NO: 185693
  derived and/or modified sequence opt5 from hemagglutinin__InfluenzaA__ACZ95897

SEQ ID NO: 186837 - RNA, 1701 nt, Artificial Sequence
  derived and/or modified sequence opt5 from hemagglutinin__InfluenzaA__ACZ95907
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccgucuaugacugcaauacaaccugucaaaccccuaaaggcgccaucaacacaagccuccccuuccagaauauucauccgaucacgauuggcaagugcccuaaguacgugaaaucuaccaagcugagacuugcuacagggcugcggaacguucccagcauccagucccgcggacucuuuggcgccauugccggguucaucgagggaggcuggaccgggaugguggacggaugguauggcuaccaccaucagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuauaaugccgagcugcugguccuccuggaaaacgagcggacccuugacuaccacgauagcaaugugaaaaaccuguaugagaagguccgcucucagcucaaaaacaaugccaaggaaauugggaacggauguuuugaguucuaccauaagugcgacaauacauguauggaauccgugaaaaacggcaccuaugauuacccuaaguauagcgaggaagcuaaacugaauagagaggagaucgacgggguuaaacuugaaucuacacggaucuaccaaauucuggccaucuacuccacgguggcgagcucccucguccuggugguuucucugggcgcuauuagcuuuuggaugugcuccaacggaucucuccagugccgcaucuguauuuga

SEQ ID NO: 186838 - RNA, 1701 nt, Artificial Sequence; identical to SEQ ID NO: 185693
  derived and/or modified sequence opt5 from hemagglutinin__InfluenzaA__ACZ95927

SEQ ID NO: 186839 - RNA, 1701 nt, Artificial Sequence
  derived and/or modified sequence opt5 from hemagglutinin__InfluenzaA__ACZ95937
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaagcuguguaaacugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccaacgccgaucaacagucucucuaccagaaugcugacgccuacguguucgugggcagcuccagauauagcaaaaaguuuaaaccugagauugcuauccggccgaagguccgcgaucaggaagggagaaugaacuacuauuggacacugguugagcccggagacaaaauuaccuucgaagccacgggcaaccugguggugccucgguacgcguuugccauggagcgcaaugcugggucuggaaucauuaucuccgauacacccguccaugacugcaacaccacaugucaaaccccuaagggcgccaucaauaccagccuccccuuccacaacauucauccgaucacaauuggcaaaugcccuaaguaugugaagucuacgaaacugagacuugcuaccgggcugcggaauguucccagcauccagucccgcggacucuuuggcgccauugccggguucaucgaaggaggcuggacagggaugguggacggaugguacggcuaucaccaccagaacgagcagggcucuggguacgcugcggaucuuaagagcacccaaaaugccaucgacgagauuacaaacaaagucaauuccgugaucgaaaagaugaacacccaguuuacggcuguuggaaaagaguucaaucaucuugaaaagagaauugagaaccugaauaagaaaguggaugacggcuuccucgauaucuggacauacaacgccgaacugcugguccuccuggagaaugagcggacccuugacuaucacgauagcaacgugaagaaccuguacgaaaaaguccgcucucagcucaagaauaacgccaaagagauugggaauggauguuuugaguucuaucauaagugcgacaacaccuguauggaauccgugaagaauggcacauacgauuauccuaaauacagcgaagaggcuaagcugaacagagaggaaaucgacgggguuaaacuugagucuacccggaucuaucagauucuggccaucuacuccacaguggcgagcucccucguccuggugguuucucugggcgcuauuagcuuuuggaugugcuccaauggaucucuccaaugccgcaucuguauuuga

SEQ ID NO: 186840 - RNA, 1701 nt, Artificial Sequence; identical to SEQ ID NO: 185935
  derived and/or modified sequence opt5 from hemagglutinin__InfluenzaA__ACZ95947

SEQ ID NO: 186841 - RNA, 1701 nt, Artificial Sequence; identical to SEQ ID NO: 185693
  derived and/or modified sequence opt5 from hemagglutinin__InfluenzaA__ACZ95957

SEQ ID NO: 186842 - RNA, 1701 nt, Artificial Sequence; identical to SEQ ID NO: 185935
  derived and/or modified sequence opt5 from hemagglutinin__InfluenzaA__ACZ95967

SEQ ID NO: 186843 - RNA, 1701 nt, Artificial Sequence; identical to SEQ ID NO: 186839
  derived and/or modified sequence opt5 from hemagglutinin__InfluenzaA__ACZ95977

SEQ ID NO: 186844 - RNA, 1701 nt, Artificial Sequence
  derived and/or modified sequence opt5 from hemagglutinin__InfluenzaA__ACZ95987
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacauccccagcauucagucccgcggacucuuuggcgccaucgccggguucaucgagggaggcuggaccgggaugauugacggaugguacggcuaucaucaccagaaugaacaaggcucuggguacgcugcggaucugaaaagcacacagaacgccaucgacgagauuaccaauaagguuaacuccgugaucgagaaaaugaauacgcaguuuacagcugucggaaaggaguucaaccaccuugagaagagaauugaaaaucugaacaaaaagguggaugacggcuuccucgauaucuggaccuacaaugccgagcugcugguucuccuggaaaacgagcggacccuugacuaucaugauagcaaugugaaaaaccuguacgagaagguccgcucucagcucaaaaacaaugccaaggaaaucgggaacggauguuuugaguucuaucacaagugcgacaauacauguauggaauccgugaaaaacggcaccuacgauuauccuaaguacagcgaggaagcuaaacugaauagagaggagauugacggggucaaacuugaaucuacacggaucuaucaaauucuggccaucuacuccacgguggcgagcucccucguucugguggucucucugggcgcuauuagcuuuuggaugugcuccaacggaucucuccagugccgcaucuguauuuga

SEQ ID NO: 186845 - RNA, 1701 nt, Artificial Sequence; identical to SEQ ID NO: 185693
  derived and/or modified sequence opt5 from hemagglutinin__InfluenzaA__ACZ95997

SEQ ID NO: 186846 - RNA, 1701 nt, Artificial Sequence; identical to SEQ ID NO: 185693
  derived and/or modified sequence opt5 from hemagglutinin__InfluenzaA__ACZ96007

SEQ ID NO: 186847 - RNA, 1701 nt, Artificial Sequence; identical to SEQ ID NO: 185680
  derived and/or modified sequence opt5 from hemagglutinin__InfluenzaA__ACZ96017

SEQ ID NO: 186848 - RNA, 1701 nt, Artificial Sequence; identical to SEQ ID NO: 185693
  derived and/or modified sequence opt5 from hemagglutinin__InfluenzaA__ACZ96027

SEQ ID NO: 186849 - RNA, 1701 nt, Artificial Sequence; identical to SEQ ID NO: 186839
  derived and/or modified sequence opt5 from hemagglutinin__InfluenzaA__ACZ96047

SEQ ID NO: 186850 - RNA, 1701 nt, Artificial Sequence
  derived and/or modified sequence opt5 from hemagglutinin__InfluenzaA__ACZ96057
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuugucugcaugccggcgcgaaaucuuuuuauaagaaucucaucuggcugguuaaaaagggcaacagcuaccccaaacuuuccaagagcuauauuaaugacaaggggaaagaagugcugguccucuggggaauccaccacccuuccaccucugccgaucaacagagccuguaccagaacgcugacgccuacguguucgugggcacauccagauauagcaagaaauuuaagcccgagauugcuauccggccuaaaguccgcgaucaggaggggagaaugaauuacuauuggacccugguugaaccgggagacaagauuacguucgaggccacaggcaaccucguggugccccgguacgcguuugccauggaacgcaacgcugggucuggaaucauuaucuccgauaccccuguccaugacugcaauacaaccugucaaacccccaaaggcgccaucaacacaagccugccuuuccagaauauucaccccaucacgauuggcaagugcccgaaguaugugaaaucuaccaaacuuagacuggcuacagggcuccggaacaucccuagcauucagucccgcggacuguuuggcgccaucgccggguucaucgagggaggcuggaccgggaugguugacggaugguacggcuaucaucaccagaaugaacaaggcucuggguacgcugcggaucuuaagagcacacagaacgccauugacgagaucaccaauaaggugaacuccgucauugagaaaaugaauacgcaguuuacagcugugggaaaggaguucaaccaccuggagaagagaaucgaaaaucucaacaaaaagguugaugacggcuuccuggauauuuggaccuacaaugccgagcugcucgugcugcuugaaaacgagcggacccuggacuaucaugauagcaaugucaaaaaccucuacgagaaggugcgcucucagcugaaaaacaaugccaaggaaaucgggaacggauguuuugaguucuaucacaagugcgacaauacauguauggaauccgucaaaaacggcaccuacgauuaucccaaguacagcgaggaagcuaaacuuaauagagaggagaucgacggggugaagcuggaaucuacacggauuuaucaaauccucgccauuuacuccacgguugcgagcucccuggugcuggucgugucucucggcgcuaucagcuuuuggaugugcuccaacggaucucugcagugccgcauuuguaucuga

SEQ ID NO: 186851 - RNA, 1701 nt, Artificial Sequence
  derived and/or modified sequence opt5 from hemagglutinin__InfluenzaA__ACZ96069
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggaaacaagauuacguucgaggccacaggcaaccugguggugccucgguacgcguuugccauggaacgcaaugcugggucuggaaucauuaucuccgacacccccguccaugauugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggacggaugguacggcuaucaucaccagaacgaacaaggcucuggguacgcugcggaccugaaaagcacacagaaugccaucgaugagauuaccaacaaggucaauuccgugaucgagaaaaugaacacgcaguuuacagcuguuggaaaggaguucaaucaccuugagaagagaauugaaaaccugaauaaaaagguggacgauggcuuccucgacaucuggaccuacaacgccgagcugcugguccuccuggaaaaugagcggacccuugauuaucaugacagcaacgugaaaaaccuguacgagaagguccgcucucagcucaaaaauaacgccaaggaaauugggaauggauguuuugaguucuaucacaagugcgauaacacauguauggaauccgugaaaaauggcaccuacgacuauccuaaguacagcgaggaagcuaaacugaacagagaggagaucgaugggguuaaacuugaaucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 186852 - RNA, 1701 nt, Artificial Sequence; identical to SEQ ID NO: 186839
  derived and/or modified sequence opt5 from hemagglutinin__InfluenzaA__ACZ96089

SEQ ID NO: 186853 - RNA, 1701 nt, Artificial Sequence
  derived and/or modified sequence opt5 from hemagglutinin__InfluenzaA__ACZ96119
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagauguuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauaucaaugacaaggggaaagaagugcuuguccuguggggcauucaccaccccuccaccucugccgaucaacagagccucuaccagaacgcugacgccuacguguucgugggaacauccagauauagcaagaaauuuaagccugagaucgcuauucggccgaaaguccgcgaucaggaggggagaaugaauuacuauuggacccugguugaacccggagacaagaucacguucgaggccacaggcaaccugguggugccucgguacgcguuugccauggaacgcaacgcugggucuggaauuaucauuuccgauacccccguccaugacugcaauacaaccugucaaaccccuaaaggcgccaucaacacaagccuccccuuccagaauauccacccgauuacgaucggcaagugcccuaaguaugugaaaucuaccaagcugagacuugcuacagggcugcggaacguucccagcauucagucccgcggacucuuuggcgccaucgccggguucauugagggaggcuggaccgggaugguggacggaugguacggcuaucaucaccagaaugaacaaggcucuggguacgcugcggaucugaaaagcacacagaacgccaucgacgagaucaccaauaaggucaacuccgugauugagaaaaugaauacgcaguuuacagcuguuggaaaggaguucaaccaccuugagaagagaaucgaaaaucugaacaaaaagguggaugacggcuuccucgauauuuggaccuacaaugccgagcugcugguccuccuggaaaacgagcggacccuugacuaucaugauagcaaugugaaaaaccuguacgagaagguccgcucucagcucaaaaacaaugccaaggaaaucgggaacggauguuuugaguucuaucacaagugcgacaauacauguauggaauccgugaaaaacggcaccuacgauuauccuaaguacagcgaggaagcuaaacugaauagagaggagauugacgggguuaaacuugaaucuacacggaucuaucaaauccuggccauuuacuccacgguggcgagcucccucguccuggugguuucucugggcgcuaucagcuuuuggaugugcuccaacggaucucuccagugccgcauuuguaucuga

SEQ ID NO: 186854 - RNA, 1701 nt, Artificial Sequence
  derived and/or modified sequence opt5 from hemagglutinin__InfluenzaA__ACZ96129
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggaauuuauugauuacgaggagcugcgggaacagcuuuccagcgucucuuccuucgagcgcuuugaaaucuuccccaagaccagcucuuggccuaaucacgacuccaacaagggagugacagccgcuuguccccaugccggcgcgaaaucuuuuuauaagaaucugaucuggcucguuaaaaagggcaacagcuacccuaaacuguccaagagcuauauuaaugauaaggggaaagaggugcuuguccuguggggaauccaccaccccuccaccucugccgaccaacagagccucuaccagaacgcugaugccuacguguucgugggcacauccagauauagcaagaaauuuaagccugagauugcuauccggccgaaaguccgcgaccaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaccugaaaagcacacagaacgccaucgaugagauuaccaauaaggucaacuccgugaucgaaaagaugaauacgcaguuuacagcuguuggaaaggaguucaaccaccuugaaaagagaauugagaaucugaacaaaaagguggacgauggcuuccucgacaucuggaccuacaaugccgaacugcugguccuccuggagaacgagcggacccuugauuaucaugacagcaaugugaaaaaccuguacgaaaagguccgcucucagcucaaaaacaaugccaaggagauugggaacggauguuuugaguucuaucacaagugcgauaauacauguauggaauccgugaaaaacggcaccuacgacuauccuaaguacagcgaagaggcuaaacugaauagagaggaaaucgaugggguuaaacuugagucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 186855 - RNA, 1701 nt, Artificial Sequence; identical to SEQ ID NO: 185693
  derived and/or modified sequence opt5 from hemagglutinin__InfluenzaA__ACZ96149

SEQ ID NO: 186856 - RNA, 1701 nt, Artificial Sequence; identical to SEQ ID NO: 185693
  derived and/or modified sequence opt5 from hemagglutinin__InfluenzaA__ACZ96159

SEQ ID NO: 186857 - RNA, 1701 nt, Artificial Sequence
  derived and/or modified sequence opt5 from hemagglutinin__InfluenzaA__ACZ96179
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacaagauuaccaauaaagucaacuccgugaucgagaagaugaauacgcaguuuacagcuguuggaaaggaguucaaccaccuugagaaaagaauugagaaucugaacaagaaaguggaugacggcuuccucgauaucuggaccuacaaugccgaacugcugguccuccuggagaacgaacggacccuugacuaucaugauagcaaugugaagaaccuguacgagaaaguccgcucucagcucaagaacaaugccaaggagauugggaacggauguuuugaguucuaucacaaaugcgacaauacauguauggaauccgugaagaacggcaccuacgauuauccuaaauacagcgaagaggcuaagcugaauagagaagagaucgacgggguuaaacuugagucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 186858 - RNA, 1701 nt, Artificial Sequence; identical to SEQ ID NO: 186850
  derived and/or modified sequence opt5 from hemagglutinin__InfluenzaA__ACZ96189

SEQ ID NO: 186859 - RNA, 1701 nt, Artificial Sequence; identical to SEQ ID NO: 186857
  derived and/or modified sequence opt5 from hemagglutinin__InfluenzaA__ACZ96199

SEQ ID NO: 186860 - RNA, 1701 nt, Artificial Sequence; identical to SEQ ID NO: 185693
  derived and/or modified sequence opt5 from hemagglutinin__InfluenzaA__ACZ96209

SEQ ID NO: 186861 - RNA, 1701 nt, Artificial Sequence
  derived and/or modified sequence opt5 from hemagglutinin__InfluenzaA__ACZ96219
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuaaauucgaggccacgggcaaccugguggugccucgguacgcguuugccauggaacgcaacgcugggucuggaaucauuaucuccgauacacccguccaugacugcaauaccacaugucaaaccagcaagggcgccaucaacaccucucucccuuuccagaauauucaccccaucacaauuggcaagugcccgaaauauguuaagagcacgaaacugagacuugcuaccgggcugcggaacgugccuuccauccagucucgcggacucuuuggcgccauugccggguucaucgagggaggcuggacagggaugguggacggaugguacggcuaucaucaccagaaugaacaaggcagcggguacgcugcggaucugaaguccacccagaacgccaucgacgagauuacaaauaaagucaacagcgugaucgagaagaugaauacccaguuuacggcuguuggaaaggaguucaaccaccuugagaaaagaauugaaaaucugaacaagaaaguggaugacggcuuccucgauaucuggacauacaaugccgagcugcugguccuccuggaaaacgagcggacccuugacuaucaugauucuaaugugaagaaccuguacgagaaaguccgcucccagcucaagaacaaugccaaggaaauugggaacggauguuuugaguucuaucacaaaugcgacaauaccuguauggaaagcgugaagaacggcacauacgauuaucccaaauacucugaggaagcuaagcugaauagagaggagaucgccgggguuaaacuugaauccacccggaucuaucaaauucuggcgaucuacagcacaguggcuuccucucucguccuggugguuagccugggcgccauuuccuuuuggaugugcucuaacggaagccuccagugccgcaucuguauuuga

SEQ ID NO: 186862 - RNA, 1701 nt, Artificial Sequence; identical to SEQ ID NO: 185693
  derived and/or modified sequence opt5 from hemagglutinin__InfluenzaA__ACZ96229

SEQ ID NO: 186863 - RNA, 1701 nt, Artificial Sequence; identical to SEQ ID NO: 186857
  derived and/or modified sequence opt5 from hemagglutinin__InfluenzaA__ACZ96239

SEQ ID NO: 186864 - RNA, 1701 nt, Artificial Sequence; identical to SEQ ID NO: 185693
  derived and/or modified sequence opt5 from hemagglutinin__InfluenzaA__ACZ96249

SEQ ID NO: 186865 - RNA, 1701 nt, Artificial Sequence
  derived and/or modified sequence opt5 from hemagglutinin__InfluenzaA__ACZ96269
augaaggccauccuggugguccuccuguacaccuucgcuacagccaacgcggacacgcuuugcauuggcuaucacgcuaauaacagcaccgauacaguugacaccgugcuggagagaaaugugacagucacccauuccgugaaccuccuggaagauaaacacaaugggaagcuguguaaacugcggggaguugcgccccuccaucugggcaagugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgcgagcagcuuuccagcgucucuuccuucgaaagauuugagaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaagugcuuguccuguggggaauccaccaccccuccaccucugccgaucaacagagccucuaccagaacgcugacgccuacguguucgugggcacaucccgguauagcaaaaaguuuaaaccugagauugcuauccgcccgaaggucagagaucaggaggggcggaugaauuacuauuggacccugguugaacccggagacaaaauuacguucgaggccacaggcaaccugguggugccucgcuacgcguuugccauggaaagaaacgcugggucuggaaucauuaucuccgauacccccguccaugacugcaauacaaccugucaaaccccuaagggcgccaucaacacaagccuccccuuccagaauauucacccgaucacgauuggcaaaugcccuaaguaugugaagucuaccaaacugcggcuugcuacagggcugcgcaacguucccagcauccaguccagaggacucuuuggcgccauugccggguucaucgagggaggcuggaccgggaugguggacggaugguacggcuaucaucaccagaaugaacaaggcucuggguacgcugcggaucuuaagagcacacagaacgccaucgacgagauuaccaauaaagucaacuccgugaucgagaagaugaauacgcaguuuacagcuguuggaaaagaguucaaccaccuugagaagcggauugaaaaucugaacaagaaaguggaugacggcuuccucgauaucuggaccuacaaugccgagcugcugguccuccuggaaaacgagcgcacccuugacuaucaugauagcaaugugaagaaccuguacgagaaagucagaucucagcucaagaacaaugccaaagaaauugggaacggauguuuugaguucuaucacaagugcgacaauacauguauggaauccgugaagaacggcaccuacgauuauccuaaauacagcgaggaagcuaagcugaaucgggaggagaucgacgggguuaaacuugaaucuacacgcaucuaucaaauucuggccaucuacuccacgguggcgagcucccucguccuggugguuucucugggcgcuauuagcuuuuggaugugcuccaacggaucucuccagugcagaaucuguauuuga

SEQ ID NO: 186866 - RNA, 1701 nt, Artificial Sequence; identical to SEQ ID NO: 185693
  derived and/or modified sequence opt5 from hemagglutinin__InfluenzaA__ACZ96299

SEQ ID NO: 186867 - RNA, 1701 nt, Artificial Sequence; identical to SEQ ID NO: 185693
  derived and/or modified sequence opt5 from hemagglutinin__InfluenzaA__ACZ96309

SEQ ID NO: 186868 - RNA, 1701 nt, Artificial Sequence
  derived and/or modified sequence opt5 from hemagglutinin__InfluenzaA__ACZ96319
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaucugcaacauugccggguggauccugggaaauccugagugugaaucucucagcacagcuuccucuuggagcuacauuguggagaccuccucuagcgacaacggcacgugcuauccgggggauuuuaucgacuacgaagaacugcgggagcagcuuuccagcgucucuuccuucgaacgcuuugagaucuuccccaaaaccagcucuuggccuaaucacgauuccaacaagggagugacagccgcuuguccccaugccggcgccaagagcuuuuauaaaaaucugauuuggcucguuaagaaaggcaacucuuacccuaagcuguccaaaagcuauaucaaugacaaggggaaggaagugcuuguccuguggggcauucaccaccccuccaccucugccgaucaacagagccucuaccagaacgcugacgccuacguguucgugggaacauccagauauagcaaaaaguuuaaaccugagaucgcuauucggccgaagguccgcgaucaggaggggagaaugaauuacuauuggacccugguugaacccggagacaaaaucacguucgaggccacaggcaaccugguggugccucgguacgcguuugccauggaacgcaacgcugggucuggaauuaucaucuccgauacccccguccaugacugcaauacaaccugucaaaccccuaagggcgccauuaacacaagccuccccuuccagaauauccacccgauuacgaucggcaaaugcccuaaguaugugaagucuaccaaacugagacuugcuacagggcugcggaacguucccagcauucagucccgcggacucuuuggcgccaucgccggguucaucgagggaggcuggaccgggaugguggacggaugguacggcuaucaucaccagaaugaacaaggcucuggguacgcugcggaucuuaagagcacacagaacgccauugacgagaucaccaauaaagucaacuccgugauugagaagaugaauacgcaguuuacagcuguuggaaaagaguucaaccaccuggagaagagaaucgaaaaucugaacaagaaaguggaugacggcuuccucgauauuuggaccuacaaugccgagcugcugguccuccuggaaaacgagcggacccuugacuaucaugauagcaaugugaagaaccuguacgagaaaguccgcucucagcucaagaacaaugccaaagaaaucgggaacggauguuuugaguucuaucacaagugcgacaauacauguauggaauccgugaagaacggcaccuacgauuauccuaaauacagcgaggaagcuaagcugaauagagaggagaucgacgggguuaaacuugaaucuacacggauuuaucaaauccuggccauuuacuccacgguggcgagcucccucguccuggugguuucucugggcgcuaucagcuuuuggaugugcuccaacggaucucuccagugccgcauuuguaucuga

SEQ ID NO: 186869 - RNA, 1701 nt, Artificial Sequence; identical to SEQ ID NO: 186868
  derived and/or modified sequence opt5 from hemagglutinin__InfluenzaA__ACZ96329

SEQ ID NO: 186870 - RNA, 1701 nt, Artificial Sequence
  derived and/or modified sequence opt5 from hemagglutinin__InfluenzaA__ACZ96339
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacuccuacguguucgugggcacaagcagauauucuaagaaauuuaagccugagauugccauccggccgaaaguccgcgaucaggaggggagaaugaauuacuauuggacccugguugaacccggagacaagauuacguucgaggcuacaggcaaccugguggugccucgguacgccuuugcgauggaacgcaacgccggguccggaaucauuaucagcgauacccccguccaugacugcaauacaaccugucaaaccccugagggcgcuaucaacacaucucuccccuuccagaauauucacccgaucacgauuggcaaaugcccuaaguauguuaagagcaccaaacugagacuugccacagggcugcggaacgugcccuccauccagucucgcggacucuuuggcgcuauugccggguucaucgaaggaggcuggaccgggaugguggacggaugguacggcuaucaucaccagaaugagcaaggcagcggguacgccgcugaucugaaguccacacagaacgcgaucgacgagauuaccaauaaagucaacagcgugaucaagaaaaugaauacgcaguuuacagccguuggaaaggaguucaaccaccuugagaagagaauugaaaaucugaacaaaaagguggaugacggcuuccucgauaucuggaccuacaaugcugagcugcugguccuccuggaaaacgagcggacccuugacuaucaugauucuaaugugaaaaaccuguacgagaagguccgcucccagcucaaaaacaaugccaaggaaauugggaacggauguuuugaguucuaucacaagugcgacaauacauguauggaaagcgugaaaaacggcaccuacgauuauccuaaguacucugaggaagccaaacugaauagagaggagaucgacgggguuaaacuugaauccacacggaucuaucaaauucuggcuaucuacagcacgguggccuccucucucguccuggugguuagccugggcgcgauuuccuuuuggaugugcucuaacggaagccuccagugccgcaucuguauuuga

SEQ ID NO: 186871 - RNA, 1701 nt, Artificial Sequence; identical to SEQ ID NO: 185693
  derived and/or modified sequence opt5 from hemagglutinin__InfluenzaA__ACZ96349

SEQ ID NO: 186872 - RNA, 1701 nt, Artificial Sequence; identical to SEQ ID NO: 186868
  derived and/or modified sequence opt5 from hemagglutinin__InfluenzaA__ACZ96359

SEQ ID NO: 186873 - RNA, 1701 nt, Artificial Sequence; identical to SEQ ID NO: 185693
  derived and/or modified sequence opt5 from hemagglutinin__InfluenzaA__ACZ96372

SEQ ID NO: 186874 - RNA, 1701 nt, Artificial Sequence; identical to SEQ ID NO: 186868
  derived and/or modified sequence opt5 from hemagglutinin__InfluenzaA__ACZ96382

SEQ ID NO: 186875 - RNA, 1701 nt, Artificial Sequence; identical to SEQ ID NO: 185680
  derived and/or modified sequence opt5 from hemagglutinin__InfluenzaA__ACZ96392

SEQ ID NO: 186876 - RNA, 1701 nt, Artificial Sequence; identical to SEQ ID NO: 185935
  derived and/or modified sequence opt5 from hemagglutinin__InfluenzaA__ACZ96405

SEQ ID NO: 186877 - RNA, 1701 nt, Artificial Sequence; identical to SEQ ID NO: 185693
  derived and/or modified sequence opt5 from hemagglutinin__InfluenzaA__ACZ96415

SEQ ID NO: 186878 - RNA, 1701 nt, Artificial Sequence; identical to SEQ ID NO: 185693
  derived and/or modified sequence opt5 from hemagglutinin__InfluenzaA__ACZ96425

SEQ ID NO: 186879 - RNA, 1701 nt, Artificial Sequence
  derived and/or modified sequence opt5 from hemagglutinin__InfluenzaA__ACZ96435
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcccagcuccaucugggcaaaugcaacaucgccggguggauucugggaaaucccgagugugaaucucucagcacagcuuccucuuggagcuacaucguggagaccuccucuagcgacaacggcacgugcuauccuggggauuuuauugacuacgaagaacugcgggagcaacuuuccagcgucucuuccuucgaacgcuuugagaucuucccgaagaccagcucuuggcccaaucacgauuccaacaagggagugacagccgcuuguccucaugccggcgcgaaaucuuuuuauaagaaucugaucuggcucguuaaaaagggcaacagcuaccccaaacuguccaagagcuauauuaaugacaaggggaaagaagugcuuguccuguggggaauccaccacccuuccaccucugccgaucagcagagccucuaccagaacgcugacgccuacguguucgugggcacauccagauauagcaagaaauuuaagcccgagauugcuauccggccuaaaguccgcgaucaagaggggagaaugaauuacuauuggacccugguugaaccgggagacaagauuacguucgaggccacaggcaaccugauggugccccgguacgcguuugccauggaacgcaacgcugggucuggaaucauuaucuccgauaccccugugcaugacugcaauacaaccugucagacccccaaaggcgccaucaacacaagccucccuuuccagaauauucaccccaucacgauuggcaagugcccgaaguaugucaaaucuaccaagcugagacuugcuacagggcugcggaacgugccuagcauccagucccgcggacucuuuggcgccauugccggguucaucgagggaggcuggaccgggaugguugacggaugguacggcuaucaucaccaaaaugaacagggcucuggguacgcugcggaucugaaaagcacacagaacgccaucgacgagauuaccaauaaggugaacuccgucaucgagaaaaugaauacgcaguuuacagcugugggaaaggaguucaaccaccuugagaagagaauugaaaaucugaacaaaaagguugaugacggcuuccucgauaucuggaccuacaaugccgagcugcuggugcuccuggaaaacgagcggacccuugacuaucaugauagcaaugucaaaaaccuguacgagaaggugcgcucucaacucaaaaacaaugccaaggaaauugggaacggauguuuugaguucuaucacaagugcgacaauacauguauggaauccgucaaaaacggcaccuacgauuaucccaaguacagcgaggaagcuaaacugaauagagaggagaucgacggggugaaacuugaaucuacacggaucuaucagauucuggccaucuacuccacgguugcgagcucccucgugcuggucgugucucugggcgcuauuagcuuuuggaugugcuccaacggaucucuccagugccgcaucuguauuuga

SEQ ID NO: 186880 - RNA, 1701 nt, Artificial Sequence; identical to SEQ ID NO: 185693
  derived and/or modified sequence opt5 from hemagglutinin__InfluenzaA__ACZ96445

SEQ ID NO: 186881 - RNA, 1701 nt, Artificial Sequence
  derived and/or modified sequence opt5 from hemagglutinin__InfluenzaA__ACZ96476
augaaggccauccuggugguccuccuguacaccuucgcuacagccuaugcggacacgcuuugcauuggcuaccacgcuaacaauagcaccgauacaguugacaccgugcuggagaagaacgugacagucacccauuccgugaaucuccuggaagauaagcacaacgggaaacuuuguaagcugagaggaguugcuccccuccaucugggcaaaugcaauaucgccggguggauucugggaaacccugagugugaaucucucagcacagccuccucuuggagcuauaucguggagaccuccucuagcgacaauggcacgugcuacccgggggauuuuauugacuaugaagaacugcgggagcagcuuuccagcgucucuuccuucgaacgcuuugagaucuuccccaagaccagcucuuggccuaaccacgauuccaauaagggagugacagccgcuuguccccaugccggcgcgaaaucuuuuuacaagaaccugaucuggcucguuaaaaagggcaauagcuauccuaaacuguccaagagcuacauuaacgacaaggggaaagaagugcuuguccuguggggaauccaccaccccuccaccucugccgaucaacagagccucuaccagaaugcugacgccuauguguucgugggcacauccagauacagcaagaaauuuaagccugagauugcuauccggccgaaaguccgcgaucaggaggggagaaugaacuauuacuggacccugguugaacccggagacaagauuacguucgaggccacaggcaaucugguggugccucgguaugcguuugccauggaacgcaacgcugggucuggaaucauuaucuccgauacccccguccaugacugcaacacaaccugucaaaccccuaaaggcgccaucaauacaagccuccccuuccagaacauucacccgaucacgauuggcaagugcccuaaguacgugaaaucuaccaagcugagacuugcuacagggcugcggaauguucccagcauccagucccgcggacucuuuggcgccauugccggguucaucgagggaggcuggaccgggaugguggacggaugguauggcuaccaucaccagaacgaacaaggcucuggguacgcugcggaucugaaaagcacacagaaugccaucgacgagauuaccaacaaggucaauuccgugaucgagaaaaugaacacgcaguuuacagcuguuggaaaggaguucaaucaccuugagaagagaauugaaaaccugaauaaaaagguggaugacggcuuccucgauaucuggaccuauaacgccgagcugcugguccuccuggaaaaugagcggacccuugacuaccaugauagcaacgugaaaaaucuguaugagaagguccgcucucagcucaaaaacaacgccaaggaaauugggaauggauguuuugaguucuaccacaagugcgacaacacauguauggaauccgugaaaaauggcaccuaugauuacccuaaguauagcgaggaagcuaaacugaacagagaggagaucgacgggguuaaacuugaaucuacacggaucuaccaaauucuggccaucuacuccacgguggcgagcucccucguccuggugguuucucugggcgcuauuagcuuuuggaugugcuccaauggaucucuccagugccgcaucuguauuuga

SEQ ID NO: 186882 - RNA, 1701 nt, Artificial Sequence; identical to SEQ ID NO: 185693
  derived and/or modified sequence opt5 from hemagglutinin__InfluenzaA__ACZ96496

SEQ ID NO: 186883 - RNA, 1701 nt, Artificial Sequence; identical to SEQ ID NO: 185693
  derived and/or modified sequence opt5 from hemagglutinin__InfluenzaA__ACZ96506

SEQ ID NO: 186884 - RNA, 1701 nt, Artificial Sequence; identical to SEQ ID NO: 185693
  derived and/or modified sequence opt5 from hemagglutinin__InfluenzaA__ACZ96526

SEQ ID NO: 186885 - RNA, 1701 nt, Artificial Sequence
  derived and/or modified sequence opt5 from hemagglutinin__InfluenzaA__ACZ96536
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuaagggaguugcgccccugcaucucggcaagugcaacauugccggguggauccugggaaauccugagugugaaucucugagcacagcuuccucuuggagcuacauuguggagaccuccucuagcgacaacggcacgugcuauccgggggauuuuaucgacuacgaagaacucagagagcagcuguccagcgucucuuccuucgaacgguuugagaucuuccccaagaccagcucuuggccuaaucacgauuccaacaaaggagugacagccgcuuguccccaugccggcgccaagagcuuuuauaaaaaucuuauuuggcugguuaagaaaggcaacucuuacccuaagcucuccaagagcuauaucaaugacaaagggaaggaagugcugguccuuuggggcauucaccaccccuccaccucugccgaucaacagagccuguaccagaacgcugacacauacguguucgugggauccagcaaauauucuaagaaauuuaagccugagaucgccauucgcccgaaagucagagaucaggaggggcggaugaauuacuauuggacccucguugaacccggagacaagaucacguucgaggcuacaggcaaccugguggugccucgcuacgccuuugcgauggaaagaaacgccggguccggaauuaucaucagcgauacccccguccaugacugcaauacaaccugucaaaccccuaagggcgcuauuaacacaucucugcccuuccagaauauccacccgauuacgaucggcaaaugcccuaagcaugugaaaagcaccaagcuccggcuggccacagggcuucgcaacguucccuccauucagucuagaggacuguuuggcgcuaucgccggguucaucgagggaggcuggaccgggaugguggacggaugguauggcuaccaccaccagaaugaacaaggcagcggguaugccgcugaucucaaauccacacagaacgcgauugacgagaucaccaauaaggucaacagcgugauugagaagaugaauacgcaguuuacagccguuggaaaagaguucaaccaucuggagaagcggaucgaaaaucuuaacaaaaagguggaugacggcuuccuggauauuuggaccuacaaugcugagcuccugguccugcucgaaaacgagcgcacccuggacuaccacgauucuaaugugaaaaaccuuuaugagaaggucagaucccagcugaagaacaaugccaaagaaaucgggaacggauguuuugaguucuaccauaagugcgacaauacauguauggaaagcgugaaaaacggcaccuaugauuacccuaaguauucugaggaagccaaacucaaucgggaggagaucgacgggguuaagcuggaauccacacgcauuuaccaaauccuugcuauuuauagcacgguggccuccucucugguccucgugguuagccugggcgcgaucuccuuuuggaugugcucuaacggaagccugcagugcagaauuuguaucuga

SEQ ID NO: 186886 - RNA, 1701 nt, Artificial Sequence; identical to SEQ ID NO: 185693
  derived and/or modified sequence opt5 from hemagglutinin__InfluenzaA__ACZ96549

SEQ ID NO: 186887 - RNA, 1701 nt, Artificial Sequence
  derived and/or modified sequence opt5 from hemagglutinin__InfluenzaA__ACZ96559
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaccugguggugccucgguacgcguuugccauggaacgcaaugcugggucuggaaucauuaucuccgacacccccguccaugauugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggacggaugguacggcuaucaucaccagaacgaacaaggcucuggguacgcugcggaccugaaaagcacacagaaugccaucgaugagauuaccaacaaggucaauuccgugaucgagaaaaugaacacgcaguuuacagcuguuggaaaggaguucaaucaccuugagaagagaauugaaaaccugaauaaaaagguggacgauggcuuccucgacaucuggaccuacaacgccgagcugcugguccuccuggaaaaugagcggacccuugauuaucaugacagcaacgugaaaaaccuguacgagaagguccgcucucagcucaaaaauaacgccaaggaaauugggaauggauguuuugaguucuaucacaagugcgauaacacauguauggaauccgugaaaaauggcaccuacgacuauccuaaguacagcgaggaagcuaaacugaacagagaggagaucgaugggguuaaacuugaaucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 186888 - RNA, 1701 nt, Artificial Sequence
  derived and/or modified sequence opt5 from hemagglutinin__InfluenzaA__ACZ96569
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauuaauuacgaggagcugcgggaacagcuuuccagcgucucuuccuucgagcgcuuugaaaucuuccccaaaaccagcucuuggccuaaccacgacuccaauaagggagugacagccgcuuguccccaugccggcgccaagagcuuuuauaaaaaccugaucuggcucguuaagaaaggcaauucuuacccuaagcuguccaaaagcuauauuaacgauaaggggaaggaggugcuuguccuguggggaauccaccaccccuccaccucugccgaccaacagagccucuaccagaaugcugaugccuacguguucgugggcuccagcagauauucuaaaaaguuuaaaccugagauugcuauccggccgaagguccgcgaccaggaagggagaaugaacuacuauuggacacugguugagcccggagauaaaauuaccuucgaagccacgggcaaccugguggugccucgguacgcguuugccauggagcgcaaugcuggguccggaaucauuaucagcgacacacccguccaugauugcaacaccacaugucaaaccccuaagggcgccaucaauaccucucuccccuuccacaacauucauccgaucacaauuggcaaaugcccuaaguauguuaagagcacgaaacugagacuugcuaccgggcugcggaaugugcccuccauccagucucgcggacucuuuggcgccauugccggguucaucgaaggaggcuggacagggaugguggacggaugguacggcuaucaccaccagaacgagcagggcagcggguacgcugcggaccugaaguccacccaaaaugccaucgaugagauuacaaacaaagucaauagcgugaucgaaaagaugaacacccaguuuacggcuguuggaaaagaguucaaucaucuugaaaagagaauugagaaccugaauaagaaaguggacgauggcuuccucgacaucuggacauacaacgccgaacugcugguccuccuggagaaugagcggacccuugauuaucacgacucuaacgugaagaaccuguacgaaaaaguccgcucccagcucaagaauaacgccaaagagauugggaauggauguuuugaguucuaucauaagugcgauaacaccuguauggaaagcgugaagaauggcacauacgacuauccuaaauacucugaagaggcuaagcugaacagagaggaaaucgaugggguuaaacuugaguccacccggaucuaucagauucuggccaucuacagcacaguggcguccucucucguccuggugguuagccugggcgcuauuuccuuuuggaugugcucuaauggaagccuccaaugccgcaucuguauuuga

SEQ ID NO: 186889 - RNA, 1701 nt, Artificial Sequence
  derived and/or modified sequence opt5 from hemagglutinin__InfluenzaA__ACZ96579
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaagcuguguaaacugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccucuagcgccgaucaacagucccucuaccagaacgcugacgccuacguguucgugggcagcucuagauauuccaaaaaguuuaaaccugagauugcuauccggccgaagguccgcgaucaggaagggagaaugaauuacuauuggacccugguugagcccggagacaaaauuacauucgaagccaccggcaaccugguggugccucgguacgcguuugccauggagcgcaacgcugggagcggaaucauuaucucugauacgcccguccaugacugcaauacaaccugucaaacaccuaagggcgccaucaacaccagccuccccuuccacaauauucauccgaucaccauuggcaaaugcccuaaguaugugaaguccacaaaacugagacuugcuacggggcugcggaacguucccucuauccagagccgcggacucuuuggcgccauugccggguucaucgaaggaggcuggaccgggaugguggacggaugguacggcuaucaccaccagaaugagcagggcuccggguacgcugcggaucuuaagagcacacaaaacgccaucgacgagauuaccaauaaagucaacucugugaucgaaaagaugaauacacaguuuaccgcuguuggaaaagaguucaaccaucuugaaaagagaauugagaaucugaacaagaaaguggaugacggcuuccucgauaucuggacguacaaugccgaacugcugguccuccuggagaacgagcggacacuugacuaucacgauuccaaugugaagaaccuguacgaaaaaguccgcagccagcucaagaacaaugccaaagagauugggaacggauguuuugaguucuaucauaagugcgacaauaccuguauggaaucugugaagaacggcaccuacgauuauccuaaauacuccgaagaggcuaagcugaauagagaggaaaucgacgggguuaaacuugagagcacacggaucuaucagauucuggccaucuacuccaccguggcgucuagccucguccuggugguuucccugggcgcuauuucuuuuuggaugugcagcaacggaucccuccaaugccgcaucuguauuuga

SEQ ID NO: 186890 - RNA, 1701 nt, Artificial Sequence; identical to SEQ ID NO: 185693
  derived and/or modified sequence opt5 from hemagglutinin__InfluenzaA__ACZ96589

SEQ ID NO: 186891 - RNA, 1701 nt, Artificial Sequence
  derived and/or modified sequence opt5 from hemagglutinin__InfluenzaA__ACZ96599
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugguggugccucgguacgcguuugccauggagcgcaacaccgggucuggaaucauuaucuccgacacacccguccaugauugcaauaccaccugucaaacaccuaaaggcgcuaucaacacgagccuccccuuccagaauauucacucuaucaccauuggcaagugcccgaaguaugugaaaagcacaaagcugagacuugccaccgggcugcggaacguuccuuccauccagucucgcggacucuuuggcgcuauugccggguucaucgaaggaggcuggacagggaugguggacggaugguacggcuaucaucaccagaaugagcaaggcagcggguacgccgcugaccugaaauccacccagaacgcgaucgaugagauuacgaauaaggucaacagcgugaucgaaaagaugaauacacaguuuaccgccguuggaaaggaguucaaccaccuugaaaagagaauugagaaucugaacaaaaagguggacgauggcuuccucgacaucuggaccuacaaugcugaacugcugguccuccuggagaacgagcggacacuugauuaucaugacucuaaugugaaaaaccuguacgaaaagguccgcucccagcucaaaaacaaugccaaggagauugggaacggauguuuugaguucuaucacaagugcgauaauaccuguauggagagcgugaaaaacggcacauacgacuaucccaaguacucugaagaggccaaacugaauagagaggaaaucgaugggguuaaacuugaguccacgcggaucuaucaaauucuggcuaucuacagcaccguggccuccucucucguccuggugguuagccugggcgcgauuuccuuuuggaugugcucuaacggaagccuccagugccgcaucuguauuuga

SEQ ID NO: 186892 - RNA, 1701 nt, Artificial Sequence
  derived and/or modified sequence opt5 from hemagglutinin__InfluenzaA__ACZ96609
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcuccagcagauauucuaagaaauuuaagccugagauugcuauccggccgaaaguccgcgaccaggaggggagaaugaacuacuauuggacacugguugaacccggagauaagauuaccuucgaggccacgggcaaccugguggugccucgguacgcguuugccauggaacgcaaugcuggguccggaaucauuaucagcgacacacccguccaugauugcaacaccacaugucaaaccccuaaaggcgccaucaauaccucucuccccuuccagaacauucacccgaucacaauuggcacgugcccuaaguauguuaagagcaccaaacugagacuugcuacagggcugcggaaugugcccuccauccagucucgcggacucuuuggcgccauugccggguucaucgagggaggcuggaccgggaugguggacggaugguacggcuaucaucaccagaacgaacaaggcagcggguacgcugcggaccugaaguccacacagaaugccaucgaugagauuaccaacaaagucaauagcgugaucgagaagaugaacacgcaguuuacagcuguuggaaaagaguucaaucaccuugagaagagaauugaaaaccugaauaagaaaguggacgauggcuuccucgacaucuggaccuacaacgccgagcugcugguccuccuggaaaaugagcggacccuugauuaucaugacucuaacgugaagaaccuguacgagaaaguccgcucccagcucaagaauaacgccaaagaaauugggaauggauguuuugaguucuaucacaagugcgauaacacauguauggaaagcgugaagaauggcaccuacgacuauccuaaauacucugaggaagcuaagcugaacagagaggagaucgaugggguuaaacuugaauccacacggaucuaucaaauucuggccaucuacagcacgguggcguccucucucguccuggugguuagccugggcgcuauuuccuuuuggaugugcucuaauggaagccuccagugccgcaucuguauuuga

SEQ ID NO: 186893 - RNA, 1701 nt, Artificial Sequence; identical to SEQ ID NO: 185873
  derived and/or modified sequence opt5 from hemagglutinin__InfluenzaA__ACZ96619

SEQ ID NO: 186894 - RNA, 1701 nt, Artificial Sequence; identical to SEQ ID NO: 185873
  derived and/or modified sequence opt5 from hemagglutinin__InfluenzaA__ACZ96629

SEQ ID NO: 186895 - RNA, 1701 nt, Artificial Sequence; identical to SEQ ID NO: 185873
  derived and/or modified sequence opt5 from hemagglutinin__InfluenzaA__ACZ96639

SEQ ID NO: 186896 - RNA, 1701 nt, Artificial Sequence; identical to SEQ ID NO: 185873
  derived and/or modified sequence opt5 from hemagglutinin__InfluenzaA__ACZ96649

SEQ ID NO: 186897 - RNA, 1701 nt, Artificial Sequence; identical to SEQ ID NO: 185873
  derived and/or modified sequence opt5 from hemagglutinin__InfluenzaA__ACZ96659

SEQ ID NO: 186898 - RNA, 1701 nt, Artificial Sequence; identical to SEQ ID NO: 185873
  derived and/or modified sequence opt5 from hemagglutinin__InfluenzaA__ACZ96669

SEQ ID NO: 186899 - RNA, 1701 nt, Artificial Sequence; identical to SEQ ID NO: 185873
  derived and/or modified sequence opt5 from hemagglutinin__InfluenzaA__ACZ96679

SEQ ID NO: 186900 - RNA, 1701 nt, Artificial Sequence; identical to SEQ ID NO: 185873
  derived and/or modified sequence opt5 from hemagglutinin__InfluenzaA__ACZ96689

SEQ ID NO: 186901 - RNA, 1701 nt, Artificial Sequence; identical to SEQ ID NO: 185873
  derived and/or modified sequence opt5 from hemagglutinin__InfluenzaA__ACZ96699

SEQ ID NO: 186902 - RNA, 1701 nt, Artificial Sequence; identical to SEQ ID NO: 185873
  derived and/or modified sequence opt5 from hemagglutinin__InfluenzaA__ACZ96719

SEQ ID NO: 186903 - RNA, 1701 nt, Artificial Sequence; identical to SEQ ID NO: 185873
  derived and/or modified sequence opt5 from hemagglutinin__InfluenzaA__ACZ96729

SEQ ID NO: 186904 - RNA, 1701 nt, Artificial Sequence; identical to SEQ ID NO: 185873
  derived and/or modified sequence opt5 from hemagglutinin__InfluenzaA__ACZ96739

SEQ ID NO: 186905 - RNA, 1701 nt, Artificial Sequence
  derived and/or modified sequence opt5 from hemagglutinin__InfluenzaA__ACZ96749
augaagaccauccuggugguccuccuguacacauucgccacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcuccagcagauauucuaagaaauuuaagccugagauugccauccggccgaaaguccgcgaucaggaggggagaaugaauuacuauuggacccugguugaacccggagacaagauuacguucgaggcuacaggcaaccugguggugccucgguacgccuuugcgauggaacgcaacgccggguccggaaucauuaucagcgauacccccguccaugacugcaauacaaccugucaaaccccuaaaggcgcuaucaacacaucucuccccuuccagaauauucacccgaucacgauuggcaagugcccuaaguaugugaaaagcaccaagcugagacuugccacagggcugcggaacguucccuccauccagucucgcggacucuuuggcgcuauugccggguucaucgagggaggcuggaccgggaugguggacggaugguacggcuaucaucaccagaaugaacaaggcagcggguacgccgcugaucugaaauccacacagaacgcgaucgacgagauuaccaauaaggucaacagcgugaucgagaaaaugaauacgcaguuuacagccguuggaaaggaguucaaccaccuugagaagagaauugaaaaucugaacaaaaagguggaugacggcuuccucgauaucuggaccuacaaugcugagcugcugguccuccuggaaaacgagcggacccuugacuaucaugauucuaaugugaaaaaccuguacgagaagguccgcucccagcucaaaaacaaugccaaggaaauugggaacggauguuuugaguucuaucacaagugcgacaauacauguauggaaagcgugaaaaacggcaccuacgauuauccuaaguacucugaggaagccaaacugaauagagaggagaucgacgggguuaaacuugaauccacacggaucuaucaaauucuggcuaucuacagcacgguggccuccucucucguccuggugguuagccugggcgcgauuuccuuuuggaugugcucuaacggaagccuccagugccgcaucuguauuuga

SEQ ID NO: 186906 - RNA, 1701 nt, Artificial Sequence; identical to SEQ ID NO: 185680
  derived and/or modified sequence opt5 from hemagglutinin__InfluenzaA__ACZ96759

SEQ ID NO: 186907 - RNA, 1701 nt, Artificial Sequence; identical to SEQ ID NO: 185680
  derived and/or modified sequence opt5 from hemagglutinin__InfluenzaA__ACZ96769

SEQ ID NO: 186908 - RNA, 1701 nt, Artificial Sequence; identical to SEQ ID NO: 185680
  derived and/or modified sequence opt5 from hemagglutinin__InfluenzaA__ACZ96779

SEQ ID NO: 186909 - RNA, 1701 nt, Artificial Sequence; identical to SEQ ID NO: 185680
  derived and/or modified sequence opt5 from hemagglutinin__InfluenzaA__ACZ96789

SEQ ID NO: 186910 - RNA, 1701 nt, Artificial Sequence
  derived and/or modified sequence opt5 from hemagglutinin__InfluenzaA__ACZ96809
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccaacgccgaucaacagucucucuaccagaaugcugacgccuacguguucgugggcacaagcagauauuccaagaaauuuaagccugagauugcuauccggccgaaaguccgcgaucaggaggggagaaugaacuacuauuggacccugguugaacccggagacaagauuacguucgaggccacaggcaaccugguggugccucgguacgcguuugccauggaacgcaaugcugggagcggaaucauuaucucugauacccccguccaugacugcaacacaaccugucaaaccccuaaaggcgccaucaauacaucccuccccuuccagaacauucacccgaucacgauuggcaagugcccuaaguaugugaaaagcaccaagcugagacuugcuacagggcugcggaauguucccucuauccagagccgcggacucuuuggcgccauugccggguucaucgagggaggcuggaccgggaugguggacggaugguacggcuaucaucaccagaacgaacaaggcuccggguacgcugcggaucugaaaucuacacagaaugccaucgacgagauuaccaacaaggucaauagcgugaucgagaaaaugaacacgcaguuugcugccguuggaaaggaguucaaucaccuugagaagagaauugaaaaccugaauaaaaagguggaugacggcuuccucgauaucuggacauacaacgccgagcugcugguccuccuggaaaaugagcggacccuugacuaucaugauuccaacgugaaaaaccuguacgagaagguccgcagccagcucaaaaauaacgcuaaggaaauugggaauggauguuuugaguucuaucacaagugcgacaacaccuguauggaaucugugaaaaauggcacauacgauuauccuaaguacuccgaggaagccaaacugaacagagaggagaucgacgggguuaaacuugaaagcacccggaucuaucaaauucuggcgaucuacucuacaguggcuuccagccucguccuggugguuucccugggcgccauuucuuuuuggaugugcagcaauggaucccuccagugccgcaucuguauuuga

SEQ ID NO: 186911 - RNA, 1701 nt, Artificial Sequence; identical to SEQ ID NO: 185680
  derived and/or modified sequence opt5 from hemagglutinin__InfluenzaA__ACZ96819

SEQ ID NO: 186912 - RNA, 1701 nt, Artificial Sequence; identical to SEQ ID NO: 185680
  derived and/or modified sequence opt5 from hemagglutinin__InfluenzaA__ACZ96829

SEQ ID NO: 186913 - RNA, 1701 nt, Artificial Sequence; identical to SEQ ID NO: 185680
  derived and/or modified sequence opt5 from hemagglutinin__InfluenzaA__ACZ96839

SEQ ID NO: 186914 - RNA, 1701 nt, Artificial Sequence; identical to SEQ ID NO: 186833
  derived and/or modified sequence opt5 from hemagglutinin__InfluenzaA__ACZ96849

SEQ ID NO: 186915 - RNA, 1701 nt, Artificial Sequence; identical to SEQ ID NO: 185693
  derived and/or modified sequence opt5 from hemagglutinin__InfluenzaA__ACZ96859

SEQ ID NO: 186916 - RNA, 1701 nt, Artificial Sequence; identical to SEQ ID NO: 185680
  derived and/or modified sequence opt5 from hemagglutinin__InfluenzaA__ACZ96869

SEQ ID NO: 186917 - RNA, 1701 nt, Artificial Sequence; identical to SEQ ID NO: 185680
  derived and/or modified sequence opt5 from hemagglutinin__InfluenzaA__ACZ96879

SEQ ID NO: 186918 - RNA, 1701 nt, Artificial Sequence
  derived and/or modified sequence opt5 from hemagglutinin__InfluenzaA__ACZ96899
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccacuccucuaccagcgccgaucaacagucccucuaccagaacgcugacgccuacguguucgugggcagcucuagauauuccaagaaauuuaagcccgagauugcuauccggccuaaaguccgcgaucaggaggggagaaugaauuacuauuggacacugguugaaccgggagacaagauuaccuucgaggccacgggcaaccugguggugccccgguacgcguuugccauggaacgcaacgcugggagcggaaucauuaucucugauacaccuguccaugacugcaauaccacaugucaaacccccaaaggcgccaucaacaccagccucccuuuccagaauauucaccccaucacaauuggcaagugcccgaaguaugugaaauccacgaagcugagacuugcuaccgggcugcggaacguuccuucuauccagagccgcggacucuuuggcgccauugccggguucaucgagggaggcuggacagggaugguggacggaugguacggcuaucaucaccagaaugaacaaggcuccggguacgcugcggaucugaaaagcacccagaacgccaucgacgagauuacaaauaaggucaacucugugaucgagaaaaugaauacccaguuuacggcuguuggaaaggaguucaaccaccuugagaagagaauugaaaaucugaacaaaaagguggaugacggcuuccucgauaucuggacauacaaugccgagcugcugguccuccuggaaaacgagcggacccuugacuaucaugauuccaaugugaaaaaccuguacgagaagguccgcagccagcucaaaaacaaugccaaggaaauugggaacggauguuuugaguucuaucacaagugcgacaauaccuguauggaaucugugaaaaacggcacauacgauuaucccaaguacuccgaggaagcuaaacugaauagagaggagaucgacgggguuaaacuugaaagcacccggaucuaucaaauucuggccaucuacuccacaguggcgucuagccucguccuggugguuucccugggcgcuauuucuuuuuggaugugcagcaacggaucccuccagugccgcaucuguauuuga

SEQ ID NO: 186919 - RNA, 1701 nt, Artificial Sequence; identical to SEQ ID NO: 185680
  derived and/or modified sequence opt5 from hemagglutinin__InfluenzaA__ACZ96909

SEQ ID NO: 186920 - RNA, 1701 nt, Artificial Sequence; identical to SEQ ID NO: 185680
  derived and/or modified sequence opt5 from hemagglutinin__InfluenzaA__ACZ96919

SEQ ID NO: 186921 - RNA, 1701 nt, Artificial Sequence; identical to SEQ ID NO: 185680
  derived and/or modified sequence opt5 from hemagglutinin__InfluenzaA__ACZ96929

SEQ ID NO: 186922 - RNA, 1701 nt, Artificial Sequence; identical to SEQ ID NO: 185680
  derived and/or modified sequence opt5 from hemagglutinin__InfluenzaA__ACZ96939

SEQ ID NO: 186923 - RNA, 1701 nt, Artificial Sequence
  derived and/or modified sequence opt5 from hemagglutinin__InfluenzaA__ACZ96949
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucuccccuuccagaauauucacccgaucacaauuggcaagugcccuaaguaugugaaaagcacgaagcugagacuugcuaccgggcugcggaacguucccuccauccagucucgcggacucuuuggcgccauugccggguucaucgagggaggcuggacagggaugguggacggaugguacggcuaucaucaccagaaugaacaaggcagcggguacgcugcggaucugaaauccacccagaacgccaucgacgagauuacaaauaaggucaacagcgugaucgagaaaaugaauacccaguuuacggcuguuggaaaggaguucaaccaccuugagaagagaauugaaaaucugaacaaaaagguggaugacggcuuccucgauaucuggacauacaaugccgagaugcugguccugcucgaaaacgagcggacccuggacuaucaugauucuaaugugaaaaaccuuuacgagaagguccgcucccagcugaaaaacaaugccaaggaaauugggaacggauguuuugaguucuaucacaagugcgacaauaccuguauggaaagcgugaaaaacggcacauacgauuauccuaaguacucugaggaagcuaaacucaauagagaggagaucgacgggguuaagcuggaauccacccggaucuaucaaauucuugccaucuacagcacaguggcguccucucugguccucgugguuagccugggcgcuauuuccuuuuggaugugcucuaacggaagccugcagugccgcaucuguauuuga

SEQ ID NO: 186924 - RNA, 1701 nt, Artificial Sequence; identical to SEQ ID NO: 185680
  derived and/or modified sequence opt5 from hemagglutinin__InfluenzaA__ACZ97021

SEQ ID NO: 186925 - RNA, 1701 nt, Artificial Sequence; identical to SEQ ID NO: 186047
  derived and/or modified sequence opt5 from hemagglutinin__InfluenzaA__ACZ97343

SEQ ID NO: 186926 - RNA, 1701 nt, Artificial Sequence; identical to SEQ ID NO: 186047
  derived and/or modified sequence opt5 from hemagglutinin__InfluenzaA__ACZ97353

SEQ ID NO: 186927 - RNA, 1701 nt, Artificial Sequence; identical to SEQ ID NO: 185680
  derived and/or modified sequence opt5 from hemagglutinin__InfluenzaA__ACZ97363

SEQ ID NO: 186928 - RNA, 1701 nt, Artificial Sequence
  derived and/or modified sequence opt5 from hemagglutinin__InfluenzaA__ACZ97383
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccacgucugacaacgggaccugcuauccgggcgauuuuauugacuacgaagaacugcgggagcagcuuagcuccgucagcucuuucgaacgcuuugagaucuuccccaagacauccagcuggccuaaucacgauucuaacaagggagugaccgccgcuuguccccaugccggcgcgaaauccuuuuauaagaaucugaucuggcucguuaaaaagggcaacagcuacccuaaacugucuaaguccuauauuaaugacaaggggaaagaagugcuuguccuguggggaauccaccaccccagcacauccgccgaucaacagucucucuaccagaacgcugacgccuacguguucgugggcagcuccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 186929 - RNA, 1701 nt, Artificial Sequence; identical to SEQ ID NO: 185680
  derived and/or modified sequence opt5 from hemagglutinin__InfluenzaA__ACZ97393

SEQ ID NO: 186930 - RNA, 1701 nt, Artificial Sequence
  derived and/or modified sequence opt5 from hemagglutinin__InfluenzaA__ACZ98178
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacuacgggaaacuuuguaagcugagaggaguugcuccccuccaucugggcaaaugcaauaucgccggguggauucugggaaacccugagugugaaucucucagcacagccuccucuuggagcuauaucguggagaccuccucuagcgacaauggcacgugcuacccgggggauuuuauugacuaugaagaacugcgggagcagcuuuccagcgucucuuccuucgaacgcuuugagaucuuccccaagaccagcucuuggccuaaccacgauuccaauaagggagugacaaccgccuguccccaugcuggcgccaagagcuuuuacaagaaccugaucuggcucguuaaaaagggcaauucuuauccuaaacuguccaagagcuacauuaacgacaaggggaaagaagugcuuguccuguggggaauccaccaccccuccacaucugcggaucaacagagccucuaccagaaugccgacgcuuauguguucgugggcaccuccagauacagcaagaaauuuaagccugagauugccauccggccgaaaguccgcgaucaggaggggagaaugaacuauuacuggacgcugguugaacccggagacaagauuacauucgaggcuaccggcaaucugguggugccucgguaugccuuugcgauggaacgcaacgccgggucuggaaucauuaucuccgauacacccguccaugacugcaacaccaccugucaaacaccuaaaggcgcuaucaauacgagccuccccuuccagaacauucacccgaucaccauuggcaagugcccuaaguacgugaaaucuacaaagcugagacuugccaccgggcugcggaauguucccagcauccagucccgcggacucuuuggcgcuauugccggguucaucgagggaggcuggacagggaugguggacggaugguauggcuaccaucaccagaacgaacaaggcucuggguacgccgcugaucugaaaagcacccagaaugcgaucgacgagauuacgaacaaggucaauuccgugaucgagaaaaugaacacacaguuuaccgccguuggaaaggaguucaaucaccuugagaagagaauugaaaaccugaauaaaaagguggaugacggcuuccucgauaucuggaccuauaacgcugagcugcugguccuccuggaaaaugagcggacacuugacuaccaugauagcaacgugaaaaaucuguaugagaagguccgcucucagcucaaaaacaacgccaaggaaauugggaauggauguuuugaguucuaccacaagugcgacaacaccuguauggaauccgugaaaaauggcacauaugauuacccuaaguauagcgaggaagccaaacugaacagagaggagaucgacgggguuaaacuugaaucuacgcggaucuaccaaauucuggcuaucuacuccaccguggccagcucccucguccuggugguuucucugggcgcgauuagcuuuuggaugugcuccaauggaucucuccagugccgcaucuguauuuga

SEQ ID NO: 186931 - RNA, 1701 nt, Artificial Sequence; identical to SEQ ID NO: 185680
  derived and/or modified sequence opt5 from hemagglutinin__InfluenzaA__ACZ98188

SEQ ID NO: 186932 - RNA, 1701 nt, Artificial Sequence; identical to SEQ ID NO: 185873
  derived and/or modified sequence opt5 from hemagglutinin__InfluenzaA__ACZ98198

SEQ ID NO: 186933 - RNA, 1701 nt, Artificial Sequence; identical to SEQ ID NO: 185693
  derived and/or modified sequence opt5 from hemagglutinin__InfluenzaA__ACZ98208

SEQ ID NO: 186934 - RNA, 1701 nt, Artificial Sequence; identical to SEQ ID NO: 185693
  derived and/or modified sequence opt5 from hemagglutinin__InfluenzaA__ACZ98218

SEQ ID NO: 186935 - RNA, 1701 nt, Artificial Sequence; identical to SEQ ID NO: 185693
  derived and/or modified sequence opt5 from hemagglutinin__InfluenzaA__ACZ98228

SEQ ID NO: 186936 - RNA, 1701 nt, Artificial Sequence; identical to SEQ ID NO: 185693
  derived and/or modified sequence opt5 from hemagglutinin__InfluenzaA__ACZ98238

SEQ ID NO: 186937 - RNA, 1701 nt, Artificial Sequence; identical to SEQ ID NO: 186322
  derived and/or modified sequence opt5 from hemagglutinin__InfluenzaA__ACZ98248

SEQ ID NO: 186938 - RNA, 1701 nt, Artificial Sequence; identical to SEQ ID NO: 185693
  derived and/or modified sequence opt5 from hemagglutinin__InfluenzaA__ACZ98258

SEQ ID NO: 186939 - RNA, 1701 nt, Artificial Sequence; identical to SEQ ID NO: 185693
  derived and/or modified sequence opt5 from hemagglutinin__InfluenzaA__ACZ98268

SEQ ID NO: 186940 - RNA, 1701 nt, Artificial Sequence; identical to SEQ ID NO: 186833
  derived and/or modified sequence opt5 from hemagglutinin__InfluenzaA__ACZ98278

SEQ ID NO: 186941 - RNA, 1701 nt, Artificial Sequence; identical to SEQ ID NO: 186833
  derived and/or modified sequence opt5 from hemagglutinin__InfluenzaA__ACZ98288

SEQ ID NO: 186942 - RNA, 1701 nt, Artificial Sequence
  derived and/or modified sequence opt5 from hemagglutinin__InfluenzaA__ACZ98298
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaaaugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgggagcagcuuuccagcgucucuuccuucgaaaaguuugagaucuuccccaagaccagcucuuggccuaaucacgauuccaacaaaggagugacagccgcuuguccccaugccggcgccaagagcuuuuauaaaaaucugaucuggcucguuaagaaaggcaacucuuacccuaagcuguccaagagcuauauuaaugacaaagggaaggaagugcuuguccuguggggaauccaccaccccuccaccucugccgaucaacagagccucuaccagaacgcugacgccuacguguucgugggcuccagccgcuauucuaaaaaguuuaaaccugagauugcuaucagaccgaagguccgggaucaggaggggcgcaugaauuacuauuggacacugguugaacccggagacaaaauuaccuucgaggccacgggcaaccugguggugccuagauacgcguuugccauggaacggaacgcuggguccggaaucauuaucagcgauacacccguccaugacugcaauaccacaugucaaaccccuaagggcgccaucaacaccucucuccccuuccagaauauucacccgaucacaauuggcaagugcccuaaauauguuaagagcacgaaacugcgccuugcuaccgggcugagaaacgugcccuccauccagucucggggacucuuuggcgccauugccggguucaucgagggaggcuggacagggaugguggacggaugguacggcuaucaucaccagaaugaacaaggcagcggguacgcugcggaucugaaguccacccagaacgccaucgacggaauuacaaauaaagucaacagcgugaucgagaagaugaauacccaguuuacggcuguuggcaaggaguucaaccaccuugaaaaacgcauugagaaucugaacaagaaaguggaugacggguuccucgauaucuggacauacaaugccgaacugcugguccuccuggagaacgaaagaacccuugacuaucaugauucuaaugugaagaaccuguacgagaaaguccggucccagcucaagaacaaugccaaggagauuggaaacggcuguuuugaguucuaucacaaaugcgacaauaccuguauggagagcgugaagaacgggacauacgauuauccuaaauacucugaagaggcuaagcugaaucgcgaagagaucgacggcguuaaacuugaguccaccagaaucuaucaaauucuggccaucuacagcacaguggcguccucucucguccuggugguuagccugggagcuauuuccuuuuggaugugcucuaacggcagccuccagugccggaucuguauuuga

SEQ ID NO: 186943 - RNA, 1701 nt, Artificial Sequence
  derived and/or modified sequence opt5 from hemagglutinin__InfluenzaA__ACZ98318
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggaucuaucauauucuggccaucuacuccacgguggcgagcucccucguccuggugguuucucugggcgcuauuagcuuuuggaugugcuccaacggaucucuccaaugccgcaucuguauuuga

SEQ ID NO: 186944 - RNA, 1701 nt, Artificial Sequence; identical to SEQ ID NO: 185935
  derived and/or modified sequence opt5 from hemagglutinin__InfluenzaA__ACZ98328

SEQ ID NO: 186945 - RNA, 1701 nt, Artificial Sequence; identical to SEQ ID NO: 185693
  derived and/or modified sequence opt5 from hemagglutinin__InfluenzaA__ACZ98338

SEQ ID NO: 186946 - RNA, 1701 nt, Artificial Sequence; identical to SEQ ID NO: 186833
  derived and/or modified sequence opt5 from hemagglutinin__InfluenzaA__ACZ98348

SEQ ID NO: 186947 - RNA, 1701 nt, Artificial Sequence; identical to SEQ ID NO: 185693
  derived and/or modified sequence opt5 from hemagglutinin__InfluenzaA__ACZ98358

SEQ ID NO: 186948 - RNA, 1701 nt, Artificial Sequence; identical to SEQ ID NO: 185693
  derived and/or modified sequence opt5 from hemagglutinin__InfluenzaA__ACZ98368

SEQ ID NO: 186949 - RNA, 1701 nt, Artificial Sequence; identical to SEQ ID NO: 185935
  derived and/or modified sequence opt5 from hemagglutinin__InfluenzaA__ACZ98388

SEQ ID NO: 186950 - RNA, 1701 nt, Artificial Sequence; identical to SEQ ID NO: 185693
  derived and/or modified sequence opt5 from hemagglutinin__InfluenzaA__ACZ98398

SEQ ID NO: 186951 - RNA, 1701 nt, Artificial Sequence; identical to SEQ ID NO: 185693
  derived and/or modified sequence opt5 from hemagglutinin__InfluenzaA__ACZ98408

SEQ ID NO: 186952 - RNA, 1701 nt, Artificial Sequence; identical to SEQ ID NO: 185873
  derived and/or modified sequence opt5 from hemagglutinin__InfluenzaA__ACZ98418

SEQ ID NO: 186953 - RNA, 1701 nt, Artificial Sequence; identical to SEQ ID NO: 185693
  derived and/or modified sequence opt5 from hemagglutinin__InfluenzaA__ACZ98428

SEQ ID NO: 186954 - RNA, 1701 nt, Artificial Sequence; identical to SEQ ID NO: 185693
  derived and/or modified sequence opt5 from hemagglutinin__InfluenzaA__ACZ98438

SEQ ID NO: 186955 - RNA, 1701 nt, Artificial Sequence; identical to SEQ ID NO: 185693
  derived and/or modified sequence opt5 from hemagglutinin__InfluenzaA__ACZ98448

SEQ ID NO: 186956 - RNA, 1701 nt, Artificial Sequence; identical to SEQ ID NO: 186833
  derived and/or modified sequence opt5 from hemagglutinin__InfluenzaA__ACZ98458

SEQ ID NO: 186957 - RNA, 1701 nt, Artificial Sequence
  derived and/or modified sequence opt5 from hemagglutinin__InfluenzaA__ACZ98546
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcagauauuccaagaaauuuaagccggagauugcuauccggcccaaaguccgcgaucaggaggggagaaugaauuacuauuggacccugguugaaccuggagacaagauuacguucgaggccacaggcaaccugguggugccccgguacgcguuugccauggaacgcaacgcugggagcggaaucauuaucucugauaccccuguccaugacugcaauacaaccugucaaacccccaaaggcgccaucaacacaucccucccguuccagaauauucacccuaucacgauuggcaagugccccaaguaugugaaaagcaccaagcugagacuuacaaccgggcugcggaacguuccuucuauccaguaccgcggacucuuuggcgcuauuacaggguucaucgagggaggcuggaccgggaugguggacggaugguauggcuaccaucaccagaaugaacaaggcagcggguacgccgccgaucugaaauccacgcagaacgcuaucgacgagauuacaaauaaggucaacucugugaucgagaaaaugaauacccaguuuaccgcgguuggaaaggaguucaaccaccuugagaagagaauugaaaaucugaacaaaaagguggaugacggcuuccucgauaucuggacauauaaugccgagcugcugguccuccuggaaaacgagcggacccuugacuaccaugauagcaaugugaaaaaccuguaugagaagguccgcucccagcucaaaaacaaugcuaaggaaauugggaacggauguuuugaguucuaccacaagugcgacaauacauguauggaaagcgugaaaaacggcacguaugauuaccccaaguauucugaggaagccaaacugaauagagaggagaucgacgggguuaaacuugaauccacccggaucuaccaaauucuggccaucuacagcacaguggcuucuucccucguccuggugguuagccugggcgccauuuccuuuuggaugugcucuaacggaagccuccagugccgcaucuguauuuga

SEQ ID NO: 186958 - RNA, 1701 nt, Artificial Sequence
  derived and/or modified sequence opt5 from hemagglutinin__InfluenzaA__ACZ98560
augaaggccaucagagugguccugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuucggggaguugcuccccugcaucucggcaagugcaacaucgccggguggauucugggaaauccugagugugaaucucugagcacagccuccucuuggagcuacaucguggagaccuccucuagcgacaacggcacgugcuauccgggggauuuuauugacuacgaagaacuccgcgagcagcuguccagcgucucuuccuucgaaagauuugagaucuuccccaagaccagcucuuggccuaaucacgaucccaacaagggagugacagccgcuuguccucaugccggcgcgaaauccuuuuauaagaaucuuaucuggcugguuaaaaagggcaacagcuaccccaaacucucuaaguccuauauuaaugacaaggggaaagaagugcugguccuuuggggaauccaccacccuagcaccuccgccgaucaacagucucuguaccagaacgcugacgccuacguguucgugggcacaagccgguauuccaagaaauuuaagccggagauugcuauccgccccaaagucagagaucaggaggggcggaugaauuacuauuggacccucguugaaccuggagacaagauuacguucgaggccacaggcaaccugguggugccccgcuacgcguuugccauggaaagaaacgcugggagcggaaucauuaucucugauaccccuguccaugacugcaauacaaccugucaaacccccaaaggcgccaucaacacaucccugccguuccagaauauucacccuaucacgauuggcaagugccccaaguaugugaaaagcccuaagcuccggcuggcuaccgggaugcgcaacguucccuuuauccaguacagaggacuuuucggcgccauuacaggguuuaucgagggaggcuggaccgggaugguggacggaugguauggcuaccaucaccagaaugaacaaggcucuggguacgccgcugaucugaaaagcacacagaacgcgaucgacgagauuaccaauaaggucaacuccgugaucgagaaaaugaauacgcaguucacagccguuggaaaggaguucaaccaccucgagaagcggauugaaaaucugaacaaaaagguggaugacggcuuucuugauaucuggaccuauaaugcugagcugcucguccugcuggaaaacgagcgcacccucgacuaccaugauucuaaugugaaaaaccuguaugagaaggucagaagccagcuuaaaaacaaugccaaggaaauugggaacggauguuucgaguuuuaccacaagugcgacaauacauguauggaauccgugaaaaacggcaccuaugauuaccccaaguauagcgaggaagccaaacugaaucgggaggagaucgacgggguuaagcucgaaucuacacgcaucuaccaaauucuggcuaucuacuccacgguggccagcucucuuguccuggugguuucccucggcgcgauuagcuucuggaugugcuccaacggaucucugcagugcagaaucuguauuuga

SEQ ID NO: 186959 - RNA, 1701 nt, Artificial Sequence
  derived and/or modified sequence opt5 from hemagglutinin__InfluenzaA__ACZ98567
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcagauauuccaagaaauuuaagccggagauugcuauccggcccaaaguccgcgaucaggaggggagaaugaauuacuauuggacccugguugaaccuggagacaagauuacguucgaggccacaggcaaccugguggugccccgguacgcguuugccauggaacgcaacgcugggagcggaaucauuaucucugauaccccuguccaugacugcaauacaaccugucaaacccccaaaggcgccaucaacacaucccucccguuccagaauauucacccuaucacgauuggcaagugccccaaguaugugaaaagcccuaagcugagacuugcuucugggaugcggaacguucccuuuauccagagccgcggacuguucggcgccauuaccggguuuaucgaggaaggauggacaggcaugguggacgggugguacggauuccaucaccagaaugagcaaggcuccggcuaugccgcugaucucaaaucuacccagaacgcgaucgacgagauuacaaauaaggucaacagcgugaucgagaaaaugaauacccaguucacggccguugggaaggaguuuaaccaccuggaaaagagaauugagaaucuuaacaaaaagguggaugacggauuccuggauaucuggacauacaaugcugaacuccugguccugcucgagaacgagcggacccuggacuaccaugauuccaaugugaaaaaccuuuaugaaaagguccgcagccagcugaaaaacaaugccaaggagauuggcaacggguguuuugaguucuaccacaagugcgacaauaccuguauggaaucugugaaaaacggaacauaugauuaccccaaguauuccgaagaggccaaacucaauagagaggaaaucgacggcguuaagcuggagagcacccggaucuaccaaauucuugcuaucuauucuacaguggccuccagccugguccucgugguuucccugggggcgauuucuuuuuggaugugcagcaacggcucccugcagugccgcaucuguauuuga

SEQ ID NO: 186960 - RNA, 1701 nt, Artificial Sequence; identical to SEQ ID NO: 185680
  derived and/or modified sequence opt5 from hemagglutinin__InfluenzaA__ACZ98671

SEQ ID NO: 186961 - RNA, 1701 nt, Artificial Sequence; identical to SEQ ID NO: 185680
  derived and/or modified sequence opt5 from hemagglutinin__InfluenzaA__ACZ98681

SEQ ID NO: 186962 - RNA, 1701 nt, Artificial Sequence; identical to SEQ ID NO: 185693
  derived and/or modified sequence opt5 from hemagglutinin__InfluenzaA__ACZ98691

SEQ ID NO: 186963 - RNA, 1701 nt, Artificial Sequence
  derived and/or modified sequence opt5 from hemagglutinin__InfluenzaA__ADA60799
augaaggccauccuggugguccuccuguacaccuucgcuacagccaacgcggacacgcuuugcauuggcuaucacgcuaauaacagcaccgauacaguugacaccgugcuggagagaaaugugacagucacccauuccgugaaccuccuggaagauaaacacaaugggaagcuguguaaacugcggggaguugcgccccuccaucugggcaagugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgcgagcagcuuuccagcgucucuuccuucgaaagauuugagaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaagugcuuguccuguggggaauccaccaccccuccaccucugccgaucaacagagccucuaccagaacgcugacgccuacguguucgugggcacaucccgguauagcaaaaaguuuaaaccugagauugcuauccgcccgaaggucagagaucaggaggggcggaugaauuacuauuggacccugguugaacccggagacaaaauuacguucgaggccacaggcaaccugguggugccucgcuacgcguuugccauggaaagaaacgcugggucuggaaucauuaucuccgauacccccguccaugacugcaauacaaccugucaaaccccuaagggcgccaucaacacaagccuccccuuccagaauauucacccgaucacgauuggcaaaugcccuaaguaugugaagucuaccaaacugcggcuugcuacagggcugcgcaacauccccagcauucaguccagaggacucuuuggcgccaucgccggguucaucgagggaggcuggaccgggaugguugacggaugguacggcuaucaucaccagaaugaacaaggcucuggguacgcugcggaucuuaagagcacacagaacgccauugacgagaucaccaauaaagugaacuccgucauugagaagaugaauacgcaguuuacagcugugggaaaagaguucaaccaccuugagaagcggaucgaaaaucugaacaagaaaguugaugacggcuuccucgauauuuggaccuacaaugccgagcugcuggugcuccuggaaaacgagcgcacccuugacuaucaugauagcaaugucaagaaccuguacgagaaagugagaucucagcucaagaacaaugccaaagaaaucgggaacggauguuuugaguucuaucacaagugcgacaauacauguauggaauccgucaagaacggcaccuacgauuauccuaaauacagcgaggaagcuaagcugaaucgggaggagaucgacggggugaaacuugaaucuacacgcauuuaucaaauccuggccauuuacuccacgguugcgagcucccucgugcuggucgugucucugggcgcuaucagcuuuuggaugugcuccaacggaucucuccagugcagaauuuguaucuga

SEQ ID NO: 186964 - RNA, 1701 nt, Artificial Sequence; identical to SEQ ID NO: 186857
  derived and/or modified sequence opt5 from hemagglutinin__InfluenzaA__ADA69302

SEQ ID NO: 186965 - RNA, 1701 nt, Artificial Sequence; identical to SEQ ID NO: 186857
  derived and/or modified sequence opt5 from hemagglutinin__InfluenzaA__ADA69312

SEQ ID NO: 186966 - RNA, 1701 nt, Artificial Sequence; identical to SEQ ID NO: 186857
  derived and/or modified sequence opt5 from hemagglutinin__InfluenzaA__ADA69322

SEQ ID NO: 186967 - RNA, 1701 nt, Artificial Sequence; identical to SEQ ID NO: 186857
  derived and/or modified sequence opt5 from hemagglutinin__InfluenzaA__ADA69332

SEQ ID NO: 186968 - RNA, 1701 nt, Artificial Sequence; identical to SEQ ID NO: 186794
  derived and/or modified sequence opt5 from hemagglutinin__InfluenzaA__ADA70329

SEQ ID NO: 186969 - RNA, 1698 nt, Artificial Sequence
  derived and/or modified sequence opt5 from hemagglutinin__InfluenzaA__ADA71150
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucucguugaaaacucucacaaugggaaacugugccuucugaagggaaucgcgccccuccagcugggcaacuguagcguggcuggguggauucugggaaauccugagugcgaacuccugaucuccaaagagucuuggagcuacauugucgaaaagccgaaccccgagaauggcaccuguuauccugggcauuuugccgauuacgaggaacuuagagagcaacuguccucugugagcuccuucgaacgguuugagaucuuccccaaggagagcucuuggccuaaccacacgguuaccggaguguccgccagcugcucucauaauggcgaauccagcuuuuaucgcaaccuccuguggcuuacaggcaaaaaugggcuguaccccaaccucucuaaguccuaugcuaauaacaaagagaaggaaguccuggugcuguggggagugcaccacccuccgagcaucuccaaccagaaaacccucuaccauacagagaaugccuacgucucuguugugagcucccacuauagcagaaaguucacccccgaaauugcuaagcggccuaaagugcgcgaccaggagggcagaaucaacuacuauuggacgcugcuugagcccggggauacaauuaucuuugaagccaauggaaaccugauugcgccucgguacgccuucgcucucucucgcggcuuuggguccggaaucauuaauagcaacgcccccauggacaagugugaugcuaaaugccagaccccgcaaggcgccaucaauucuagccugccuuuccagaacguccaucccgugacaaucggcgaguguccuaaguauguuagauccgcgaaacuucggauggugaccgggcugcgcaauauucccucuauccagagcagaggacucuuuggcgccauugcuggguucaucgaaggaggcuggaccgggauggucgacggaugguacggcuaucaccaccagaacgagcaaggcuccggguacgccgcugaucagaagucuacacagaaugccauuaacggaaucacgaaaaaggugaauagcguuaucgaaaagaugaacacccaguuuacagccgugggcaaagaguucaauaagcuggagcggcgcauggaaaaccugaacaaaaaggucgacgauggguucauugacaucuggaccuacaaugcugagcuccuggugcuucuggaaaacgagagaacacucgauuuucaugacuccaaugucaaaaaccuguaugaaaagguuaagagccaacuuaaaaauaacgcgaaggagauuggaaauggcugcuucgaguuuuaccacaaauguaacgacgaaugcauggagucugugaagaaugggaccuaugauuaccccaaauauuccgaagagagcaagcugaaccgggagaagaucgacggcgugaaacucgaauccaugggagucuaccagauucuggccaucuauucuacgguggcuagcucccugguucuccuggugucucuuggcgccaucagcuucuggaugugcuccaaugggagccugcagugucgcauuugcaucuga

SEQ ID NO: 186970 - RNA, 1701 nt, Artificial Sequence
  derived and/or modified sequence opt5 from hemagglutinin__InfluenzaA__ADA71152
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggggaaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggagugcaccauccugggacggauaaugaccagaucuuucucuaugcgcaagccucuggccgcauuacaguuuccaccaagagaagccagcagacagugaucccgaacauugggucccggccccgcgucagaaauaucccuucucggaucagcauuuacuggaccaucgugaaacccggagauauucugcugaucaacuccaccggcaaucucauugcuccucgcggguacuucaagaucagaagcggaaaaucuuccaucaugcggagcgacgcccccauuggcaaguguaacucugagugcaucacaccgaauggcagcauuccuaacgacaagcccuuucagaaugugaaccgcaucacguauggggcuuguccuagauacgucaaacaaaauacccugaaacuugccacaggaaugcggaacguucccgaaaaacagacccgcggcauuuucggggcgaucgccggauuuaucgagaauggcugggaagggaugguggauggaugguauggcuucagacaccagaacuccgagggccgggggcaagcugccgaccugaagucuacacaggcugccauugaucagaucaauggaaaacucaacagacugauuggcaagaccaacgagaaauuccaccagaucgaaaaggaguuuagcgaaguggaggggcgcauucaagaccuugaaaaguacgucgaggauacgaaaaucgaccugugguccuauaaugccgagcuccugguggcucuggaaaaccagcauacaauugaucucaccgacagcgagaugaauaagcuguucgaaaagaccaagaaacagcuucgggagaacgcggaagauaugggaaauggcugcuuuaagaucuaccacaagugugacaacgccugcaucgggucuauuagaaauggcacauaugaucaugacguuuaccgcgacgaggcucugaacaaucgguuccagaucaaaggaguggagcucaaguccggcuacaaagauuggauucuguggaucagcuuugccauuucuugcuuccuucugugugucgcccuccugggguuuaucaugugggcuugccaaaagggaaacaucagauguaauauuugcaucuga

SEQ ID NO: 186971 - RNA, 1698 nt, Artificial Sequence
  derived and/or modified sequence opt5 from hemagglutinin__InfluenzaA__ADA71154
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauuccgagugcgaacugcuuaucucuaaagagagcugguccuacauuguggaaaagccuaacccggagaauggcaccuguuauuuugggcauuucgccgauuacgaggaacugagagagcaauuuggaucugucagcuccuucgaacgguuugagaucuuccccaaggagagcucuuggccuaaccacacggugaccggcguuuccgccagcugcucucauaauggcgaauccagcuuuuaucgcaaccuccuguggcuuacagggaaaaauggacuguaccccaaccucucuaaguccuaugcuaauaacaaagagaaggaagugcugguccuguggggcgugcaccacccucccagcaucaacgaccagaaaacccucuaccauacagagaaugccuacguguccgucguuucuagccacuauuccagaaaguucaccccugaaauugcuaagcggccgaaagugcgcgaucaggaggggagaaucaacuacuauuggacgcugcuugagccccgggacacaauuaucuuugaagccaauggaaaccugauugcgccucgcuacgccuucgcucucagcagaggcuuugggucuggaaucauuaauuccaacgcccccauggauaagugugacgcuaaaugccagaccccucaaggcgccaucaauagcucucugcccuuccagaacgugcauccggucacaaucggcgaguguccuaaguaugugcggagcgcgaaacuucgcaugguuaccgggcugagaaauauucccuccauccagucucggggacucuuuggcgccauugcuggguucaucgaaggaggcuggaccgggaugguggauggaugguacggcuaucaccaccagaacgagcaaggcagcggguacgccgcugaccagaaguccacacagaaugccauuaacggaaucacgaauaaagucaacagcgugaucgaaaagaugaauacccaguucacagccguuggcaaggaguuuaacaaacuggagcgcagaauggaaaaccugaauaagaaaguggaugacggguucauugauaucuggaccuacaacgcugagcuccugguccuucuggaaaaugagcggacacucgacuuucaugacucuaacgugaagaaucuguaugaaaaagucaagucccaacuuaagaacaaugcgaaagagauuggaaacggcugcuucgaguuuuaccacaaguguaaugaugaaugcauggagagcgugaaaaacgggaccuaugacuacccuaaguauucugaagaguccaaacugaaucgcgagaagaucgauggcguuaagcucgaaagcaugggaguguaccagauucuggccaucuauuccacggucgcuucuagccuggugcuccugguuucccuuggcgccaucucuuucuggaugugcagcaacgggucccugcaguguagaauuugcaucuga

SEQ ID NO: 186972 - RNA, 1698 nt, Artificial Sequence
  derived and/or modified sequence opt5 from hemagglutinin__InfluenzaA__ADA71158
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagaccuggucuuacauuguggaaaagccgaaccccgagaauggcacguguuauccugggcauuuugccgauuacgaggaacugagagagcaacucagcuccgucucuagcuucgaacgguuugagaucuuccccaaggaguccagcuggccuaaccacaccgugacaggaguuucugccuccugcagccauaauggcgaaucuuccuuuuaucgcaaccugcuuuggcugaccggcaaaaaugggcucuaccccaaccugagcaagucuuaugcuaauaacaaagagaaggaagugcugguccucuggggagugcaccacccuccguccaucaacgaccagagaacacuguaccauaccgagaaugccuacgugagcgucguuuccucucacuauagccggaaauucacgcccgaaauugcuaagcgcccuaaggugagagaucaggagggccggaucaacuacuauuggacacuucuggagccccgcgacaccauuaucuuugaagccaaugggaaccucauugcgccuagauacgccuucgcucugucccggggauuuggcagcgggaucauuaauucuaacgcccccauggauaaaugugacgcuaagugccagacaccgcaaggagccaucaauuccagccuuccuuuccagaacgugcaucccgucaccaucggcgaguguccuaaauaugugcgcucugcgaagcugagaaugguuaccggccuccggaauacacccagcauucagucccgcgggcuguuuggagccaucgcuggcuucauugaagggggauggacgggcaugguggaugggugguacggauaucaccaccagaacgagcaaggcucuggcuacgccgcugaccagaaaagcacccagaaugccaucaacgggauuacaaauaaggucaacuccgugaucgaaaagaugaauacccaguuuacagccguuggaaaagaguucaacaagcuggagagccucauggauauccugaacaaaaagguggacgauggcuucauugacaucuggaccuacaaugcugaacuucugguccuccuggagaacgaaagaacgcuugacuuucaugauucuaaugugaaaaaccuguaugagaaggucaaaucccaacucaagaauaacgcgaaggaaauugggaauggaugcuucgaguuuuaccacaaauguaacgacgagugcauggaaagcgugaagaauggcacauaugauuaccccaaauauucugaggaauccaagcugaaccgggagaaaaucgacgggguuaagcuggagagcaugggcguguaccagauucucgccaucuauuccaccgucgcuucuagccuggugcuucugguuucccucggagccaucucuuucuggaugugcagcaauggcucccugcagugucgcauuugcaucuga

SEQ ID NO: 186973 - RNA, 1701 nt, Artificial Sequence; identical to SEQ ID NO: 185458
  derived and/or modified sequence opt5 from hemagglutinin__InfluenzaA__ADA71162

SEQ ID NO: 186974 - RNA, 1698 nt, Artificial Sequence
  derived and/or modified sequence opt5 from hemagglutinin__InfluenzaA__ADA71164
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuguguccaaagagucuuggagcuacaucgucgaaaagccgaaccccgagaauggcaccuguuauccugggcauuuugccgauuacgaggaacugagagagcaacucuccucugugagcuccuucgaacgguuugagauuuuccccaaggagagcucuuggccuaaccacacgguuaccggagccuccgcuagcugcucucauaauggcgaaaacuccuuuuaucgcaaucugcuuuggcugacaggcaaaaacgggcucuaccccaaucugagcaagucuuaugccaacaacaaagagaaggaagugcugguccucuggggagugcaccacccuccguccaucgcugaccagaaaacccuguaccauacagagaaugccuacgugagcgucguuuccucucacuauagcagaaaguucacccccgaaaucgcgaagcggccuaaagugcgcgaucaggagggccggauucauuacuauuggacgcuucuggagcccggggacacaaucauuuuugaagccaacggaaaucucaucgcuccuagauacgccuucgcucugucccgcggcuuugggagcggaauuaucaacucuaaugcccccauggauaagugugacgcgaccugccagacaccgcaaggcgccauuaacuccagccuuccuuuccagaaugugcaccccgucaccaucggcgaguguccuaaauaugugagaucugcuaagcugcggaugguuaccgggcuccgcaacauccccagcauucaguccagaggacuguuuggcgccaucgcuggguucauugaaggaggcuggacagggaugguggauggaugguacggcuaucaccaucagaaugagcaaggcucuggguacgccgccgaccagaaaagcacgcagaacgcuaucaauggaauuaccaacaaggucaauuccgugaucgaaaagaugaacacacaguuuaccgcgguuggcaaagaguucaauaagcuggagcggcgcauggaaaaccucaacaaaaagguggaugacggguucaucgauauuuggacauacaaugccgagcugcuuguccugcucgaaaacgagagaacccuggacuuucacgacagcaaugugaaaaaccuuuaugaaaaggucaucucucaacugaaaauuaaugcuaaggaucucggauacggcugcuucgaguuuuaucauaaguguaacgacgagugcauggaauccgugaaaaaugggacguacgauuaucccaaguacagcgaggaaucuaaacugaaccgggagaagaucgacggcguuaaacuggaguccaugggaguguaucagauucucgccaucuacagcacagucgccuccucucuggugcuucugguuagccucggcgcuaucuccuucuggaugugcucuaaugggagccugcagugucgcauuugcaucuga

SEQ ID NO: 186975 - RNA, 1698 nt, Artificial Sequence
  derived and/or modified sequence opt5 from hemagglutinin__InfluenzaA__ADA71168
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauaaccacaaugggaaacuuugccugcucaagggaaaagcgccccugcagcugggcaacuguucuguugcuggguggauccucggaaauccugagugcggccugcuuauuagcaaggaauccuggucuuacaucguggagagaccgaaccccgaaaaugggaccuguuauccuggacauuuugccgacuacgaggagcugcgggaacaacucagcuccgucucuagcuucgagcgcuuugaaauuuuccccaaggaguccagcuggccuaaccacacggugaccggcguuucugccuccugcagccauaauggcgagucuuccuuuuauaaaaaccugcuuuggcugacagggaagaauggacucuaccccaaccugagcaaaucuuaugcuaauaacaaggaaaaagaggugcugguccucuggggcgugcaccacccuccgaacaucggggugcagaugacccuguaccauaaggaaaaugccuacgucuccguugugagcucccacuauucuagaaaguucacacccgagaucgugaaacggccuaagguccgcgaucaggaaggaagaauuaacuacuauuggacccuucuggagcccggcgacacgaucauuuuugaggcuaaugggaaccucaucgccccucgguacgcguucgcccugagccgcggauuuggcuccggcauuaucaauagcaacgcucccauggaugaaugugacgccaaaugccagacaccgcaaggggcuauuaauucuucccuuccuuuccagaacgugcaucccguuaccaucggagaguguccuaaguaugugagaagcgccaaacugcggauggucacaggccuccgcaauauccccucuauucagagcagagggcuguuuggagcgaucgccggcuucauugaagggggauggaccggcaugguggauggcugguacggguaucaccaccagaacgagcaaggauccggcuacgcugccgaccagaagucuacccagaaugcuaucaacgggauuacaaauaaaguuaacagcgugaucgaaaagaugaauacgcaguuuaccgccgucggaaaggaguucaacaaacuggagcggcgcauggaaaaccucaauaagaaaguggaugacggcuucaucgauauuuggacauacaacgccgagcugcuuguccugcucgaaaaugagagaacccuggacuuucaugacuccaacgugaagaaucuuuaugaaaaaguuaagagccaacugaagaacaaugcuaaagagaucgggaacggcugcuucgaguuuuaccacaaguguaaugaugaaugcauggagucugugaaaaacggaacauaugacuaccccaaguauuccgaagagagcaaacucaaucgggagaagauugauggcgucaagcuggaaucuauggggguguaccagauccuggcgauuuauuccaccguugccagcucccucgugcugcuugucucucugggagcuaucagcuucuggaugugcuccaacggcucucuccagugucgcaucugcauuuga

SEQ ID NO: 186976 - RNA, 1698 nt, Artificial Sequence
  derived and/or modified sequence opt5 from hemagglutinin__InfluenzaA__ADA71170
augaaggugaaacugcucguccugcuuugcaccuucacagccacguacgcugacaccaucuguauuggcuaucacgccaacaauagcacagauaccguugacacagugcuggagaagaacgggaccgugacacccuccggaaaucucgucgaaaacucuccuaauggcaaacugugccuucugaaggggaucaccccgcuccagcugggaaaauguagcguggcgggcuggauucuggggaaccccaagugggagcuccugguuuccaaggaaucuuggagcuacaucggaaagaagccuaaucccgagaacggcacgugcuauccuggccauuuucccuacuaugaggagcuuagagagcaacuguccucugugagcuccuucgaacgguuugagauuuucccuaaagaaagcucuuggccgaaucacaccgucacaggggcuuccgccagcuguucucauaacggagaaaauuccuuuuaccgcaaccuccuguggcuuaccggcaagaaugggcuguaucccaaccucagcaaaucuuacgccaauaacaaggagaaggaagugcugguucuguggggagugcaccauccucccaacaucgcugaucagaaaacacucuaccacaccgagaaugccuaugucuccguggugagcucccacuacucuagaaaguucacgccugaaaucgcuaaacggcccaagguccgcgaccaggagggcagaauuaacuauuacuggacacugcuugaaccgggggauaccaucauuuuugaggccaauggaaaccugaucgcgccucgguaugccuucgcucucagccgcggcuuuggcuccgggauuaucaauagcaacgcccccauggacaaaugcgaugcuaagugucagacaccucaaggagccauuaauucuucccugcccuuccagaacguucaucccgugaccaucggcgagugcccuaaauacgugagaagcgcgaaacuucggauggucaccgggcugcgcaauaucccgucuauucagagcagaggacucuuuggcgccaucgcuggguucauugaaggaggcuggacaggcaugguggacgggugguauggauaccaccaucagaacgagcaaggcuccggguacgccgcugaucagaagucuacgcagaaugccaucaacggaauuaccaauaaaguuaacagcgugaucgaaaagaugaauacacaguuuaccgccgucggcaaagaguucaacaagcuggaacggcgcauggagaaccugaauaaaaagguggacgauggguucaucgacauuuggacauauaacgcugagcuccugguucuucuggaaaaugagagaacccucgauuuucacgacuccaacgugaagaaucuguacgaaaaagucaagagccaacuuaaaaacaaugcgaaggagaucggcaacggauguuucgaauuuuaucacaaaugcaaugacgaguguauggagucugugaagaacggcacguacgauuaucccaaguacuccgaagagagcaaacugaaucgggaaaagauugacggggucaaacucgagucuaugggaguguaucagauccuggccauuuacuccacaguugcuagcucccuggugcuccuggucucucuuggcgccaucagcuucuggaugugcuccaacgggucucugcagugccgcaucuguauuuga

SEQ ID NO: 186977 - RNA, 1701 nt, Artificial Sequence
  derived and/or modified sequence opt5 from hemagglutinin__InfluenzaA__ADA71172
augaagaccaucauugcccugagcuacauccucugccugguguucacacagaaacuucccggcaacgacaauuccacggcuacccugugucucgggcaccaugccgucccuaacggaacaauuguuaagaccaucacaaaugaucaaauugaggugaccaacgcgacagaacuggugcagucuagcuccaccggcgagaucugcgacucuccgcaccagauccuugauggggaaaauuguacgcugauugacgcucuccugggagauccccagugcgacggcuuucaaaacaaaaagugggaucuguucgucgagagaagcaaagccuauuccaauuguuacccuuaugacgugcccgauuacgccucucuccggagccugguugcuuccagcgggacccuugaauuuaacaaugagucuuucaacuggacaggagugacccagaauggcacauccagcgccugcauccgcagaucuaacaauuccuuuuucagccggcugaacuggcucacccaucugaaguuuaaguauccugcucuuaaugucacgaugcccaacaacgagcaguucgacaaacuguacauuuggggcgugcaccauccugggacagauaaugaccagaucuuucucuaugcccaagcgucuggacgcauuaccguuuccacaaagagaagccagcagaccgugaucccgaacauuggcucccggccccgcgucagaaauaucccuucucggaucagcauuuacuggaccaucgugaaacccggggauauucugcugaucaacuccacaggaaaucucauugccccucgcggcuacuucaagaucagaagcgggaaaucuuccaucaugcggagcgacgcucccauuggaaaguguaacucugaaugcaucacgccgaauggcagcauuccuaacgacaagcccuuucagaaugugaaccgcaucaccuauggcgccuguccuagauacgucaaacaaaauacacugaaacuugcuaccgggaugcggaacguucccgagaagcagacacgcggaauuuucggcgccaucgcgggguuuaucgaaaauggaugggagggcaugguggaugggugguauggauucagacaccagaacuccgagggccggggccaagccgcugaccugaagucuacccaggccgcuauugaucagaucaaugggaaacucaacagacugauuggaaagacgaacgaaaaauuccaccagaucgagaaggaauuuagcgagguggaaggccgcauucaagaccuugagaaguacgucgaggauacaaaaaucgaccugugguccuauaaugccgaacuccugguggcccuggagaaccagcauaccauugaucucaccgacagcgaaaugaauaagcuguucgagaaaacaaagaaacagcuucgggaaaacgcugaggauauggggaauggaugcuuuaagaucuaccacaagugugacaacgcgugcaucggcucuauuagaaaugggaccuaugaucaugacguuuaccgcgacgaggcccugaacaaucgguuccagaucaaaggcguggaacucaaguccggauacaaagauuggauucuguggaucagcuuugcuauuucuugcuuccuucugugugucgcccuccugggcuuuaucaugugggccugccaaaaggggaacaucagauguaauauuugcaucuga

SEQ ID NO: 186978 - RNA, 1698 nt, Artificial Sequence
  derived and/or modified sequence opt5 from hemagglutinin__InfluenzaA__ADA71176
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggagccuccgcuagcugcucucauaauggcgaaaacuccuuuuaucgcaaucugcuuuggcugacaggcaaaaacgggcucuaccccaaucugagcaagucuuaugccaacaacaaagagaaggaaguucuggugcucuggggaguccaccacccuccgaauaucgcuaaccagaaaacccuguaccauacagagaaugccuacguguccguggucagcucccacuauucuagaaaguucacccccgaaauugcgaagcggccuaaaguucgcgaccaggagggcagaaucaacuacuauuggacgcuucuggagcccggggauacaauuaucuuugaagccaauggaaaccucauugcuccucgguacgccuucgcucugagccgcggcuuuggguccggaaucauuaauagcaacgcccccauggacaagugugaugcgaccugccagacaccgcaaggcgccaucaauucuucccuuccuuuccagaacgugcaucccgugaccaucggcgaguguccuaaauaugucagaagcgcuaagcugcggauggugaccgggcuccgcaauauucccucuauccagagcagaggacuguuuggcgccauugcuggguucaucgaaggaggcuggacagggaugguugacggaugguacggcuaucaccaccagaacgagcaaggcuccggguacgccgccgaucagaaaucuacgcagaaugcuauuaacggaaucaccaauaaggugaacagcgucaucgaaaagaugaacacacaguuuaccgcggugggcaaagaguucaauaagcuggagcggcgcauggaaaaccucaauaaaaagguugacgauggguucauugacaucuggacauacaacgccgagcugcuugugcugcucgaaaaugagagaacccuggauuuucaugacuccaacgucaaaaaucuuuaugaaaaggugaaaagccaacugaagaacaaugcuaaggagauuggaaacggcugcuucgaguuuuaccacaaauguaaugacgaaugcauggagucugucaagaacgggacguaugauuaccccaaauauuccgaagagagcaagcucaaucgggagaaaaucgacggcgugaagcuggaaucuaugggaguuuaccagauucuggccaucuauuccacaguggccagcucccucguccugcuugugucucugggcgcuaucagcuucuggaugugcuccaacgggucucuccagugucgcauuugcaucuga

SEQ ID NO: 186979 - RNA, 1701 nt, Artificial Sequence; identical to SEQ ID NO: 186794
  derived and/or modified sequence opt5 from hemagglutinin__InfluenzaA__ADA71181

SEQ ID NO: 186980 - RNA, 1701 nt, Artificial Sequence; identical to SEQ ID NO: 186794
  derived and/or modified sequence opt5 from hemagglutinin__InfluenzaA__ADA71191

SEQ ID NO: 186981 - RNA, 1701 nt, Artificial Sequence
  derived and/or modified sequence opt5 from hemagglutinin__InfluenzaA__ADA79587
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccaacuccuggucuuacaucguggagaccagcuccucugacaauggcacgugcuauccgggggauuuuauugacuacgaagaacugcgggagcagcuuagcuccgucagcucuuucgaacgcuuugagaucuuccccaagaccuccagcuggccuaaccacgauucuaauaagggagugacagccgcuuguccccaugccggcgcgaaauccuuuuauaagaaccugaucuggcucguuaaaaagggcaauagcuacccuaaacugucuaaguccuauauuaacgacaaggggaaagaagugcuuguccuguggggaauccaccaccccagcaccuccgccgaucaacagucucucuaccagaaugcugacgccuacguguucgugggcacaagcagauauuccaagaaauuuaagccugagauugcuauccggccgaaaguccgcgaucaggaggggagaaugaacuacuauuggacccugguugaacccggagacaagauuacguucgaggccacaggcaaccugguggugccucgguacgcguuugccauggaacgcaaugcugggagcggaaucauuaucucugauacccccguccaugacugcaacacaaccugucaaaccccuaaaggcgccaucaauacaucccuccccuuccagaacauucacccgaucacgauuggcaagugcccuaaguaugugaaaagcaccaagcugagacuugcuacagggcugcggaauauccccucuauucagagccgcggacucuuuggcgccaucgccggguucaucgagggaggcuggaccgggaugguugacggaugguacggcuaucaucaccagaacgaacaaggcuccggguacgcugcggaucugaaaucuacacagaaugccauugacgagaucaccaacaaggugaauagcgucauugagaaaaugaacacgcaguuuacagcugugggaaaggaguucaaucaccuugagaagagaaucgaaaaccugaauaaaaagguugaugacggcuuccucgauauuuggaccuacaacgccgagcugcuggugcuccuggaaaaugagcggacccuugacuaucaugauuccaacgucaaaaaccuguacgagaaggugcgcagccagcucaaaaauaacgccaaggaaaucgggaauggauguuuugaguucuaucacaagugcgacaacacauguauggaaucugucaaaaauggcaccuacgauuauccuaaguacuccgaggaagcuaaacugaacagagaggagaucgacggggugaaacuugaaagcacacggauuuaucaaauccuggccauuuacucuacgguugcguccagccucgugcuggucgugucccugggcgcuaucucuuuuuggaugugcagcaauggaucccuccagugccgcauuuguaucuga

SEQ ID NO: 186982 - RNA, 1701 nt, Artificial Sequence
  derived and/or modified sequence opt5 from hemagglutinin__InfluenzaA__ADA79607
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuaaguccuauauuaaugacaagggaaaagaagugcuuguccuguggggcauccaccaccccagcaccuccgccgaucaacagucucucuaccagaacgcugacgccuacguguucguggggacaagcagauauuccaagaaauuuaagccugagauugcuauccggccgaaaguccgcgaucaggagggaagaaugaauuacuauuggacccugguugaacccggcgacaagauuacguucgaggccacagggaaccugguggugccucgguacgcguuugccauggaacgcaacgcuggaagcggcaucauuaucucugauacccccguccaugacugcaauacaaccugucaaaccccuaaaggcgccaucaacacaucccuccccuuccagaauauucacccgaucacgauugggaagugcccuaaguaugugaaaagcaccaagcugagacuugcuacaggacugcggaacguucccucuauccagagccgcggccucuuuggggccauugccggauucaucgagggcggguggaccggaaugguggacggcugguacggcuaucaucaccagaaugaacaaggguccggauacgcugcggaucugaaaucuacacagaacgccaucgacgagauuaccaauaaggucaacagcgugaucgagaaaaugaauacgcaguuuacagcuguuggcaaggaguucaaccaccuugagaagagaauugaaaaucugaacaaaaagguggaugacggguuccucgauaucuggaccuacaaugccgagcugcugguccuccuggaaaacgagcggacccuugacuaucaugauuccaaugugaaaaaccuguacgagaagguccgcagccagcucaaaaacaaugccaaggaaauuggaaacggcuguuuugaguucuaucacaagugcgacaauacauguauggaaucugugaaaaacgggaccuacgauuauccuaaguacuccgaggaagcuaaacugaauagagaggagaucgacggcguuaaacuugaaagcacacggaucuaucaaauucuggccaucuacucuacgguggcguccagccucguccuggugguuucccugggagcuauuucuuuuuggaugugcagcaacggcucccuccagugccgcaucuguauuuga

SEQ ID NO: 186983 - RNA, 1701 nt, Artificial Sequence
  derived and/or modified sequence opt5 from hemagglutinin__InfluenzaA__ADA83043
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagagagaagggcggaugaauuacuauuggacccugguugagcccggagauaagauuacguucgaagccacaggcaaccugguggugccucgcuacgcguuugccauggagagaaacgcugggucuggaaucauuaucuccgacacccccguccaugauugcaauacaaccugucagaccccuaaaggcgccaucaacacaagccuccccuuccaaaauauucacccgaucacgauuggcaagugcccuaaguaugugaaaucuaccaagcugcggcuugcuacagggcugcgcaacguucccagcauccaguccagaggacucuuuggcgccauugccggguucaucgaaggaggcuggaccgggaugguggacggaugguacggcuaucaucaccagaaugagcagggcucuggguacgcugcggaccugaaaagcacacaaaacgccaucgaugagauuaccaauaaggucaacuccgugaucgaaaagaugaauacgcaguuuacagcuguuggaaaggaguucaaccaccuugaaaagcggauugagaaucugaacaaaaagguggacgauggcuuccucgacaucuggaccuacaaugccgaacugcugguccuccuggagaacgagcgcacccuugauuaucaugacagcaaugugaaaaaccuguacgaaaaggucagaucucagcucaaaaacaaugccaaggagauugggaacggauguuuugaguucuaucacaagugcgauaauacauguauggaguccgugaaaaacggcaccuacgacuauccuaaguacagcgaagaggcuaaacugaaucgggaggaaaucgaugggguuaaacuugagucuacacgcaucuaucagauucuggccaucuacuccacgguggcgagcucccucguccuggugguuucucugggcgcuauuagcuuuuggaugugcuccaacggaucucuccaaugcagaaucuguauuuga

SEQ ID NO: 186984 - RNA, 1701 nt, Artificial Sequence
  derived and/or modified sequence opt5 from hemagglutinin__InfluenzaA__ADA83044
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcaacaauggcacgugcuauccgggggacuuuauugauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaaggaaaauagcuacccuaaacugaacaaguccuauauuaaugauaagggcaaagaggugcuuguccugugggggauccaccaccccagcaccuccgccgaccaacagucucucuaccagaacgcugaugccuacguguucgugggaacaagcagauauuccaagaaauuuaagccugagauugcuauccggccgaaaguccgcggccaggaagggagaaugaacuacuauuggacccugguugagcccggagacaagauuacguucgaagccacaggcaaucugguggugccucgguacgcguuugccauggagcgcaacgcugggagcggaaucauuaucucugauacccccguccaugacugcaauacaaccugucaaaccccuaaaggcgccaucaacacaucccuccccuuccagaauauucacccgaucacgauuggcaagugcccuaaguaugugaaaagcaccaagcugagacuugcuacagggcugcggaacguucccucuauccagagccgcggacucuuuggcgccauugccggguucaucgaaggaggcuggaccgggaugguggauggaugguacggcuaucaucaccagaaugagcaaggcuccggguacgcugcggaccugaaaucuacacagaacgccaucgacgagauuaccaauaaggucaacagcgugaucgaaaagaugaauacgcaguuuacagcuguuggaaaggaguucaaccaccuugaaaagagaauugagaaucugaacaaaaagguggaugacggcuuccucgauaucuggaccuacaaugccgaacugcugguccuccuggagaacgagcggacccuugacuaucaugauuccgacgugaaaaaccuguacgaaaagguccgcagccagcucaaaaauaacgccaaggagauugggaauggauguuuugaguucuaucacaagugcgauaacacauguauggagucugugaaaaauggcaccuacgacuauccuaaguacuccgaagaggcuaaacugaacagagaggaaaucgaugggguuaaacuugagagcacacggaucuaucaaauucuggccaucuacucuacgguggcguccagccucguccuggugguuucccugggcgcuauuucuuuuuggaugugcagcaauggaucccuccagugccgcaucuguauuuga

SEQ ID NO: 186985 - RNA, 1701 nt, Artificial Sequence; identical to SEQ ID NO: 185693
  derived and/or modified sequence opt5 from hemagglutinin__InfluenzaA__ADA83580

SEQ ID NO: 186986 - RNA, 1701 nt, Artificial Sequence; identical to SEQ ID NO: 185693
  derived and/or modified sequence opt5 from hemagglutinin__InfluenzaA__ADA83587

SEQ ID NO: 186987 - RNA, 1701 nt, Artificial Sequence
  derived and/or modified sequence opt5 from hemagglutinin__InfluenzaA__ADA83591
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauuucuauccggccgaaaguccgcgaucaggaggggagaaugaauuacuauuggacccugguugaacccggagacaagauuacguucgaggcuacaggcaaccugguggugccucgguacgccuuugcgauggaacgcaacgccggguccggaaucauuaucagcgauacccccguccaugacugcaauacaaccugucaaaccccuaaaggcgcuaucaacacaucucuccccuuccagaauauucacccgaucacgauuggcaagugcccuaaguaugugaaaagcaccaagcugagacuugccacagggcugcggaacguucccuccauccagucucgcggacucuuuggcgcuauugccggguucaucgagggaggcuggaccgggaugguggacggaugguacggcuaucaucaccagaaugaacaaggcagcggguacgccgcugaucugaaauccacacagaacgcgaucgacgagauuaccaauaaggucaacagcgugaucgagaaaaugaauacgcaguuuacagccguuggaaaggaguucaaccaccuugagaagagaauugaaaaucugaacaaaaagguggaugacggcuuccucgauaucuggaccuacaaugcugagcugcugguccuccuggaaaacgagcggacccuugacuaucaugauucuaaugugaaaaaccuguacgagaagguccgcucccagcucaaaaacaaugccaaggaaauugggaacggauguuuugaguucuaucacaagugcgacaauacauguauggaaagcgugaaaaacggcaccuacgauuauccuaaguacucugaggaagccaaacugaauagagaggagaucgacgggguuaaacuugaauccacacggaucuaucaaauucuggcuaucuacagcacgguggccuccucucucguccuggugguuagccugggcgcgauuuccuuuuggaugugcucuaacggaagccuccagugccgcaucuguauuuga

SEQ ID NO: 186988 - RNA, 1701 nt, Artificial Sequence; identical to SEQ ID NO: 186438
  derived and/or modified sequence opt5 from hemagglutinin__InfluenzaA__ADA83595

SEQ ID NO: 186989 - RNA, 1701 nt, Artificial Sequence; identical to SEQ ID NO: 185693
  derived and/or modified sequence opt5 from hemagglutinin__InfluenzaA__ADA83599

SEQ ID NO: 186990 - RNA, 1701 nt, Artificial Sequence; identical to SEQ ID NO: 185693
  derived and/or modified sequence opt5 from hemagglutinin__InfluenzaA__ADA83603

SEQ ID NO: 186991 - RNA, 1701 nt, Artificial Sequence; identical to SEQ ID NO: 185693
  derived and/or modified sequence opt5 from hemagglutinin__InfluenzaA__ADA83611

SEQ ID NO: 186992 - RNA, 1701 nt, Artificial Sequence
  derived and/or modified sequence opt5 from hemagglutinin__InfluenzaA__ADA83615
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugaucugaaugugaaaaaccucuacgagaagguccgcagccagcugaaaaacaaugccaaggaaauugggaacggauguuuugaguucuaucacaagugcgacaauacauguauggaaucugugaaaaacggcaccuacgauuauccuaaguacuccgaggaagcuaaacuuaauagagaggagaucgacgggguuaagcuggaaagcacacggaucuaucaaauucucgccaucuacucuacgguggcguccagccugguccuggugguuucccucggcgcuauuucuuuuuggaugugcagcaacggaucccugcagugccgcaucuguauuuga

SEQ ID NO: 186993 - RNA, 1701 nt, Artificial Sequence
  derived and/or modified sequence opt5 from hemagglutinin__InfluenzaA__ADA83622
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaggaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagacucuaccagaacgcugacgccuacguguucgugggcacaagccgguauuccaagaaacugaagccugagauugcuauccgcccgaaagucagagaucaggaggggcggaugaauuacuauuggacccugguugaacccggagacaagauuacguuugaggccacaggcaaccucguggugccucgcuacgcguucgccauggaaagaaacgcugggagcggaaucauuaucucugauacccccguccaugacugcaauacaaccugucaaaccccuaaaggcgccaucaacacaucccugcccuuucagaauauucacccgaucacgauuggcaagugcccuaaguaugugaaaagcaccaaacuucggcuggcuacagggcuccgcaacguucccucuauccagagcagaggacuguucggcgccauugccggguuuaucgagggaggcuggaccgggaugguggacggaugguacggcuaucaucaccagaaugaacaaggcuccggguacgcugcggaucuuaagucuacacagaacgccaucgacgagauuaccaauaaggucaacagcgugaucgagaaaaugaauacgcaguucacagcuguuggaaaggaauuuaaccaccuggagaagcggauugaaaaucucaacaaaaagguggaugacggcuuccuggauaucuggaccuacaaugccgagcugcucguccugcuugaaaacgagcgcacccuggacuaucaugauuccaaugugaaaaaccucuacgagaaggucagaagccagcugaaaaacaaugccaaggaaauugggaacggauguuucgaguuuuaucacaagugcgacaauacauguauggaaucugugaaaaacggcaccuacgauuauccuaaguacuccgaggaagcuaaacuuaaucgggaggagaucgacgggguuaagcuggaaagcacacgcaucuaucaaauucucgccaucuacucuacgguggcguccagccugguccuggugguuucccucggcgcuauuucuuucuggaugugcagcaacggaucccugcagugcagaaucuguauuuga

SEQ ID NO: 186994 - RNA, 1701 nt, Artificial Sequence; identical to SEQ ID NO: 185693
  derived and/or modified sequence opt5 from hemagglutinin__InfluenzaA__ADA83633

SEQ ID NO: 186995 - RNA, 1701 nt, Artificial Sequence; identical to SEQ ID NO: 185693
  derived and/or modified sequence opt5 from hemagglutinin__InfluenzaA__ADA83637

SEQ ID NO: 186996 - RNA, 1701 nt, Artificial Sequence; identical to SEQ ID NO: 185693
  derived and/or modified sequence opt5 from hemagglutinin__InfluenzaA__ADA83641

SEQ ID NO: 186997 - RNA, 1701 nt, Artificial Sequence; identical to SEQ ID NO: 185693
  derived and/or modified sequence opt5 from hemagglutinin__InfluenzaA__ADA83645

SEQ ID NO: 186998 - RNA, 1701 nt, Artificial Sequence; identical to SEQ ID NO: 185693
  derived and/or modified sequence opt5 from hemagglutinin__InfluenzaA__ADA83648

SEQ ID NO: 186999 - RNA, 1701 nt, Artificial Sequence; identical to SEQ ID NO: 185693
  derived and/or modified sequence opt5 from hemagglutinin__InfluenzaA__ADA83656

SEQ ID NO: 187000 - RNA, 1701 nt, Artificial Sequence; identical to SEQ ID NO: 185693
  derived and/or modified sequence opt5 from hemagglutinin__InfluenzaA__ADA83660

SEQ ID NO: 187001 - RNA, 1701 nt, Artificial Sequence
  derived and/or modified sequence opt5 from hemagglutinin__InfluenzaA__ADA83664
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagaccgcuauucggccgaaaguccgcgaucaggaggggagaaugaauuacuauuggacgcugguugaacccggagacaagaucacauucgaggccaccggcaaccugguggugccucgguacgcguuugccauggaacgcaacgcugggucuggaauuaucauuuccgauacacccguccaugacugcaauaccaccugucaaacaccuaaaggcgccaucaacacgagccuccccuuccagaauauccacccgauuaccaucggcaagugcccuaaguaugugaaaucuacaaagcugagacuugcuaccgggcugcggaacguucccagcauucagucccgcggacucuuuggcgccaucgccggguucauugagggaggcuggacagggaugguggacggaugguacggcuaucaucaccagaaugaacaaggcucuggguacgcugcggaucugaaaagcacccagaacgccaucgacgagaucacgaauaaggucaacuccgugauugagaaaaugaauacacaguuuaccgcuguuggaaaggaguucaaccaccuugagaagagaaucgaaaaucugaacaaaaagguggaugacggcuuccucgauauuuggaccuacaaugccgagcugcugguccuccuggaaaacgagcggacacuugacuaucaugauagcaaugugaaaaaccuguacgagaagguccgcucucagcucaaaaacaaugccaaggaaaucgggaacggauguuuugaguucuaucacaagugcgacaauaccuguauggaauccgugaaaaacggcacauacgauuauccuaaguacagcgaggaagcuaaacugaauagagaggagauugacgggguuaaacuugaaucuacgcggaucuaucaaauccuggccauuuacuccaccguggcgagcucccucguccuggugguuucucugggcgcuaucagcuuuuggaugugcuccaacggaucucuccagugccgcauuuguaucuga

SEQ ID NO: 187002 - RNA, 1701 nt, Artificial Sequence
  derived and/or modified sequence opt5 from hemagglutinin__InfluenzaA__ADA83668
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugaguguggcucucucagcacagccuccucuuggagcuacaucguggaaaccuccucuagcgacaacgggacgugcuauccgggagauuuuauugacuacgaggaacugcgggagcagcuuuccagcgucucuuccuucgagcgcuuugaaaucuuccccaagaccagcucuuggccuaaucacgauuccaacaagggcgugacagccgcuuguccccaugccggcgcgaaaucuuuuuauaagaaucugaucuggcucguuaaaaaggggaacagcuacccuaaacuguccaagagcuauauuaaugacaagggaaaagaggugcuuguccuguggggcauccaccaccccuccaccucugccgaucaacagagccucuaccagaacgcugacgccuacguguucguggggacauccagauauagcaagaaauuuaagccugaaauugcuauccggccgaaaguccgcgaucaggagggaagaaugaauuacuauuggacccugguugagcccggcgacaagauuacguucgaagccacagggaaccugguggugccucgguacgcguuugccauggagcgcaacgcuggaucuggcaucauuaucuccgauacccccguccaugacugcaauacaaccugucaaaccccuaaaggcgccaucaacacaagccuccccuuccagaauauucacccgaucacgauugggaagugcccuaaguaugugaaaucuaccaagcugagacuugcuacaggacugcggaacguucccagcauccagucccgcggccucuuuggggccauugccggauucaucgaaggcggguggaccggaaugguggacggcugguacggcuaucaucaccagaaugagcaagggucuggauacgcugcggaucugaaaagcacacagaacgccaucgacgaaauuaccaauaaggucaacuccgugaucgagaaaaugaauacgcaguuuacagcuguuggcaaggaguucaaccaccuugaaaagagaauugagaaucugaacaaaaagguggaugacggguuccucgauaucuggaccuacaaugccgaacugcugguccuccuggagaacgaacggacccuugacuaucaugauagcaaugugaaaaaccuguacgagaagguccgcucucagcucaaaaacaaugccaaggagauuggaaacggcuguuuugaguucuaucacaagugcgacaauacauguauggaauccgugaaaaacgggaccuacgauuauccuaaguacagcgaagaggcuaaacugaauagagaagagaucgacggcguuaaacuugagucuacacggaucuaucaaauucuggccaucuacuccacgguggcgagcucccucguccuggugguuucucugggagcuauuagcuuuuggaugugcuccaacggcucucuccagugccgcaucuguauuuga

SEQ ID NO: 187003 - RNA, 1701 nt, Artificial Sequence; identical to SEQ ID NO: 185693
  derived and/or modified sequence opt5 from hemagglutinin__InfluenzaA__ADA83672

SEQ ID NO: 187004 - RNA, 1701 nt, Artificial Sequence; identical to SEQ ID NO: 185693
  derived and/or modified sequence opt5 from hemagglutinin__InfluenzaA__ADA83676

SEQ ID NO: 187005 - RNA, 1701 nt, Artificial Sequence; identical to SEQ ID NO: 185693
  derived and/or modified sequence opt5 from hemagglutinin__InfluenzaA__ADA83680

SEQ ID NO: 187006 - RNA, 1701 nt, Artificial Sequence
  derived and/or modified sequence opt5 from hemagglutinin__InfluenzaA__ADA86068
augaaggccauccuggugguccuccuguacaccuucgcuacagccaacgcggacacgcuuugcauuggcuaucacgcuaauaacagcaccgauacaguugacaccgugcuggagaagaaugugacagucacccauuccguggaucuccuggaagacaagcacaacgggaaacuuuguaagcugagaggaguugcuccccuccaucugggcaaaugcaauaucgccggguggauucugggaaacccugagugugaaucucucagcacagccuccucuuggagcuacaucguggagaccuccucuagcgauaauggcacgugcuauccgggggacuuuauugauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcaaccaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaucaagcugagacuugcuaccgggcugcggaacguucccagcauucagucccgcggacucuuuggcgccaucgccggguucaucgagggaggcuggacagggaugguggacggaugguacggcuaucaucaccagaaugaacaaggcucuggguacgcugcggaucugaaaagcacccagaacgccauugacgagaucacaaauaaggucaacuccgugauugagaaaaugaauacccaguuuacggcuguuggaaaggaguucaaccaccuugagaagagaaucgaaaaucugaacaaaaagguggaugacggcuuccucgauauuuggacauacaaugccgagcugcugguccuccuggaaaacgagcggacccuugacuaucaugauagcaaugugaaaaaccuguacgagaagguccgcucucagcucaaaaacaaugccaaggaaaucgggaacggauguuuugaguucuaucacaagugcgacaauaccuguauggaauccgugaaaaacggcacauacgauuauccuaaguacagcgaggaagcuaaacugaauagagaggagaucgacgggguuaaacuugaaucuacccggauuuaucaaauccuggccauuuacuccacaguggcgagcucccucguccuggugguuucucugggcgcuaucagcuuuuggaugugcuccaacggaucucuccagugccgcauuuguaucuga

SEQ ID NO: 187007 - RNA, 1701 nt, Artificial Sequence
  derived and/or modified sequence opt5 from hemagglutinin__InfluenzaA__ADA86086
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccaacgccgaucaacagucucucuaccagaaugcugacgccuacguguucgugggcacaagcagauauuccaagaaauuuaagccugagauugcuauccggccgaaaguccgcgaucaggaggggagaaugaacuacuauuggacccugguugaacccggagacaagauuacguucgaggccacaggcaaccugguggugccucgguacgcguuugccauggaacgcaaugcugggagcggaaucauuaucucugauacccccguccaugacugcaacacaaccugucaaaccccuaaaggcgccaucaauacaucccuccccuuccagaacauucacccgaucacgauuggcaagugcccuaaguaugugaaaagcaccaagcugagacuugcuacagggcugcggaauguucccucuauccagagccgcggacucuuuggcgccauugccggguucaucgagggaggcuggaccgggaugguggacggaugguacggcuaucaucaccagaacgaacaaggcuccggguacgcugcggaucugaaaucuacacagaaugccaucgacgagauuaccaacaaggucaauagcgugaucgagaaaaugaacacgcaguuuacagcuguuggaaaggaguucaaucaccuugagaagagaauugaaaaccugaauaaaaagguggaugacggcuuccucgauaucuggaccuacaacgccgagcugcugguccuccuggaaaaugagcggacccuugacuaucaugauuccaacgugaaaaaccuguacgagaagguccgcagccagcucaaaaauaacgccaaggaaauugggaauggauguuuugaguucuaucacaagugcgacaacacauguauggaaucugugaaaaauggcaccuacgauuauccuaaguacuccgaggaagcuaaacugaacagagaggagaucgacgggguuaaacuugaaagcacacggaucuaucaaauucuggccaucuacucuacgguggcguccagccucguccuggugguuucccugggcgcuauuucuuuuuggaugugcagcaauggaucccuccagugccgcaucuguauuuga

SEQ ID NO: 187008 - RNA, 1701 nt, Artificial Sequence
  derived and/or modified sequence opt5 from hemagglutinin__InfluenzaA__ADA86087
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuuuuccucugacaacggcacgugcuauccgggggauuucauugacuacgaagaacugcgggagcagcuuagcuccgucagcucuuuugaacgcuucgagaucuuucccaagaccuccagcuggccuaaucacgauucuaacaagggagugacagccgcuuguccccaugccggcgcgaaauccuucuauaagaaucugaucuggcucguuaaaaagggcaacagcuacccuaaacugucuaaguccuauauuaaugacaaggggaaagaagugcuuguccuguggggaauccaccaccccagcaccuccgccgaucaacagucucucuaccagaacgcugacgccuacguguuugugggcacaagcagauauuccaagaaauucaagccugagauugcuauccggccgaaaguccgcgaucaggaggggagaaugaauuacuauuggacccugguugaacccggagacaagauuacguuugaggccacaggcaaccugguggugccucgguacgcguucgccauggaacgcaacgcugggagcggaaucauuaucucugauacccccguccaugacugcaauacaaccugucaaaccccuaaaggcgcccucaacacaucccugcccuuucagaauauccacccgauuacgaucggcaagugcccuaaguaugugaaaagcaccaaacuuagacuggcuacagggcuccggaacguucccucuauucagagccgcggacuguucggcgccaucgccggguuuauugagggaggcuggaccgggaugguggacggaugguacggcuaucaucaccagaaugaacaaggcuccggguacgcugcggaucuuaagucuacacagaacgccaucgacgagaucaccaauaaggucaacagcgugauugagaaaaugaauacgcaguucacagcuguuggaaaggaguucaaccaccuggagaagagaaucgaaaaucucaacaaaaagguggaugacggcuuucuggauauuuggaccuacaaugccgagcugcucguccugcuugaaaacgagcggacccuggacuaucaugauuccaaugugaaaaaccucuacgagaagguccgcaaccagcugaaaaauaacgccaaggaaaucgggaauggauguuucgaguuuuaucacaagugcgacaacacauguauggaaagcgugaaaaauggcaccuacgauuauccuaaguacucugaggaagcuaaacuuaacagagaggagauugacgggguuaagcuggaauccacacggaucuaucaaauccucgccauuuacagcacgguggcgucuucccugguccuggugguuagccucggcgcuaucuccuucuggaugugcucuaauggaagccugcagugccgcauuuguaucuga

SEQ ID NO: 187009 - RNA, 1701 nt, Artificial Sequence; identical to SEQ ID NO: 186491
  derived and/or modified sequence opt5 from hemagglutinin__InfluenzaA__ADA86088

SEQ ID NO: 187010 - RNA, 1701 nt, Artificial Sequence
  derived and/or modified sequence opt5 from hemagglutinin__InfluenzaA__ADB03603
augaaggccauccugauugugcuccuguacaccuucgcuacagcccacgcggacacgcuuugcaucggcuaucaugcuaacaauagcaccgauacagucgacaccguucuggagaagaacgugacagugacccacuccgucaaucuccuggaagauaagcauaacgggaaacuuuguaagcugagaggaguggcuccccuccaccugggcaaaugcaauauugccggguggauccugggaaacccugagugugaaucucucagcacagccuccucuuggagcuacauuguugagaccuccucuagcgacaauggcacgugcuauccgggggauuuuaucgacuacgaagaacugcgggagcagcuuuccagcgugucuuccuucgaacgcuuugagaucuuccccaagaccagcucuuggccuaaccaugauuccaauaagggagucacagccgcuuguccccacgccggcgcgaaaucuuuuuauaagaaccugauuuggcucgugaaaaagggcaauagcuacccuaaacuguccaagagcuauaucaacgacaaggggaaagaaguucuugugcuguggggcauucaccaucccuccaccucugccgaucaacagagccucuaccagaaugcugacgccuacgucuucgugggaacauccagauauagcaagaaauuuaagccugagaucgcuauucggccgaaagugcgcgaucaggaggggagaauggacuacuauuggacccuggucgaacccggagauaagaucacguucgaggccacaggcaaccugguugugccucgguacgcguuugccauggaacgcaaugcugggucuggaauuaucaucuccgacacccccgugcacgacugcaacacaaccugucaaaccccuaaaggcgccauuaacacaagccuccccuuccagaauauccauccgauuacgaucggcaagugcccuaaguaugucaaaucuaccaagcugagacuugcuacagggcugcggaacgugcccagcauucagucccgcggacucuuuggcgccaucgccggguucaucgagggaggcuggaccgggaugguugauggaugguacggcuaucaccaccagaaugaacaaggcucuggguacgcugcggaccugaaaagcacacagaacgccauugaugagaucaccaauaaggugaacuccgucauugagaaaaugaauacgcaguuuacagcugugggaaaggaguucaaccaucuugagaagagaaucgaaaaucugaacaaaaagguugacgauggcuuccucgacauuuggaccuacaaugccgagcugcuggugcuccuggaaaacgagcggacccuugauuaucacgacagcaaugucaaaaaccuguacgagaaggugcgcucucagcucaaaaauaacgccaaggaaaucgggaacggauguuuugaguucuaucauaagugcgauaauacauguauggaauccgucaaaaacggcaccuacgacuauccuaaguacagcgaggaagcuaaacugaauagagaggagaucgauggggugaaacuugaaucuacacggauuuaucaaauccuggccauuuacuccacgguugcgagcucccucgugcuggucgugucucugggcgcuaucagcuuuuggaugugcuccaacggaucucuccagugccgcauuuguaucuga

SEQ ID NO: 187011 - RNA, 1701 nt, Artificial Sequence; identical to SEQ ID NO: 185680
  derived and/or modified sequence opt5 from hemagglutinin__InfluenzaA__ADB03604

SEQ ID NO: 187012 - RNA, 1701 nt, Artificial Sequence
  derived and/or modified sequence opt5 from hemagglutinin__InfluenzaA__ADB03605
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaauggauuacuauuggacccugguugagcccggagacaagauuacguucgaagccacaggcaaucugguggugccucgguacgcguuugccauggagcgcaacgcugggucuggaaucauuaucuccgauacccccguccaugacugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgaaggaggcuggaccgggaugguggacggaugguacggcuaucaucaccagaacgagcaaggcucuggguacgcugcggaucugaaaagcacacagaaugccaucgacgagauuaccaacaaggucaauuccgugaucgaaaagaugaacacgcaguuuacagcuguuggaaaggaguucaaucaccuugaaaagagaauugagaaccugaauaaaaagguggaugacggcuuccucgauaucuggaccuacaacgccgaacugcugguccuccuggagaaugagcggacccuugacuaucaugauagcaacgugaaaaaucuguacgaaaagguccgcucucagcucaaaaacaacgccaaggagauugggaauggauguuuugaguucuaucacaagugcgacaacacauguauggaguccgugaaaaauggcaccuacgauuauccuaaguacagcgaagaggcuaaacugaacagagaggaaaucgacgggguuaaacuugagucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 187013 - RNA, 1701 nt, Artificial Sequence; identical to SEQ ID NO: 185693
  derived and/or modified sequence opt5 from hemagglutinin__InfluenzaA__ADB03607

SEQ ID NO: 187014 - RNA, 1701 nt, Artificial Sequence; identical to SEQ ID NO: 186046
  derived and/or modified sequence opt5 from hemagglutinin__InfluenzaA__ADB03609

SEQ ID NO: 187015 - RNA, 1701 nt, Artificial Sequence; identical to SEQ ID NO: 185693
  derived and/or modified sequence opt5 from hemagglutinin__InfluenzaA__ADB03611

SEQ ID NO: 187016 - RNA, 1701 nt, Artificial Sequence
  derived and/or modified sequence opt5 from hemagglutinin__InfluenzaA__ADB03612
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccuuuauccagagccgcggacucuucggcgccauugccggguuuaucgagggaggcuggaccgggaugguggacggaugguacggcuaucaucaccagaaugaacaaggcuccggguacgcugcggaucugaaaucuacacagaacgccaucgacgagauuaccaauaaggucaacagcgugaucgagaaaaugaauacgcaguucacagcuguuggaaaggaguucaaccaccuugagaagagaauugaaaaucugaacaaaaagguggaugacggcuuucucgauaucuggaccuacaaugccgagcugcugguccuccuggaaaacgagcggacccuugacuaucaugauuccaaugugaaaaaccuguacgagaagguccgcagccagcucaaaaacaaugccaaggaaauugggaacggauguuucgaguuuuaucacaagugcgacaauacauguauggaaucugugaaaaacggcaccuacgauuauccuaaguacuccgaggaagcuaaacugaauagagaggagaucgacgggguuaaacuugaaagcacacggaucuaucaaauucuggccaucuacucuacgguggcguccagccucguccuggugguuucccugggcgcuauuucuuucuggaugugcagcaacggaucccuccagugccgcaucuguauuuga

SEQ ID NO: 187017 - RNA, 1701 nt, Artificial Sequence; identical to SEQ ID NO: 185693
  derived and/or modified sequence opt5 from hemagglutinin__InfluenzaA__ADB03614

SEQ ID NO: 187018 - RNA, 1701 nt, Artificial Sequence
  derived and/or modified sequence opt5 from hemagglutinin__InfluenzaA__ADB03617
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaccugaaaagcacacagaacgccaucgaugagauuaccaauaaggucaacuccgugaucgagaaaaugaauacgcaguuuacagcuguuggaaaggaguucaaccaccuugaaaagagaauugagaaucugaacaaaaagguggacgauggcuuccucgacaucuggaccuacaaugccgaacugcugguccuccuggagaacgagcggacccuugauuaucaugacagcaaugugaaaaaccuguacgaaaagguccgcucucagcucaaaaacaaugccaaggagauugggaacggauguuuugaguucuaucacaagugcgauaauacauguauggaauccgugaaaaacggcaccuacgacuauccuaaguacagcaaagaagcuaagcugaauagagaggagaucgaugggguuaaacuugaaucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 187019 - RNA, 1701 nt, Artificial Sequence; identical to SEQ ID NO: 186046
  derived and/or modified sequence opt5 from hemagglutinin__InfluenzaA__ADB03619

SEQ ID NO: 187020 - RNA, 1701 nt, Artificial Sequence
  derived and/or modified sequence opt5 from hemagglutinin__InfluenzaA__ADB03620
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagggaagcacaauggaaaacuuuguaagcugagaggcguugcuccccuccaucuggggaaaugcaacaucgccggauggauucugggcaauccugagugugaaucucucagcacagccuccucuuggagcuacaucguggagaccuccucuagcgauaacgggacgugcuauccgggagacuuuauugauuacgaggaacugcgggagcagcuuuccagcgucucuuccuucgaacgcuuugagaucgugcccaagaccagcucuuggccuaaucacgacuccaacaagggcguuacagccgcuuguccccaugccggcgcgaaaucuuucuauaagaaucugaucuggcucgugaaaaaggggaacagcuacccuaaacuguccaagagcuauauuaaugauaagggaaaagaaguccuugugcuguggggcauccaccaccccuccaccucugccgaccaacagagccucuaccagaacgcugaugccuacguguuugucgggacauccagauauagcaagaaauucaagccugagauugcuauccggccgaaaguucgcgaccaggagggaagaaugaauuacuauuggacccugguggaacccggcgauaagauuacguuugaggccacagggaaccugguggucccucgguacgcguucgccauggaacgcaacgcuggaucuggcaucauuaucuccgacacccccgugcaugauugcaauacaaccugucaaaccccuaaaggcgccaucaacacaagccuccccuuucagaauauucacccgaucacgauugggaagugcccuaaguauguuaaaucuaccaagcugagacuugcuacaggacugcggaacgugcccagcauccagucccgcggccucuucggggccauugccggauuuaucgagggcggguggaccggaauggucgacggcugguacggcuaucaucaccagaaugaacaagggucuggauacgcugcggaccugaaaagcacacagaacgccaucgaugagauuaccaauaaggugaacuccguuaucgagaaaaugaauacgcaguucacagcugugggcaaggaauuuaaccaccuugagaagagaauugaaaaucugaacaaaaaggucgacgauggguuccucgacaucuggaccuacaaugccgagcugcuggugcuccuggaaaacgagcggacccuugauuaucaugacagcaaugucaaaaaccuguacgagaaggugcgcucucagcucaaaaacaaugccaaggaaauuggaaacggcuguuucgaguuuuaucacaagugcgauaauacauguauggaauccguuaaaaacgggaccuacgacuauccuaaguacagcgaggaagcuaaacugaauagagaggagaucgauggcgugaaacuugaaucuacacggaucuaucaaauucuggccaucuacuccacggucgcgagcucccucgugcugguugugucucugggagcuauuagcuucuggaugugcuccaacggcucucuccagugccgcaucuguauuuga

SEQ ID NO: 187021 - RNA, 1701 nt, Artificial Sequence
  derived and/or modified sequence opt5 from hemagglutinin__InfluenzaA__ADB03622
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaccugguggugccucgguacgcguuugccauggaacgcaaugcugggucuggaaucauuaucuccgacacccccguccaugauugcaacacaaccugucaaaccccuaauggcgccaucaacacaagccuccccuuccagaauauucacccgaucacgauuggcaaaugcccuaaguaugugaagucuaccaaacugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaccuuaagagcacacagaacgccaucgauaaaauuaccaauaaggucaacuccgugaucgagaaaaugaauacgcaguuuacagcuguuggaaaggaguucaaccaccuugaaaagagaauugagaaucugaacaaaaagguggacgauggcuuccucgacaucuggaccuacaaugccgaacugcugguccuccuggagaacgaacggacccuugauuaucaugacagcaacgugaaaaaucuguacgagaagguccgcucucagcucaaaaacaaugccaaggagauugggaacggauguuuugaguucuaucacaagugcgauaauacauguauggaguccgugaaaaacggcaccuacgacuauccuaaguacagcgaagaggcuaaacugaauagagaagagaucgaugggguuaagcuggagucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 187022 - RNA, 1701 nt, Artificial Sequence; identical to SEQ ID NO: 187021
  derived and/or modified sequence opt5 from hemagglutinin__InfluenzaA__ADB03623

SEQ ID NO: 187023 - RNA, 1701 nt, Artificial Sequence
  derived and/or modified sequence opt5 from hemagglutinin__InfluenzaA__ADB03628
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaagcuguguaaacugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagagccucuaccagaacgcugacgccuacguguucgugggcacauccagauauagcaaaaaguuuaaaccugagauugcuauccggccgaagguccgcgaucaggaagggagaaugaauuacuauuggacccugguugagcccggagacaaaauuacguucgaagccacaggcaaccugguggugccucgguacgcguuugccauggagcgcaacgcugggucuggaaucauuaucuccgauacccccguccaugacugcaauacaaccugucaaaccccuaagggcgccaucaacacaagccuccccuuccacaauauucauccgaucacgauuggcaaaugcccuaaguaugugaagucuaccaaacugagacuugcuacagggcugcggaacguucccagcauccagucccgcggacucuuuggcgccauugccggguucaucgaaggaggcuggaccgggaugguggacggaugguacggcuaucaccaccagaaugagcagggcucuggguacgcugcggaucuuaagagcacacaaaacgccaucgacgagauuaccaauaaagucaacuccgugaucgaaaagaugaauacgcaguuuacagcuguuggaaaagaguucaaccaucuugaaaagagaauugagaaucugaacaagaaaguggaugacggcuuccucgauaucuggaccuacaaugccgaacugcugguccuccuggagaacgagcggacccuugacuaucacgauagcaaugugaagaaccuguacgaaaaaguccgcucucagcucaagaacaaugccaaagagauugggaacggauguuuugaguucuaucauaagugcgacaauacauguauggaauccgugaagaacggcaccuacgauuauccuaaauacagcgaagaggcuaagcugaauagagaggaaaucgacgggguuaaacuugagucuacacggaucuaucagauucuggccaucuacuccacgguggcgagcucccucguccuggugguuucucugggcgcuauuagcuuuuggaugugcuccaacggaucucuccaaugccgcaucuguauuuga

SEQ ID NO: 187024 - RNA, 1701 nt, Artificial Sequence
  derived and/or modified sequence opt5 from hemagglutinin__InfluenzaA__ADB03629
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgagcaggaagggagaaugaauuacuauuggacgcugguugagcccggagauaagauuacauucgaagcuaccggcaaccugguggugccucgguacgccuuugcgauggagcgcaacgccgggucuggaaucauuaucuccgacacacccguccaugauugcaauaccaccugucaaacaccuaaaggcgcuaucaacacgagccuccccuuccagaauauucacucuaucaccauuggcaagugcccgaaguaugugaaaagcacaaagcugagacuugccaccgggcugcggaacguuccuuccauccagucucgcggacucuuuggcgcuauugccggguucaucgaaggaggcuggacagggaugguggacggaugguacggcuuucaucaccagaaugagcaaggcagcggguaugccgcugaccugaaauccacccagaacgcgaucgaugagauuacgaauaaggucaacagcgugaucgagaaaaugaauacacaguucaccgccguuggaaaggaguucaaccaccuugaaaagagaauugagaaucugaacaaaaagguggacgauggcuuucucgacaucuggaccuacaaugcugaacugcugguccuccuggagaacgagcggacacuugauuaccaugacucuaaugugaaaaaccuguaugaaaagguccgcucccagcucaaaaacaaugccaaggagauugggaacggauguuucgaauuuuaccacaagugcgauaauaccuguauggagagcgugaaaaacggcacauaugacuaccccaaguauucugaagaggccaaacugaauagagaggaaaucgaugggguuaaacuugaguccacgcggaucuaccaaauucuggcuaucuauagcaccguggccuccucucucguccuggugguuagccugggcgcgauuuccuucuggaugugcucuaacggaagccuccagugccgcaucuguauuuga

SEQ ID NO: 187025 - RNA, 1701 nt, Artificial Sequence
  derived and/or modified sequence opt5 from hemagglutinin__InfluenzaA__ADB03630
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuaccauuggacccugguugaacccggagacaagauuacguucgaggccacaggcaaccugguggugccucgguaugcguuugccauggaacgcaacgcugggucuggaaucauuaucuccgauacccccguccacgacugcaauacaaccugucaaaccccuaaaggcgccaucaacacaagccuccccuuccagaauauucauccgaucacgauuggcaagugcccuaaguacgugaaaucuaccaagcugagacuugcuacagggcugcggaacguucccagcauccagucccgcggacucuuuggcgccauugccggguucaucgagggaggcuggaccgggaugguggacggaugguauggcuaccaccaccagaaugaacaaggcucuggguaugcugcggaucugaaaagcacacagaacgccaucgacgagauuaccaauaaggucaacuccgugaucgagaaaaugaauacgcaguuuacagcuguuggaaaggaguucaaccaucuugagaagagaauugaaaaucugaacaaaaagguggaugacggcuuccucgauaucuggaccuacaaugccgagcugcugguccuccuggaaaacgagcggacccuugacuaccacgauagcaaugugaaaaaccuguaugagaagguccgcucucagcucaaaaacaaugccaaggaaauugggaacggauguuuugaguucuaccauaagugcgacaauacauguauggaauccgugaaaaacggcaccuaugauuacccuaaguauagcaaagaggcuaagcugaauagagaagagaucgacgggguuaaacuugagucuacacggaucuaccaaauucuggccaucuauuccacgguggcgagcucccucguccuggugguuucucugggcgcuauuagcuuuuggaugugcuccaacggaucucuccagugccgcaucuguauuuga

SEQ ID NO: 187026 - RNA, 1701 nt, Artificial Sequence; identical to SEQ ID NO: 186438
  derived and/or modified sequence opt5 from hemagglutinin__InfluenzaA__ADB25319

SEQ ID NO: 187027 - RNA, 1701 nt, Artificial Sequence; identical to SEQ ID NO: 185693
  derived and/or modified sequence opt5 from hemagglutinin__InfluenzaA__ADB25321

SEQ ID NO: 187028 - RNA, 1701 nt, Artificial Sequence
  derived and/or modified sequence opt5 from hemagglutinin__InfluenzaA__ADB27970
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcgaugcugggucuggaaucauuaucuccgacacccccguccaugacugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggauggaugguacggcuaucaucaccagaacgaacaaggcucuggguacgcugcggaccugaaaagcacacagaaugccaucgaugagauuaccaacaaggucaauuccgugaucgagaaaaugaacacgcaguuuacagcuguuggaaaggaguucaaucaccuugagaagagaauugaaaaccugaauaaaaagguggacgauggcuuccucgacaucuggaccuacaacgccgagcugcugguccuccuggaaaaugagcggacccuugauuaucaugacagcaacgugaaaaaucuguacgagaagguccgcucucagcucaaaaacaacgccaaggaaauugggaauggauguuuugaguucuaucacaagugcgauaacacauguauggaauccgugaaaaauggcaccuacgacuauccuaaguacagcgaggaagcuaaacugaacagagaggagaucgaugggguuaaacuugaaucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 187029 - RNA, 1701 nt, Artificial Sequence; identical to SEQ ID NO: 185693
  derived and/or modified sequence opt5 from hemagglutinin__InfluenzaA__ADB27980

SEQ ID NO: 187030 - RNA, 1701 nt, Artificial Sequence; identical to SEQ ID NO: 185693
  derived and/or modified sequence opt5 from hemagglutinin__InfluenzaA__ADB54352

SEQ ID NO: 187031 - RNA, 1701 nt, Artificial Sequence; identical to SEQ ID NO: 185693
  derived and/or modified sequence opt5 from hemagglutinin__InfluenzaA__ADB54355

SEQ ID NO: 187032 - RNA, 1698 nt, Artificial Sequence
  derived and/or modified sequence opt5 from hemagglutinin__InfluenzaA__ADB65926
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauaaacacaacgggaaacuuugccugcucaagggaaaggcgccccugcagcugggcaauuguucuguugcuggguggauccucggaaacccugagugcggccugcuuauuagcaaggaauccuggucuuacaucguggagagaccgaaucccgaaaacgggaccuguuauccuggacauuuugccgacuacgaggagcugcgggaacaacucagcuccgucucuagcuucgagcgcuuugaaauuuuccccaaaggcuccagcuggccuaaucacacggugaccggcguuucugccuccugcagccauaacggggagucuuccuuuuauaagaaucugcuuuggcugacagggaaaaacggccucuaccccaaucugagcaagucuuaugcuaacaauaaagagaaggaagugcugguccucuggggagugcaccacccuccgaacaucggagaucagaugacccuguaccauaaggagaacgccuacguguccgucguuagcucccacuauucuagaaaauucacacccgaaaucgcuaagcggccuaaagugcgcgaccaggagggcagaauuaauuacuauuggacccuucuggaacccggggauacgaucauuuuugaggccaacggaaaucucaucgcgccucgguacgccuucgcucugagccgcggcuuuggcuccgggauuaucaacagcaaugcccccauggacgagugugaugcuaagugccagacaccgcaaggagccauuaacucuucccuuccuuuccagaaugugcaucccgucaccaucggcgaauguccuaaauaugugagaagcgcgaagcugcggaugguuacagggcuccgcaacauccccucuauucagagcagaggacuguuuggcgccaucgcuggguucauugagggaggcuggaccggcaugguggacgggugguacggauaucaccaccagaaugaacaaggcuccggguacgccgcugaucagaaaucuacccagaacgccaucaauggaauuacaaacaaggucaauagcgugaucgagaagaugaacacgcaguuuaccgccguuggcaaagaguucaauaagcuggaacggcgcauggagaaccucaacaaaaagguggacgauggguucaucgacgucuggacauacaaugcugaacugcuugugcugcucgagaacgaaagaacccuggacuuucaugauuccaaugucaaaaaccuuuaugagaaggugaagaaucaacugaaaaacaaugcgaaggaaaugggcaacggaugcuucgaguuuuaccacaaauguaaugacgagugcauggaaagcguuaagaacggcacauaugauuaccccaaauauucugaggaauccaagcucagccgggagaagauugacggggugaaacuggagucuaugggagucuaccagauccuggccauuuauuccaccguggcuagcucccucguucugcuugugucucugggcgccaucggguucuggaugugcagcaauggaucccuccagugucgcauuugcaucuga

SEQ ID NO: 187033 - RNA, 1698 nt, Artificial Sequence
  derived and/or modified sequence opt5 from hemagglutinin__InfluenzaA__ADB80153
augaaggugaaacugcucgcccugcuuugcaccuucacagcuacguacgccgacaccaucuguauuggcuaucacgcgaacaauagcacagauaccgucgacacaguucuggagaagaacgugaccgugacacauuccgucaaucuccuggaagauaaccacaaugggaaacuuugccugcucaagggaaucgcuccccugcagcugggcaacuguucuguggccggguggauucucggaaauccugagugcgaacugcuuaucagcaaagaguccuggucuuacauuguugaaaagccgaaccccgagaauggcaccuguuauccugggcauuuugccgacuacgaggaacugagagagcaacucagcuccgugucuagcuucgaacgguuugagaucuuccccaaggaguccagcuggccuaaccacacggucaccggagugucugcuuccugcagccauaauggcgaaucuuccuuuuauaaaaaccugcuuuggcugacaggcaagaaugggcucuaccccaaccugagcaaaucuuucgccaauaacaaggagaaagaaguucuggugcucuggggaguccaccacccuccgaacaucggcgaucagaugacccuguaucauaaggagaaugcuuacguguccguggucagcucccacuacucucgcaaguuuacacccgaaauugccaaaagaccuaagguucgggaccaggaggggcgcaucaacuauuacuggacccuucuggagcccggagauacgauuaucuucgaagcgaauggcaaccucauugccccuagauaugcuuuugcccugagccggggguucggauccggcaucauuaauagcaacgcucccauggacgagugugaugccaaaugccagacaccgcaaggcgcgaucaauucuucccuuccuuuucagaacgugcaucccgugaccaucggggaauguccuaaguacguccgcagcacaaaacugagaauggugaccggacuccggaauauucccucuauccagagccgcggccuguucggggccauugcuggauuuaucgagggcggguggaccggaaugguugacggcugguauggcuaccaccaccagaacgaacaaggguccggauaugccgcugaucagaagucuacacagaaugccauuaacggcaucacgaauaaagugaacagcgucaucgagaagaugaauacccaguucacagccguggggaaggaguucaacaaacuggaaagacggauggagaaccucaauaagaaaguugacgauggauuuauugacguguggaccuacaacgcugaacugcuuguccugcucgagaaugaacgcacacuggacuuccaugauuccaacgugaagaaucuuuacgagaaagucaagaaccaacugaagaauaacgcgaaagagaucggcaaugggugcuuugaguucuaucacaaguguaacgacgaaugcauggaaagcgugaaaaauggcaccuacgauuaucccaaguacucugaggaguccaaacucagcagagaaaagauugacggaguuaagcuggagucuaugggcguguaucagauccuggccauuuacuccacggucgcuagcucccucgugcugcuuguuucucugggggccaucagcuuuuggaugugcuccaacggaucucuccagugucggaucugcauuuga

SEQ ID NO: 187034 - RNA, 1701 nt, Artificial Sequence; identical to SEQ ID NO: 186794
  derived and/or modified sequence opt5 from hemagglutinin__InfluenzaA__ADB81399

SEQ ID NO: 187035 - RNA, 1701 nt, Artificial Sequence; identical to SEQ ID NO: 186794
  derived and/or modified sequence opt5 from hemagglutinin__InfluenzaA__ADB81409

SEQ ID NO: 187036 - RNA, 1701 nt, Artificial Sequence
  derived and/or modified sequence opt5 from hemagglutinin__InfluenzaA__ADB81419
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacauccccagcauucagucccgcggacucuuuggcgccaucgccggguucaucgagggaggcuggaccgggaugguugacggaugguacggcuaucaucaccagaaugaacaaggcucuggguacgcugcggaucugaaaagcacacagaacgccauugacgagaucaccaauaaggugaacuccgucauugagaaaaugaauacgcaguuuacagcugugggaaaggaguucaaccaccuugagaagagaaucgaaaaucugaacaaaaagguugaugacggcuuccucgauauuuggaccuacaaugccgagcugcuggugcuccuggaaaacgagcggacccuugacuaucaugauagcaaugucaaaaaccuguacgagaaggugcgcucucagcucaaaaacaaugccaaggaaaucgggaacggauguuuugaguucuaucacaagugcgacaauacauguauggaauccgucaaaaacggcaccuacgauuauccugaguacagcgaagaggcuaagcugaauagagaggaaaucgacggggugaaacuugagucuacacggauuuaucaaauccuggccauuuacuccacgguugcgagcucccucgugcuggucgugucucugggcgcuaucagcuuuuggaugugcuccaacggaucucuccagugccgcauuuguaucuga

SEQ ID NO: 187037 - RNA, 1701 nt, Artificial Sequence; identical to SEQ ID NO: 186853
  derived and/or modified sequence opt5 from hemagglutinin__InfluenzaA__ADB81429

SEQ ID NO: 187038 - RNA, 1701 nt, Artificial Sequence
  derived and/or modified sequence opt5 from hemagglutinin__InfluenzaA__ADB81439
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcagauauuccaagaaauuuaagccggagauugcuauccggcccaaaguccgcaaucaggaggggagaaugaacuacuauuggacccugguugaaccuggagauaagauuacguucgaggccacaggcaaccugguggugccccgguacgcguuugccauggaacgcaaugcugggagcggaaucauuaucucugacaccccuguccaugauugcaacacaaccugucaaacccccaaaggcgccaucaauacaucccucccguuccagaacauucacccuaucacgauuggcaagugccccaaguaugugaaaagcaccaagcugagacuugcuacagggcugcggaauguuccuucuauccagagccgcggacucuuuggcgccauugccggguucaucgagggaggcuggaccgggaugguggacggaugguacggcuaucaucaccagaacgaacaaggcuccggguacgcugcggaccugaaaucuacacagaaugccaucgaugagauuaccaacaaggucaauagcgugaucgagaaaaugaacacgcaguuuacagcuguuggaaaggaguucaaucaccuugagaagagaauugaaaaccugaauaaaaagguggacgauggcuuccucgacaucuggaccuacaacgccgagcugcugguccuccuggaaaaugagcggacccuugauuaucaugacuccaacgugaaaaaccuguacgagaagguccgcagccagcucaaaaauaacgccaaggaaauugggaauggauguuuugaguucuaucacaagugcgauaacacauguauggaaucugugaaaaauggcaccuacgacuaucccaaguacuccgaggaagcuaaacugaacagagaggagaucgaugggguuaaacuugaaagcacacggaucuaucaaauucuggccaucuacucuacgguggcguccagccucguccuggugguuucccugggcgcuauuucuuuuuggaugugcagcaauggaucccuccagugccgcaucuguauuuga

SEQ ID NO: 187039 - RNA, 1701 nt, Artificial Sequence
  derived and/or modified sequence opt5 from hemagglutinin__InfluenzaA__ADB81449
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacugaauaaguccuauauuaacgacaaggggaaagaagugcuuguccuguggggaauccaccaccccagcaccuccgccgaucaacagucucucuaccagaaugcugacgccuacguguucgugggcacaagcagauauuccaagaaauuuaagccugagauugcuauccggccgaaaguccgcgaucaggaggggagaaugaacuacuauuggacccugguugaacccggagacaagauuacguucgaggccacaggcaaccugguggugccucgguacgcguuugccauggaacgcaaugcugggagcggaaucauuaucucugauacccccguccaugacugcaacacaaccugucaaaccccuaaaggcgccaucaauacaucccuccccuuccagaacauucacccgaucacgauuggcaagugcccuaaguaugugaaaagcaccaagcugagacuugcuacagggcugcggaauguucccucuauccagagccgcggacucuuuggcgccauugccggguucaucgagggaggcuggaccgggaugguggacggaugguacggcuaucaucaccagaacgaacaaggcuccggguacgcugcggaucugaaaucuacacagaaugccaucgacgagauuaccaacaaggucaauagcgugaucgagaaaaugaacacgcaguuuacagcuguuggaaaggaguucaaucaccuugagaagagaauugaaaaccugaauaaaaagguggaugacggcuuccucgauaucuggaccuacaacgccgagcugcugguccuccuggaaaaugagcggacccuugacuaucaugauuccaacgugaaaaaccuguacgagaagguccgcagccagcucaaaaauaacgccaaggaaauugggaauggauguuuugaguucuaucacaagugcgacaacacauguauggaaucugugaaaaauggcaccuacgauuauccuaaguacuccgaggaagcuaaacugaacagagaggagaucgacgggguuaaacuugaaagcacacggaucuaucaaauucuggccaucuacucuacgguggcguccagccucguccuggugguuucccugggcgcuauuucuuuuuggaugugcagcaauggaucccuccagugccgcaucuguauuuga

SEQ ID NO: 187040 - RNA, 1701 nt, Artificial Sequence
  derived and/or modified sequence opt5 from hemagglutinin__InfluenzaA__ADB81459
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacugaauaaguccuauauuaacgacaaggggaaagaagugcuuguccuguggggaauccaccaccccagcaccuccgccgaucaacagucucucuaccagaaugcugacgccuacguguucgugggcacaagcagauauuccaagaaauuuaagccugagauugcuauccggccgaaaguccgcgaucaggaggggagaaugaacuacuauuggacccugguugaacccggagacaagauuacguucgaggccacaggcaaccugguggugccucgguacgcguuugccauggaacgcaaugggggaagcggcaucauuaucucugauacccccguccaugacugcaacacaaccugucaaaccccuaaaggcgcuaucaauacaucccuccccuuccagaacauucacccgaucacgauugggaagugcccuaaguaugugaaaagcaccaagcugagacuugccacaggacugcggaauguucccucuauccagagccgcggccucuuuggggcuauugccggauucaucgagggcggguggaccggaaugguggacggcugguacggcuaucaucaccagaacgaacaaggguccggauacgccgcugaucugaaaucuacacagaaugcgaucgacgagauuaccaacaaggucaauagcgugaucgagaaaaugaacacgcaguuuacagccguuggcaaggaguucaaucaccuugagaagagaauugaaaaccugaauaaaaagguggaugacggguuccucgauaucuggaccuacaacgcugagcugcugguccuccuggaaaaugagcggacccuugacuaucaugauuccaacgugaaaaaccuguacgagaagguccgcagccagcucaaaaauaacgccaaggaaauuggaaauggcuguuuugaguucuaucacaagugcgacaacacauguauggaaucugugaaaaaugggaccuacgauuauccuaaguacuccgaggaagccaaacugaacagagaggagaucgacggcguuaaacuugaaagcacacggaucuaucaaauucuggcuaucuacucuacgguggccuccagccucguccuggugguuucccugggagcgauuucuuuuuggaugugcagcaauggcucccuccagugccgcaucuguauuuga

SEQ ID NO: 187041 - RNA, 1701 nt, Artificial Sequence
  derived and/or modified sequence opt5 from hemagglutinin__InfluenzaA__ADB82655
augaaggccauccugcucgugcugcuuugcacccuggcugccgcgaacgcugacacacucuguauuggcuaccacgccaauaacagcacggauaccgucgacacaguucuggagaaaaaugugaccgugacacauuccgucaaccuucuggaagauagacacaaugggaagcucugcaaccugcggggaaaagcuccccugcaucucggcaaguguaauaucgccggguggcugcuuggaaacccugagugcgaacuccuguucgccguuaauucuuggagcuauauuguggagaccuccaacucugacaauggcacauguuacccgggggauuuuaccagcuaugaggaacugcgcgagcagcuuuccucugugagcuccuucgaaagauuugagaucuuccccaaagcuagcucuuggccuaaccacgaaacgaaucggggagucaccgccgcgugccccuacgccggcacaaacggcuuuuaucgcaaucugauuuggcucgugaagaaggagaacuccuacccuaaacugagaaagagcuauguuaacaauaaaaagaaagaggugcugguccucugggggauccaucaucccccuaccaacacagaccaacagucucuguaccagaaugcugaugccuacguguucgugggauccagcaaguauucucggaaguuuaaaccggaaaucgcugagcgccccaaggucagaggccaggccgggcggaugaacuacuauuggacccuuauugaaccuggagacacgaucacauucgaggcgaccggcaaucugguugcuccccgcuacgccuuugccaugaacagagggccuguguccggaauuaucacaagcgaugcucccgugcacgacuguaaugcuaccugccaaaccccgaaaggcgccauuaacacaucccucccuuuccagaauauccaccccauuacgaucggcgaauguccuaaguaugucaaaucuacccggcugcgcauggccacagggcuuagaaacauccccagcauucagucccggggacuguuuggcgcgaucgccggguucauugagggaggcuggaccgggaugaucgauggaugguacggcuaucaccaucagaauggccaagggagcggauacgcugccgaccagaagucuacacagaacgccauugaucgcaucaccaauaaagugaacuccguuaucgagaagaugaauauucaguuuacggcugugggcaaggaguucaaccaccucgaaagacggaucgaaaaccugaauaaaaaggucgacgacggguuccuggauguguggacauacaacgccgagcuccugguucuucuggaaaaugagagaacccucgacuuucacgauagcaacgugaaaacccuguaugagaaggucaaaacacaacuucgcaauaacgcgaaggaaauuggaaauggcugcuucgaguuuuaccauaagugugacgauaccugcauggaaucuaucaaaaacgggacauauaauuaccccaaguauagcgaggaauccaaacugaaccgggaggagauugacggcgugaagcucgaaucuacgagaaucuaccagauccuggcuauuuauagcaccgccgccuccagccugguccuccuggugucucuuggagcuaucggcuucuggaugugcuccaaugggagccugcagugucgcauuugcaucuga

SEQ ID NO: 187042 - RNA, 1701 nt, Artificial Sequence
  derived and/or modified sequence opt5 from hemagglutinin__InfluenzaA__ADB82656
augaaggccauccugcucgugcugcagugcauucuuaccgcugccaacgcggacacacuguguaucggcuaccacgcuaauaacagcacggauaccgucgacacaguucucgagaaaaaugugaccgugacacauuccgucaaccugcuugaagauagacacaaugggaagcugugcaaacucaagggaauugcuccccugcaucugggcaaauguaacaucgccggguggcuccugggaaauccugagugcgaacuucuguucaaggccaacucuuggagcuauauuguggagaccuccuacucugacaauggcacauguuauccgggggauuuuaccaacuacgaggagcuccgggagcaacugagcuccguuucuagcuucgaacgcuuugagauguuccccaaggccaauuccuggccuaaccacgaaacgaauaaaggagugaccgcugccugccccuaugcgggcgccaacagcuuuuacagaaaucuuaucuggcuggucaagaaaggcaacucuuauccucggcucuccaagagcuacgugaacaauaaaaagaaggagguucuggugcugugggggauccaucaccccucuacauccaccgaccagcagagccucuaccagaacgcugaugccuaugucuucgugucuuccagcacauacaauaaacgcuuuaagccugagauuggaaccagaccgaaagugcgggaccaauccggccgcaugaacuauuacuggacgaucgucgaacccggggauacaauuaccuucgaggcuacaggaaaucugguugccccuagauaugcguuugccaugaagcgggacucuggcagcgggaucauuauguccgauacccccgugcacgacuguaacaccacaugccagacgccuaaaggagcuaucaauaccagccuucccuuccagaacgugcauccggucacaauuggcgaauguccuaaguacgugaaaucuaccaagcugcgcauggccacaggccucagaaauauccccuccauccagagccgggggcuguuuggagcuauugccggcuucaucgaagggggauggaccggcaugauugaugggugguauggauaccaccaucaaaacgaacagggcucuggcuacgccgcugaccgcaagagcacgcagaaugcgaucgacgggauuacaaacaaaguuaauuccaucaucgagaagaugaacauucaguuuaccgccgugggaaaagaguucucucaccuugaaaagagagucgagaaucugaacaaaaagguggaugacggcuuccucgauguuuggaccuauaacgcugaacugcuggugcuccuggagaaugaacggacacuugacuaccacgauagcaacgucaagaaucuguaugagaaagugcgcucccaacucaagaacaaugccaaagagaucgggaacggaugcuuugaguucuaccauaagugugacgauagcugcauggaaucuauuaaaaaugaaaccuaugacuacuccaaguauagcgaggaaucuagacugaaccgggagaagaucgauggcgucaaacuugaguccacacagauuuaccagauccuggccaucuacagcacgguggcuuccucucucguucugcuggugagccucggggccauuuccuuuuggaugugcucuaauggcagccugcaauguagaaucugcauuuga

SEQ ID NO: 187043 - RNA, 1701 nt, Artificial Sequence
  derived and/or modified sequence opt5 from hemagglutinin__InfluenzaA__ADB82944
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcagauauuccaagaaauuuaagccggagauugcuauccggcccaaaguccgcgaucaggaggggagaaugaauuacuauuggacccugguugaaccuggagacaagauuacguucgaggccacaggcaaccugguggugccccgguacgcguuugccauggaacgcaacgcugggagcggaaucauuaucucugauaccccuguccaugacugcaauacaaccugucaaacccccaaaggcgccaucaacacaucccucccguuccagaauauucacccuaucacgauuggcaagugccccaaguaugugaaaagcaccaagcugagacuugcuacagggcugcggaacaucccuucuauucagagccgcggacucuuuggcgccaucgccggguucaucgagggaggcuggaccgggaugguugacggaugguacggcuaucaucaccagaaugaacaaggcuccggguacgcugcggaucugaaaucuacacagaacgccauugacgagaucaccaauaaggugaacagcgucauugagaaaaugaauacgcaguuuacagcugugggaaaggaguucaaccaccuugagaagagaaucgaaaaucugaacaaaaagguugaugacggcuuccucgauauuuggaccuacaaugccgagcugcuggugcuccuggaaaacgagcggacccuugacuaucaugauuccaaugucaaaaaccuguacgagaaggugcgcagccagcucaaaaacaaugccaaggaaaucgggaacggauguuuugaguucuaucacaagugcgacaauacauguauggaaucugucaaaaacggcaccuacgauuaucccaaguacuccgaggaagcuaaacugaauagagaggagaucgacggggugaaacuugaaagcacacggauuuaucaaauccuggccauuuacucuacgguugcguccagccucgugcuggucgugucccugggcgcuaucucuuuuuggaugugcagcaacggaucccuccagugccgcauuuguaucuga

SEQ ID NO: 187044 - RNA, 1701 nt, Artificial Sequence
  derived and/or modified sequence opt5 from hemagglutinin__InfluenzaA__ADB82950
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuugagccugagauugcuauccggccgaagguccgcgaucaggaagggagaaugaauuacuauuggacccugguugagcccggagacaaaauuacguucgaagccacaggcaaccugguggugccucgguacgcguuugccauggagcgcaacgcugggucuggaaucauuaucuccgauacccccguccaugacugcaauacaaccugucaaaccccuaagggcgccaucaacacaagccuccccuuccagaauauucacccgaucacgauuggcaaaugcccuaaguaugugaagucuaccaaacugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaucuuaagagcacacagaacgccaucgacgagauuaccaauaaagucaacuccgugaucgaaaagaugaauacgcaguuuacagcuguuggaaaagaguucaaccaccuggaaaagagaauugagaaucugaacaagaaaguggaugacggcuuccucgauaucuggaccuacaaugccgaacugcugguccuccuggagaacgagcggacccuugacuaucaugauagcaaugugaagaaccuguacgaaaaaguccgcucucagcucaagaacaaugccaaagagauugggaacggauguuuugaguucuaucacaagugcgacaauacauguauggaguccgugaagaacggcaccuacgauuauccuaaauacagcgaagaggcuaagcugaauagagaggaaaucgacgggguuaaacuugagucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 187045 - RNA, 1701 nt, Artificial Sequence; identical to SEQ ID NO: 186491
  derived and/or modified sequence opt5 from hemagglutinin__InfluenzaA__ADB89129

SEQ ID NO: 187046 - RNA, 1701 nt, Artificial Sequence; identical to SEQ ID NO: 185693
  derived and/or modified sequence opt5 from hemagglutinin__InfluenzaA__ADB89139

SEQ ID NO: 187047 - RNA, 1701 nt, Artificial Sequence
  derived and/or modified sequence opt5 from hemagglutinin__InfluenzaA__ADB89149
augaaggccauccuggugguccuccuguacaccuucgcuacagccaacgcguauacgcuuugcauuggcuaccacgcuaauaacagcaccgacacaguugauaccgugcuggagaaaaaugugacagucacccauuccgugaaccuccuggaagacaagcacaaugggaaacuuuguaagcugagaggaguugcuccccuccaucugggcaaaugcaacaucgccggguggauucugggaaauccugagugugaaucucucagcacagccuccucuuggagcuauaucguggagaccuccucuagcgauaacggcacgugcuacccgggggacuuuauugauuaugaagaacugcgggagcagcuuuccagcgucucuuccuucgaacgcuuugagaucuuccccaagaccagcucuuggccuaaucacgacuccaacaagggagugacagccgcuuguccccauguuggcgccaagagcuuuuacaagaaucugaucuggcucgugaaaaagggcaacucuuauccuaaacuguccaagagcuacauuaaugauaaggggaaagaaguccuugugcuguggggaauccaccaccccuccaccucugcggaccaacagagccucuaccagaacgccgaugcuuauguguucgucggcacauccagauacagcaagaaauuuaagccugagauugccauccggccgaaaguucgcgggcaggagggaagaaugaauuauuacuggacccugguggaacccggcgacaagauuacguucgaggcuacagggaaccugguggucccucgguaugccuuugcgauggaacgcaacgccggaucuggcaucauuaucuccgauacccccgugcaugacugcaauacaaccugucaaaccccuaaaggcgcuaucaacacaagccuccccuuccagaauauucacccgaucacgauugggaagugcccuaaguacguuaaaucuaccaagcugagacuugccacaggacugcggaacauccccagcauucagucccgcggccucuuuggggcuaucgccggauucaucgagggcggguggaccggaaugguggauggcugguauggcuaccaucaccagaaugaacaagggucuggauacgccgcugaccugaaaagcacacagaacgcgauugacgagaucaccaauaaggucaacuccgugauugagaaaaugaauacgcaguuuacagccguuggcaaggaguucaaccaccuugagaagagaaucgaaaaucugaacaaaaagguggaugacggguuccucgauauuuggaccuauaaugcugagcugcugguccuccuggaaaacgagcggacccuugacuaccaugauagcaaugugaaaaaccuguaugagaagguccgcucucagcucaaaaacaaugccaaggaaaucggaaacggcuguuuugaguucuaccacaagugcgacaauacauguauggaauccgugaaaaacgggaccuaugauuacccuaaguauagcgaggaagccaaacugaauagagaggagaucgacggcguuaaacuugaaucuacacggauuuaccaaauccuggcuauuuacuccacgguggccagcucccucguccuggugguuucucugggagcgaucagcuuuuggaugugcuccaacggcucucuccagugccgcauuuguaucuga

SEQ ID NO: 187048 - RNA, 1701 nt, Artificial Sequence; identical to SEQ ID NO: 186046
  derived and/or modified sequence opt5 from hemagglutinin__InfluenzaA__ADB89150

SEQ ID NO: 187049 - RNA, 1701 nt, Artificial Sequence
  derived and/or modified sequence opt5 from hemagglutinin__InfluenzaA__ADB89221
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagaaccucuaccagaaugcugacgccuacguguucgugggcagcuccagauauagcaagaaauuuaagccugagauugcuauccggccgaaaguccgcgaucaggaggggagaaugaacuacuauuggacacugguugaacccggagacaagauuaccuucgaggccacgggcaaccugguggugccucgguacgcguuugccauggaacgcaaugcugggucuggaaucauuaucuccgauacacccguccaugacugcaacaccacaugucaaaccccuaaaggcgccaucaauaccagccuccccuuccagaacauucacccgaucacaauuggcaagugcccuaaguaugugaaaucuacgaagcugagacuugcuaccgggcugcggaauguucccagcauccagucccgcggacucuuuggcgccauugccggguucaucgagggaggcuggacagggaugguggacggaugguacggcuaucaucaccagaacgaacaaggcucuggguacgcugcggaucugaaaagcacccagaaugccaucgacgagauuacaaacaaggucaauuccgugaucgagaaaaugaacacccaguuuacggcuguuggaaaggaguucaaucaccuugagaagagaauugaaaaccugaauaaaaagguggaugacggcuuccucgauaucuggacauacaacgccgagcugcugguccuccuggaaaaugagcggacccuugacuaucaugauagcaacgugaaaaaccuguacgagaagguccgcucucagcucaaaaauaacgccaaggaaauugggaauggauguuuugaguucuaucacaagugcgacaacaccuguauggaauccgugaaaaauggcacauacgauuauccuaaguacagcgaggaagcuaaacugaacagagaggagaucgacgggguuaaacuugaaucuacccggaucuaucaaauucuggccaucuacuccacaguggcgagcucccucguccuggugguuucucugggcgcuauuagcuuuuggaugugcuccaauggaucucuccagugccgcaucuguauuuga

SEQ ID NO: 187050 - RNA, 1701 nt, Artificial Sequence; identical to SEQ ID NO: 185746
  derived and/or modified sequence opt5 from hemagglutinin__InfluenzaA__ADB89241

SEQ ID NO: 187051 - RNA, 1701 nt, Artificial Sequence; identical to SEQ ID NO: 185693
  derived and/or modified sequence opt5 from hemagglutinin__InfluenzaA__ADB89251

SEQ ID NO: 187052 - RNA, 1701 nt, Artificial Sequence; identical to SEQ ID NO: 186140
  derived and/or modified sequence opt5 from hemagglutinin__InfluenzaA__ADB89261

SEQ ID NO: 187053 - RNA, 1701 nt, Artificial Sequence
  derived and/or modified sequence opt5 from hemagglutinin__InfluenzaA__ADB89271
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucuccccuuccagaauauucacccgaucacaauuggcaagugcccuaaguaugugaaaagcacgaagcugagacuugcuaccgggcugcggaacguucccuccauccagucucgcggacucuuuggcgccauugccggguucaucgagggaggcuggacagggaugguggacggaugguacggcuaucaucaccagaaugaacaaggcagcggguacgcugcggaucugaaauccacccagaacgccaucgacgagauuacaaauaaggucaacagcgugaucgagaaaaugaauacccaguuuacggcuguuggaaaggaguucaaccaccuugagaagagaauugaaaaucugaacaaaaagguggaugacggcuuccucgauaucuggacauacaaugccgagcugcugguccuccuggaaaacgagcggacccuugacuaucaugauucuaaugugaaaaaccuguacgagaagguccgcucccagcucaaaaacaaugccaaggaaauugggaacggauguuuugaguucuaucacaagugcgacaauaccuguaugggcagcgugaaaaacgggacauacgauuauccuaaguacucugaagaggcuaaacugaauagagaagagaucgacggcguuaaacuugaguccacccggaucuaucaaauucuggccaucuacagcacaguggcguccucucucguccuggugguuagccugggagcuauuuccuuuuggaugugcucuaacggcagccuccagugccgcaucuguauuuga

SEQ ID NO: 187054 - RNA, 1701 nt, Artificial Sequence
  derived and/or modified sequence opt5 from hemagglutinin__InfluenzaA__ADB89281
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaucccccuaccuccgccgaucaacagucucucuaccagaacgcugacgccuacguguucgugggcacaagcagauauuccaagaaauuuaagccggagauugcuauccggcccaaaguccgcgggcaggagggaagaaugaauuacuauuggacccugguugaaccuggcgauaagauuacguucgaggccacagggaaccugguggugccccgguacgcguuugccauggaacgcaacgcuggaagcggcaucauuaucucugacaccccuguccacgauugcaauacaaccugucaaacccccaaaggcgccaucaacacaucccucccguuccagaauauucacccuaucacgauugggaagugccccaaguaugugaaaagcaccaagcugagacuugcuacaggacugcggaacguuccuucuauccagagccgcggccucuuuggggccauugccggauucaucgagggcggguggaccggaaugguggacggcugguacggcuaucaucaccagaaugaacaaggguccggauacgcugcggaccugaaaucuacacagaacgccaucgaugagauuaccaauaaggucaacagcgugaucgagaaaaugaauacgcaguuuacagcuguuggcaaggaguucaaccaccuugagaagagaauugaaaaucugaacaaaaagguggacgauggguuccucgacaucuggaccuacaaugccgagcugcugguccuccuggaaaacgagcggacccuugauuaucaugacuccaaugugaaaaaccuguacgagaagguccgcagccagcucaaaaacaaugccaaggaaauuggaaacggcuguuuugaguucuaucacaagugcgauaauacauguauggaaucugugaaaaacgggaccuacgacuaucccaaguacuccgaggaagcuaaacugaauagagaggagaucgauggcguuaaacuugaaagcacacggaucuaucaaauucuggccaucuacucuacgguggcguccagccucguccuggugguuucccugggagcuauuucuuuuuggaugugcagcaacggcucccuccagugccgcaucuguauuuga

SEQ ID NO: 187055 - RNA, 1701 nt, Artificial Sequence; identical to SEQ ID NO: 185693
  derived and/or modified sequence opt5 from hemagglutinin__InfluenzaA__ADB89291

SEQ ID NO: 187056 - RNA, 1701 nt, Artificial Sequence; identical to SEQ ID NO: 185693
  derived and/or modified sequence opt5 from hemagglutinin__InfluenzaA__ADB89301

SEQ ID NO: 187057 - RNA, 1701 nt, Artificial Sequence; identical to SEQ ID NO: 185693
  derived and/or modified sequence opt5 from hemagglutinin__InfluenzaA__ADB89311

SEQ ID NO: 187058 - RNA, 1701 nt, Artificial Sequence
  derived and/or modified sequence opt5 from hemagglutinin__InfluenzaA__ADB89321
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccgaaagcuauauuaaugacaaggggaaggaggugcuuguccuguggggaauccaccaccccuccaccucugccgaucaacagagccucuaccagaacgcugacgccuacguguucgugggcacauccaaauauagcaagaaauuuaagccugagauugcuaucagaccgaaaguccgggaucaggaagggcgcaugaauuacuauuggacccugguugagcccggagacaagauuacguucgaagccacaggcaaccugguggugccuagauacgcguuugccauggagcggaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugcgccuugcuacagggcugagaaacguucccagcauccagucccggggacucuuuggcgccauugccggguucaucgaaggaggcuggaccgggaugguggacggaugguacggcuaucaucaccagaaugagcaaggcucuggguacgcugcggaucugaaaagcacacagaacgccaucgacgagauuaccaauaaggucaacuccgugaucgaaaagaugaauacgcaguuuacagcuguuggaaaggaguucaaccaccuugaaaagcgcauugagaaucugaacaaaaagguggaugacggcuuccucgauaucuggaccuacaaugccgaacugcugguccuccuggagaacgagagaacccuugacuaucaugauagcaaugugaaaaaccuguacgaaaagguccggucucagcucaaaaacaaugccaaggagauugggaacggauguuuugaguucuaucacaagugcgacaauacauguauggaguccgugaaaaacggcaccuacgauuauccuaaguacagcgaagaggcuaaacugaaucgcgaggaaaucgacgggguuaaacuugagucuacaagaaucuaucaaauucuggccaucuacuccacgguggcgagcucccucguccuggugguuucucugggcgcuauuagcuuuuggaugugcuccaacggaucucuccagugccggaucuguauuuga

SEQ ID NO: 187059 - RNA, 1701 nt, Artificial Sequence
  derived and/or modified sequence opt5 from hemagglutinin__InfluenzaA__ADB89331
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcaaguauucuaaaaaguuuaaaccugagauugcuaucagaccgaagguccgggaucaggaggggcgcaugaauuacuauuggacacugguugaacccggagacaaaauuaccuucgaggccacgggcaaccugguggugccuagauacgcguuugccauggaacggaacgcuggguccggaaucauuaucagcgauacacccguccaugacugcaauaccacaugucaaaccccuaagggcgccaucaacaccucucuccccuuccagaauauucacccgaucacaauuggcaagugcccuaaauauguuaagagcacgaaacugcgccuugcuaccgggcugagaaacgugcccuccauccagucucggggacucuuuggcgccauugccggguucaucgagggaggcuggacagggaugguggacggaugguacggcuaucaucaccagaaugaacaaggcagcggguacgcugcggaucugaaguccacccagaacgccaucgacgagauuacaaauaaagucaacagcgugaucgagaagaugaauacccaguuuacggcuguuggaaaggaguucaaccaccuugagaaacgcauugaaaaucugaacaagaaaguggaugacggcuuccucgauaucuggacauacaaugccgagcugcugguccuccuggaaaacgagagaacccuugacuaucaugauucuaaugugaagaaccuguacgagaaaguccggucccagcucaagaacaaugccaaggaaauugggaacggauguuuugaguucuaucacaaaugcgacaauaccuguauggaaagcgugaagaacggcacauacgauuauccuaaauacucugaggaagcuaagcugaaucgcgaggagaucgacgggguuaaacuugaauccaccagaguguaucaaauccuggccauuuacagcacagucgcguccucucucgugcugguugugagccugggcgcuaucuccuuuuggaugugcucuaacggaagccuccagugccggauuuguaucuga

SEQ ID NO: 187060 - RNA, 1701 nt, Artificial Sequence; identical to SEQ ID NO: 185693
  derived and/or modified sequence opt5 from hemagglutinin__InfluenzaA__ADB89341

SEQ ID NO: 187061 - RNA, 1701 nt, Artificial Sequence; identical to SEQ ID NO: 185693
  derived and/or modified sequence opt5 from hemagglutinin__InfluenzaA__ADB89351

SEQ ID NO: 187062 - RNA, 1701 nt, Artificial Sequence; identical to SEQ ID NO: 185693
  derived and/or modified sequence opt5 from hemagglutinin__InfluenzaA__ADB89361

SEQ ID NO: 187063 - RNA, 1701 nt, Artificial Sequence; identical to SEQ ID NO: 185693
  derived and/or modified sequence opt5 from hemagglutinin__InfluenzaA__ADB89371

SEQ ID NO: 187064 - RNA, 1701 nt, Artificial Sequence; identical to SEQ ID NO: 186438
  derived and/or modified sequence opt5 from hemagglutinin__InfluenzaA__ADB89381

SEQ ID NO: 187065 - RNA, 1701 nt, Artificial Sequence
  derived and/or modified sequence opt5 from hemagglutinin__InfluenzaA__ADB89391
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuugucugcaugccggcgcgaaaucuuuuuauaagaaucucaucuggcugguuaaaaagggcaacagcuaccccaaacuuuccaagagcuauauuaaugacaaggggaaagaagugcugguccucuggggaauccaccacccuuccaccucugccgaucaacagagccuguaccagaacgcugacgccuacguguucgugggcacauccagauauagcaagaaauuuaagcccgagauugcuauccggccuaaaguccgcgaucaggaggggagaaugaauuacuauuggacccugguugaaccgggagacaagauuacguucgaggccacaggcaaccucguggugccccgguacgcguuugccauggaacgcaacgcugggucuggaaucauuaucuccgauaccccuguccaugacugcaauacaaccugucaaacccccaaaggcgccaucaacacaagccugccuuuccagaauauucaccccaucacgauuggcaagugcccgaaguaugugaaaucuaccaaacuuagacuggcuacagggcuccggaacguuccuagcauccagucccgcggacuguuuggcgccauugccggguucaucgagggaggcuggaccgggaugaucgacggaugguacggcuaucaucaccagaaugaacaaggcucuggguacgcugcggaucuuaagagcacacagaacgccauugacgagaucaccaauaaggugaacuccgucauugagaaaaugaauacgcaguuuacagcugugggaaaggaguucaaccaccuggagaagagaaucgaaaaucucaacaaaaagguugaugacggcuuccuggauauuuggaccuacaaugccgagcugcucgugcugcuugaaaacgagcggacccuggacuaucaugauagcaaugucaaaaaccucuacgagaaggugcgcucucagcugaaaaacaaugccaaggaaaucgggaacggauguuuugaguucuaucacaagugcgacaauacauguauggaauccgucaaaaacggcaccuacgauuaucccaaguacagcgaggaagcuaaacuuaauagagaggagaucgacggggugaagcuggaaucuacacggauuuaucaaauccucgccauuuacuccacgguugcgagcucccuggugcuggucgugucucucggcgcuaucagcuuuuggaugugcuccaacggaucucugcagugccgcauuuguaucuga

SEQ ID NO: 187066 - RNA, 1701 nt, Artificial Sequence; identical to SEQ ID NO: 185680
  derived and/or modified sequence opt5 from hemagglutinin__InfluenzaA__ADB89401

SEQ ID NO: 187067 - RNA, 1701 nt, Artificial Sequence; identical to SEQ ID NO: 185693
  derived and/or modified sequence opt5 from hemagglutinin__InfluenzaA__ADB89411

SEQ ID NO: 187068 - RNA, 1701 nt, Artificial Sequence; identical to SEQ ID NO: 186140
  derived and/or modified sequence opt5 from hemagglutinin__InfluenzaA__ADB89431

SEQ ID NO: 187069 - RNA, 1701 nt, Artificial Sequence; identical to SEQ ID NO: 186046
  derived and/or modified sequence opt5 from hemagglutinin__InfluenzaA__ADB89441

SEQ ID NO: 187070 - RNA, 1701 nt, Artificial Sequence; identical to SEQ ID NO: 185693
  derived and/or modified sequence opt5 from hemagglutinin__InfluenzaA__ADB89461

SEQ ID NO: 187071 - RNA, 1701 nt, Artificial Sequence; identical to SEQ ID NO: 186140
  derived and/or modified sequence opt5 from hemagglutinin__InfluenzaA__ADB89481

SEQ ID NO: 187072 - RNA, 1701 nt, Artificial Sequence; identical to SEQ ID NO: 186140
  derived and/or modified sequence opt5 from hemagglutinin__InfluenzaA__ADB89491

SEQ ID NO: 187073 - RNA, 1701 nt, Artificial Sequence
  derived and/or modified sequence opt5 from hemagglutinin__InfluenzaA__ADB89501
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucuccccuuccagaauauucacccgaucacaauuggcaagugcccuaaguaugugaaaagcacgaagcugagacuugcuaccgggcugcggaacguucccuccauccagucucgcggacucuuuggcgccauugccggguucaucgagggaggcuggacagggcugguggacggaugguacggcuaucaucaccagaaugaacaaggcagcggguacgcugcggaucuuaaauccacccagaacgccaucgacgagauuacaaauaaggucaacagcgugaucgagaaaaugaauacccaguuuacggcuguuggaaaggaguucaaccaccuggagaagagaauugaaaaucucaacaaaaagguggaugacggcuuccuggauaucuggacauacaaugccgagcugcucguccugcuugaaaacgagcggacccuggacuaucaugauucuaaugugaaaaaccucuacgagaagguccgcucccagcugaaaaacaaugccaaggaaauugggaacggauguuuugaguucuaucacaagugcgacaauaccuguauggaaagcgugaaaaacggcacauacgauuauccuaaguacucugaggaagcuaaacuuaauagagaggagaucgacgggguuaagcuggaauccacccggaucuaucaaauucucgccaucuacagcacaguggcguccucucugguccuggugguuagccucggcgcuauuuccuuuuggaugugcucuaacggaagccugcagugccgcaucuguauuuga

SEQ ID NO: 187074 - RNA, 1701 nt, Artificial Sequence; identical to SEQ ID NO: 185693
  derived and/or modified sequence opt5 from hemagglutinin__InfluenzaA__ADB89511

SEQ ID NO: 187075 - RNA, 1701 nt, Artificial Sequence; identical to SEQ ID NO: 186140
  derived and/or modified sequence opt5 from hemagglutinin__InfluenzaA__ADB89531

SEQ ID NO: 187076 - RNA, 1701 nt, Artificial Sequence; identical to SEQ ID NO: 186140
  derived and/or modified sequence opt5 from hemagglutinin__InfluenzaA__ADB89541

SEQ ID NO: 187077 - RNA, 1701 nt, Artificial Sequence; identical to SEQ ID NO: 186853
  derived and/or modified sequence opt5 from hemagglutinin__InfluenzaA__ADB89551

SEQ ID NO: 187078 - RNA, 1701 nt, Artificial Sequence; identical to SEQ ID NO: 185693
  derived and/or modified sequence opt5 from hemagglutinin__InfluenzaA__ADB89561

SEQ ID NO: 187079 - RNA, 1701 nt, Artificial Sequence; identical to SEQ ID NO: 185693
  derived and/or modified sequence opt5 from hemagglutinin__InfluenzaA__ADB89571

SEQ ID NO: 187080 - RNA, 1701 nt, Artificial Sequence; identical to SEQ ID NO: 185693
  derived and/or modified sequence opt5 from hemagglutinin__InfluenzaA__ADB89581

SEQ ID NO: 187081 - RNA, 1701 nt, Artificial Sequence
  derived and/or modified sequence opt5 from hemagglutinin__InfluenzaA__ADB89591
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauugggcccugguugagcccggagauaagauuaccuucgaagcgacgggcaaccugguggugccucgguacgccuuugcuauggagcgcaacgccgggucuggaaucauuaucuccgacacacccguccaugauugcaauaccacaugucaaaccccuaaaggcgcuaucaacaccagccuccccuuccagaauauucacucuaucacaauuggcaagugcccgaaguaugugaaaagcacgaagcugagacuugccaccgggcugcggaacguuccuuccauccagucucgcggacucuuuggcgccauugcuggguucaucgaaggaggcuggacagggaugguggacggaugguacggcuaucaucaccagaaugagcaaggcagcggguacgcggccgaccugaaauccacccagaacgcuaucgaugagauuacaaauaaggucaacagcgugaucgaaaagaugaauacccaguuuacggccguuggaaaggaguucaaccaccuugaaaagagaauugagaaucugaacaaaaagguggacgauggcuuccucgacaucuggacauacaaugccgaacugcugguccuccuggagaacgagcggacccuugauuaucaugacucuaaugugaaaaaccuguacgaaaagguccgcucccagcucaaaaacaaugcuaaggagauugggaacggauguuuugaguucuaucacaagugcgauaauaccuguauggagagcgugaaaaacggcacauacgacuaucccaaguacucugaagaggccaaacugaauagagaggaaaucgaugggguuaaacuugaguccacccggaucuaucaaauucuggcgaucuacagcacaguggcuuccucucucguccuggugguuagccugggcgccauuuccuuuuggaugugcucuaacggaagccuccagugccgcaucuguauuuga

SEQ ID NO: 187082 - RNA, 1701 nt, Artificial Sequence
  derived and/or modified sequence opt5 from hemagglutinin__InfluenzaA__ADB89601
augaaggccaucauugugguccugcucuacaccuucgcuacagccaacgcggacacgcugugcaucggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaaaugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggaacauccagauauagcaagaaauuuaagccugagaucgcuauucggccgaaaguccgcgaucaggaggggagaaugaauuacuauuggacccucguugaacccggagacaagaucacguucgaggccacaggcaaccugguggugccucgguacgcguuugccauggaacgcaacgcugggucuggaauuaucaucuccgauacccccguccaugacugcaauacaaccugucaaaccccuaaaggcgccauuaacacaagccugcccuuccagaauauccacccgauuacgaucggcaagugcccuaaguaugugaaaucuaccaagcucagacuggcuacagggcuucggaacguucccagcauucagucccgcggacuguuuggcgccaucgccggguucaucgagggaggcuggaccgggaugguggacggaugguacggcuaucaucaccagaaugaacaaggcucuggguacgcugcggaucucaaaagcacacagaacgccauugacaagaucaccaauaaagucaacuccgugauugagaagaugaauacgcaguuuacagcuguuggaaaggaguucaaccaccuggaaaagagaaucgagaaucuuaacaagaaaguggaugacggcuuccuggauauuuggaccuacaaugccgaacuccugguccugcucgagaacgaacggacccuggacuaucaugauagcaaugugaagaaccuuuacgagaaaguccgcucucagcugaagaacaaugccaaggagaucgggaacggauguuuugaguucuaucacaaaugcgacaauacauguauggaguccgugaagaacggcaccuacgauuauccuaaauacagcgaagaggcuaagcucaauagagaagagaucgacgggguuaaacuggagucuacacggauuuaucaaauccuuacgauuuacuccaccguggccagcucccugguccucgugguuucucugggcgcgaucagcuuuuggaugugcuccaacggaucucugcagugccgcauuuguaucuga

SEQ ID NO: 187083 - RNA, 1701 nt, Artificial Sequence; identical to SEQ ID NO: 186857
  derived and/or modified sequence opt5 from hemagglutinin__InfluenzaA__ADB89611

SEQ ID NO: 187084 - RNA, 1701 nt, Artificial Sequence; identical to SEQ ID NO: 186857
  derived and/or modified sequence opt5 from hemagglutinin__InfluenzaA__ADB89621

SEQ ID NO: 187085 - RNA, 1701 nt, Artificial Sequence
  derived and/or modified sequence opt5 from hemagglutinin__InfluenzaA__ADB89631
augaaggccauccugauugugcuccuguacaccuucgcuacagccaacgcggacacgcuuugcaucggcuaucacgcuaauaacagcaccgauacagucgacaccguucuggagaagaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccaagagcuauaucaaugacaaggggaaagaaguucuugugcuguggggcauucaccaccccuccaccucugccgaucaacagagccucuaccagaacgcugacgccuacgucuucgugggaacauccagauauagcaagaaauuuaagccugagaucgcuauucggccgaaagugcgcgaucaggaggggagaaugaauuacuauuggacccuggucgaacccggagacaagaucacguucgaggccacaggcaaccugguugugccucgguacgcguuugccauggaacgcaacgcugggucuggaauuaucaucuccgauacccccgugcaugacugcaauacaaccugucaaaccccuaaaggcgccauuaacacaagccuccccuuccagaauauccacccgauuacgaucggcaagugcccuaaguaugucaaaucuaccaagcugagacuugcuacagggcugcggaacauucccagcauccagucccgcggacucuuuggcgccaucgccggguucauugagggaggcuggaccgggaugguggacggaugguacggcuaucaucaccagaaugaacaaggcucuggguacgcugcggaucugaaaagcacacagaacgccaucgacgagauuaccaauaagguuaacuccgugaucgagaaaaugaauacgcaguuuacagcugucggaaaggaguucaaccaccuugagaagagaauugaaaaucugaacaaaaagguggaugacggcuuccucgauaucuggaccuacaaugccgagcugcugguucuccuggaaaacgagcggacccuugacuaucaugauagcaaugugaaaaaccuguacgagaagguccgcucucagcucaaaaacaaugccaaggaaaucgggaacggauguuuugaguucuaucacaagugcgacaauacauguauggaauccgugaaaaacggcaccuacgauuauccuaaguacagcgaggaagcuaaacugaauagagaggagauugacggggucaaacuugaaucuacacggaucuaucaaauucuggccaucuacuccacgguggcgagcucccucguucugguggucucucugggcgcuauuagcuuuuggaugugcuccaacggaucucuccagugccgcaucuguauuuga

SEQ ID NO: 187086 - RNA, 1701 nt, Artificial Sequence; identical to SEQ ID NO: 186857
  derived and/or modified sequence opt5 from hemagglutinin__InfluenzaA__ADB89641

SEQ ID NO: 187087 - RNA, 1701 nt, Artificial Sequence; identical to SEQ ID NO: 185693
  derived and/or modified sequence opt5 from hemagglutinin__InfluenzaA__ADB89651

SEQ ID NO: 187088 - RNA, 1701 nt, Artificial Sequence; identical to SEQ ID NO: 185693
  derived and/or modified sequence opt5 from hemagglutinin__InfluenzaA__ADB89661

SEQ ID NO: 187089 - RNA, 1701 nt, Artificial Sequence; identical to SEQ ID NO: 186857
  derived and/or modified sequence opt5 from hemagglutinin__InfluenzaA__ADB89671

SEQ ID NO: 187090 - RNA, 1701 nt, Artificial Sequence; identical to SEQ ID NO: 185693
  derived and/or modified sequence opt5 from hemagglutinin__InfluenzaA__ADB89681

SEQ ID NO: 187091 - RNA, 1701 nt, Artificial Sequence; identical to SEQ ID NO: 185693
  derived and/or modified sequence opt5 from hemagglutinin__InfluenzaA__ADB89691

SEQ ID NO: 187092 - RNA, 1701 nt, Artificial Sequence; identical to SEQ ID NO: 186795
  derived and/or modified sequence opt5 from hemagglutinin__InfluenzaA__ADB89701

SEQ ID NO: 187093 - RNA, 1701 nt, Artificial Sequence
  derived and/or modified sequence opt5 from hemagglutinin__InfluenzaA__ADB89711
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcggcaacgggacgugcuauccgggagacuuuauugauuacgaagaacugcgggagcagcuuuccagcgucucuuccuucgaacgcuuugagaucuuccccaagaccagcucuuggccuaaucacgacuccaacaagggcgugacagccgcuuguccccaugccggcgcgaaaucuuuuuauaagaaucugaucuggcucguuaaaaaggggaacagcuacccuaaacuguccaagagcuauauuaaugauaagggaaaagaagugcuuguccuguggggcauccaccaccccuccaccucugccgaccaacagagccucuaccagaacgcugaugccuacguguucguggggacauccagauauagcaagaaauuuaagccugagauugcuauccggccgaaaguccgcgaccaggagggaagaaugaauuaccauuggacccugguugaacccggcgauaagauuacguucgaggccacagggaaccugguggugccucgguaugcguuugccauggaacgcaacgcuggaucuggcaucauuaucuccgacacccccguccacgauugcaauacaaccugucaaaccccuaaaggcgccaucaacacaagccuccccuuccagaauauucauccgaucacgauugggaagugcccuaaguacgugaaaucuaccaagcugagacuugcuacaggacugcggaacguucccagcauccagucccgcggccucuuuggggccauugccggauucaucgagggcggguggaccggaaugguggacggcugguauggcuaccaccaccagaaugaacaagggucuggauaugcugcggaccugaaaagcacacagaacgccaucgaugagauuaccaauaaggucaacuccgugaucgagaaaaugaauacgcaguuuacagcuguuggcaaggaguucaaccaucuugagaagagaauugaaaaucugaacaaaaagguggacgauggguuccucgacaucuggaccuacaaugccgagcugcugguccuccuggaaaacgagcggacccuugauuaccacgacagcaaugugaaaaaccuguaugagaagguccgcucucagcucaaaaacaaugccaaggaaauuggaaacggcuguuuugaguucuaccauaagugcgauaauacauguauggaauccgugaaaaacgggaccuaugacuacccuaaguauagcgaggaagcuaaacugaauagagaggagaucgauggcguuaaacuugaaucuacacggaucuaccaaauucuggccaucuauuccacgguggcgagcucccucguccuggugguuucucugggagcuauuagcuuuuggaugugcuccaacggcucucuccagugccgcaucuguauuuga

SEQ ID NO: 187094 - RNA, 1701 nt, Artificial Sequence
  derived and/or modified sequence opt5 from hemagglutinin__InfluenzaA__ADB89721
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuugacaacgaaucuuucaauuggaccggagugacacagaacggcaccuccagcgcuugcauccgcagaucuaaaaauuccuuuuucagccggcugaacuggcucacacaucugaauuuuaaauauccugcccuuaacgucaccaugcccaauaacgagcaguucgauaagcuguaccucuggggcgugcaccauccugggacggacaaagaucagauuuuucuguaugcgcaagccucuggacgcaucacaguuuccaccaagagaagccagcagacagugauuccgaacaucggcucccggccccgcgucagaaauauuccuucucggaucagcaucuacuggaccauugugaaacccggggacauccugcucauuaacuccaccggaaaucugaucgcuccucgcggcuacuucaagauucagagcgggaagucuuccaucaugagaagcgacgcccccaucggaaaauguaacucugagugcauuacaccgaauggcagcaucccuaacgauaagcccuuucaaaaugugaaccggauuacguauggcgcuuguccucgcuacgucaaacagaauacccuuaagcuggccacagggaugagaaacguucccgaaaaacagacccggggaaucuucggcgcgauugccggguuuaucgagaauggaugggaaggcaugguggacgggugguauggauuccgccaccaaaacuccgagggcagaggccaggcugccgaucucaagucuacacaggcugccaucgaccagauuaaugggaaacugaaccggcuuaucggaaagaccaaugagaaguuccaccaaauugaaaaagaguuuagcgaaguggagggcagaauccaggaucuggaaaaguacgucgaggacacgaaaauugaucucugguccuauaacgccgagcugcugguggcucucgaaaaccagcauacaaucgaccugaccgauagcgagaugaauaaacuuuucgaaaagaccaagaagcagcugcgcgagaacgcggaagacauggggaauggaugcuuuaagauuuaccacaagugugauaacgccugcaucggcucuauccggaaugggacauaugaccaugacguuuacagagaugaggcucucaacaaucgcuuccaaauuaaaggcguggagcugaaguccggauacaaagacuggauccuuuggauuagcuuugccaucucuugcuuccugcucugugucgcccugcugggcuuuauuaugugggcuugccagaaggggaacauccgguguaauaucugcauuuga

SEQ ID NO: 187095 - RNA, 1701 nt, Artificial Sequence
  derived and/or modified sequence opt5 from hemagglutinin__InfluenzaA__ADB90360
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcaacaauggcacgugcuauccgggggacuuuauugauuacgaagaacugcgggagcagcuuuccagcgucucuuccuucgaacgcuuugagaucuuccccaagaccagcucuuggccuaaccacgaccccaauaagggagugacagccgcuuguccucaugccggcgcgaaauccuuuuauaagaaccugaucuggcucguuaaaaagggcaauagcuaccccaaacugucuaaguccuauauuaacgauaaggggaaagaagugcuuguccuguggggaauccaccacccuagcaccuccgccgaccaacagucucucuaccagaaugcugaugccuacguguucgugggcacaagcagauauuccaagaaauuuaagccggagauugcuauccggcccaaaguccgcgggcaggagggaagaaugaacuacuauuggacccugguugaaccuggcgacaagauuacguucgaggccacagggaaccugguggugccccgguacgcguuugccauggaacgcaaugcuggaagcggcaucauuaucucugauaccccuguccaugacugcaacacaaccugucaaacccccaaaggcgccaucaauacaucccucccguuccagaacauucacccuaucacgauugggaagugccccaaguaugugaaaagcaccaagcugagacuugcuacaggacugcggaauaucccuucuauucagagccgcggccucuuuggggccaucgccggauucaucgagggcggguggaccggaaugguugauggcugguacggcuaucaucaccagaacgaacaaggguccggauacgcugcggaccugaaaucuacacagaaugccauugacgagaucaccaacaaggugaauagcgucauugagaaaaugaacacgcaguuuacagcugugggcaaggaguucaaucaccuugagaagagaaucgaaaaccugaauaaaaagguugaugacggguuccucgauauuuggaccuacaacgccgagcugcuggugcuccuggaaaaugagcggacccuugacuaucaugauuccaacgucaaaaaccuguacgagaaggugcgcagccagcucaaaaauaacgccaaggaaaucggaaauggcuguuuugaguucuaucacaagugcgacaacacauguauggaaucugucaaaaaugggaccuacgauuaucccaaguacuccgaggaagcuaaacugaacagagaggagaucgacggcgugaaacuugaaagcacacggauuuaucaaauccuggccauuuacucuacgguugcguccagccucgugcuggucgugucccugggagcuaucucuuuuuggaugugcagcaauggcucccuccagugccgcauuuguaucuga

SEQ ID NO: 187096 - RNA, 1701 nt, Artificial Sequence
  derived and/or modified sequence opt5 from hemagglutinin__InfluenzaA__ADB90370
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcagauauuccaagaaauuuaagccggagauugcuauccggcccaaaguccgcgggcaggagggaagaaugaauuacuauuggacccugguugaaccuggcgauaagauuacguucgaggccacagggaaccugguggugccccgguacgcguuugccauggaacgcaacgcuggaagcggcaucauuaucucugacaccccuguccaugauugcaauacaaccugucaaacccccaaaggcgccaucaacacaucccucccguuccagaauauucacccuaucacgauugggaagugccccaaguaugugaaaagcaccaagcugagacuugcuacaggacugcggaacguuccuucuauccagagccgcggccucuuuggggccauugccggauucaucgagggcggguggaccggaaugguggacggcugguacggcuaucaucaccagaaugaacaaggguccggauacgcugcggaccugaaaucuacacagaacgccaucgaugagauuaccaauaaggucaacagcgugaucgagaaaaugaauacgcaguuuacagcuguuggcaaggaguucaaccaccuugagaagagaauugaaaaucugaacaaaaagguggacgauggguuccucgacaucuggaccuacaaugccgagcugcugguccuccuggaaaacgagcggacccuugauuaucaugacuccaaugugaaaaaccuguacgagaagguccgcagccagcucaaaaacaaugccaaggaaauuggaaacggcuguuuugaguucuaucacaagugcgauaauacauguauggaaucugugaaaaacgggaccuacgacuaucccaaguacuccgaggaagcuaaacugaauagagaggagaucgauggcguuaaacuugaaagcacacggaucuaucaaauucuggccaucuacucuacgguggcguccagccucguccuggugguuucccugggagcuauuucuuuuuggaugugcagcaacggcucccuccagugccgcaucuguauuuga

SEQ ID NO: 187097 - RNA, 1701 nt, Artificial Sequence; identical to SEQ ID NO: 186612
  derived and/or modified sequence opt5 from hemagglutinin__InfluenzaA__ADB90414

SEQ ID NO: 187098 - RNA, 1701 nt, Artificial Sequence; identical to SEQ ID NO: 186140
  derived and/or modified sequence opt5 from hemagglutinin__InfluenzaA__ADC32409

SEQ ID NO: 187099 - RNA, 1701 nt, Artificial Sequence
  derived and/or modified sequence opt5 from hemagglutinin__InfluenzaA__ADC32410
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagaaaacccuugacuaucaugauagcaaugugaagaaccuguacgagaaaguccggucucagcucaagaacaaugccaaggaaauugggaacggauguuuugaguucuaucacaaaugcgacaauacauguauggaauccgugaagaacggcaccuacgauuauccuaaauacagcgaggaagcuaagcugaaucgcgaggagaucgacgggguuaaacuugaaucuacaagaaucuaucaaauucuggccaucuacuccacgguggcgagcucccucguccuggugguuucucugggcgcuauuagcuuuuggaugugcuccaacggaucucuccagugccggaucuguauuuga

SEQ ID NO: 187100 - RNA, 1701 nt, Artificial Sequence
  derived and/or modified sequence opt5 from hemagglutinin__InfluenzaA__ADC32411
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaggaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccagaauauucacucuaucacgauuggcaagugcccgaaguaugugaaaagcaccaagcugagacuugcuacagggcugcggaacguuccuuccauccagucucgcggacucuuuggcgccauugccggguucaucgaaggaggcuggaccgggaugguggacggaugguacggcuaucaucaccagaaugagcaaggcagcggguacgcugcggaccugaaauccacacagaacgccaucgaugagauuaccaauaaggucaacagcgugaucgaaaagaugaauacgcaguuuacagcuguuggaaaggaguucaaccaccuugccaagagaauugaaaaucugaacaaaaagguggacgauggcuuccucgacaucuggaccuacaaugccgagcugcugguccuccuggaaaacgagcggacccuugauuaucaugacucuaaugugaaaaaccuguacgagaagguccgcucccagcucaaaaacaaugcuaaggaaauugggaacggauguuuugaguucuaucacaagugcgauaauacauguauggaaagcgugaaaaacggcaccuacgacuaucccaaguacucugaggaagccaaacugaauagagaggagaucgaugggguuaaacuugaauccacacggaucuaucaaauucuggcgaucuacagcacgguggcuuccucucucguccuggugguuagccugggcgccauuuccuuuuggaugugcucuaacggaagccuccagugccgcaucuguauuuga

SEQ ID NO: 187101 - RNA, 1701 nt, Artificial Sequence; identical to SEQ ID NO: 186046
  derived and/or modified sequence opt5 from hemagglutinin__InfluenzaA__ADC32412

SEQ ID NO: 187102 - RNA, 1701 nt, Artificial Sequence; identical to SEQ ID NO: 185693
  derived and/or modified sequence opt5 from hemagglutinin__InfluenzaA__ADC32413

SEQ ID NO: 187103 - RNA, 1701 nt, Artificial Sequence; identical to SEQ ID NO: 186140
  derived and/or modified sequence opt5 from hemagglutinin__InfluenzaA__ADC32414

SEQ ID NO: 187104 - RNA, 1701 nt, Artificial Sequence; identical to SEQ ID NO: 186140
  derived and/or modified sequence opt5 from hemagglutinin__InfluenzaA__ADC32415

SEQ ID NO: 187105 - RNA, 1701 nt, Artificial Sequence; identical to SEQ ID NO: 186140
  derived and/or modified sequence opt5 from hemagglutinin__InfluenzaA__ADC32416

SEQ ID NO: 187106 - RNA, 1701 nt, Artificial Sequence
  derived and/or modified sequence opt5 from hemagglutinin__InfluenzaA__ADC32417
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaauacaagcacaaugggaaacuuuguaagcugagaggaguugcuccccuccaucugggcaaaugcaacaucgccggguggauucugggaaauccugagugugaaucucucagcacagccuccucuuggagcuauaucguggagaccuccucuagcgauaacggcacgugcuacccgggggacuuuauugauuaugaagaacugcgggagcagcuuuccagcgucucuuccuucgaacgcuuugagaucuuccccaagaccagcucuuggccuaaucacgacuccaacaagggagugacagccgcuuguccccaugccggcgcgaaaucuuuuuacaagaaucugaucuggcucguuaaaaagggcaacagcuauccuaaacuguccaagagcuacauuaaugauaaggggaaagaagugcuuguccuguggggaauccaccaccccuccaccucugccgaccaacagagccucuaccagaacgcugaugccuauguguucgugggcacauccagauacagcaagaaauuuaagccugagauugcuauccggccgaaaguccgcgagcaggaagggagaaugaauuauuacuggacccugguugagcccggagacaagauuacguucgaagccacaggcaaccugguggugccucgguaugcguuugccauggagcgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguacgugaaaucuaccaagcugagacuugcuacagggcugcggaacguucccagcauccagucccgcggacucuuuggcgccauugccggguucaucgaaggaggcuggaccgggaugguggauggaugguauggcuaccaucaccagaaugagcaaggcucuggguacgcugcggaccugaaaagcacacagaacgccaucgacgagauuaccaauaaggucaacuccgugaucgaaaagaugaauacgcaguuuacagcuguuggaaaggaguucaaccaccuugaaaagagaauugagaaucugaacaaaaagguggaugacggcuuccucgauaucuggaccuauaaugccgaacugcugguccuccuggagaacgagcggacccuugacuaccaugauagcaaugugaaaaaccuguaugaaaagguccgcucucagcucaaaaacaaugccaaggagauugggaacggauguuuugaguucuaccacaagugcaauaacacauguauggaguccgugaaaaauggcaccuaugacuacccuaaguauagcgaagaggcuaaacugaacagagaggaaaucgaugggguuaaacuugagucuacacggaucuaccaaauucuggccaucuacuccacgguggcgagcucccucguccuggugguuucucugggcgcuauuagcuuuuggaugugcuccaauggaucucuccagugccgcaucuguauuuga

SEQ ID NO: 187107 - RNA, 1701 nt, Artificial Sequence; identical to SEQ ID NO: 186140
  derived and/or modified sequence opt5 from hemagglutinin__InfluenzaA__ADC32418

SEQ ID NO: 187108 - RNA, 1701 nt, Artificial Sequence
  derived and/or modified sequence opt5 from hemagglutinin__InfluenzaA__ADC32419
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccagaauauucacucuaucacgauuggcaagugcccgaaguaugugaaaagcaccaagcugagacuugcuacagggcugcggaacguuccuuccauccagucucgcggacucuuuggcgccauugccggguucaucgaaggaggcuggaccgggaugguggacggaugguuuggcuaccaucaccagaaugaccaaggcagcgcuuaugcggccgaucugaaauccacacagaacgcuaucgacgagauuaccaauaaggucaacagcgugaucgagaaaaugaauacgcaguucacagccguugggaaggaguucaaccaccuugagaagagaauugaaaaucugaacaaaaagguggaugacggauuucucgauaucuggaccuacaaugccgagcugcugguccuccuggaaaacgagcggacccuugacuaccaugauucuaaugugaaaaaccuguaugagaagguccgcucccagcucaaaaacaaugcuaaggaaauuggcaacggguguuucgaguuuuaccacaagugcgacaauacauguauggaaagcgugaaaaacggaaccuaugauuaccccaaguauucugaggaagccaaacugaauagagaggagaucgacggcguuaaacuugaauccacacggaucuaccaaauucuggcgaucuauagcacgguggcuuccucucucguccuggugguuagccugggggccauuuccuucuggaugugcucuaacggcagccuccagugccgcaucuguauuuga

SEQ ID NO: 187109 - RNA, 1701 nt, Artificial Sequence; identical to SEQ ID NO: 186140
  derived and/or modified sequence opt5 from hemagglutinin__InfluenzaA__ADC32420

SEQ ID NO: 187110 - RNA, 1701 nt, Artificial Sequence; identical to SEQ ID NO: 186140
  derived and/or modified sequence opt5 from hemagglutinin__InfluenzaA__ADC32421

SEQ ID NO: 187111 - RNA, 1701 nt, Artificial Sequence
  derived and/or modified sequence opt5 from hemagglutinin__InfluenzaA__ADC32422
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugauggugccucgguacgcguuugccauggagcgcaacgcugggucuggaaucauuaucuccgacacccccgugcaugauugcaauacaaccugucaaaccccuaaaggcgccaucaacacaagccuccccuuccagaauauucacucuaucacgauuggcaagugcccgaaguaugucaaaagcaccaagcugagacuugcuacagggcugcggaacgugccuuccauccagucucgcggacucuuuggcgccauugccggguucaucgaaggaggcuggaccgggaugguugacggaugguacggcuaucaucaccagaaugagcaaggcagcggguacgcugcggaccugaaauccacacagaacgccaucgaugagauuaccaauaaggugaacagcgucaucgaaaagaugaauacgcaguuuacagcugugggaaaggaguucaaccaccuugaaaagagaauugagaaucugaacaaaaagguugacgauggcuuccucgacaucuggaccuacaaugccgaacugcuggugcuccuggagaacgagcggacccuugauuaucaugacucuaaugucaaaaaccuguacgaaaaggugcgcucccagcucaaaaacaaugccaaggagauugggaacggauguuuugaguucuaucacaagugcgauaauacauguauggagagcgucaaaaacggcaccuacgacuaucccaaguacucugaagaggcuaaacugaauagagaggaaaucgauggggugaaacuugaguccacacggaucuaucaaauucuggccaucuacagcacgguugcguccucucucgugcuggucgugagccugggcgcuauuuccuuuuggaugugcucuaacggaagccuccagugccgcaucuguauuuga

SEQ ID NO: 187112 - RNA, 1701 nt, Artificial Sequence
  derived and/or modified sequence opt5 from hemagglutinin__InfluenzaA__ADC32423
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccagaauauucacucuaucacgauuggcaagugcccgaaguaugugaaaagcaccaagcugagacuugcuacagggcugcggaacguuccuuccauccagucucgcggacucuuuggcgccauugccggguucaucgaaggaggcuggaccgggaugguggacggaugguacggcuaucaucaccagaaugagcaaggcagcggguacgcugcggaccugaaauccacacagaacgccaucgaugagauuaccaauaaggucaacagcgugaucgaaaagaugaauacgcaguuuacagcuguuggaaaggaguucaaccaccuugaaaagagaauugagaaucugaacaaaaaggugaaugacggcuuccucgauaucuggaccuacaacgccgaacugcugguccuccuggagaaugagcggacccuugacuaucaugauucuaacgugaaaaaccuguacgaaaagguccgcucccagcucaaaaauaacgccaaggagauugggaauggauguuuugaguucuaucacaagugcgacaacacauguauggagagcgugaaaaauggcaccuacgauuaucccaaguacucugaagaggcuaaacugaacagagaggaaaucgacgggguuaaacuugaguccacacggaucuaucaaauucuggccaucuacagcacgguggcguccucucucguccuggugguuagccugggcgcuauuuccuuuuggaugugcucuaauggaagccuccagugccgcaucuguauuuga

SEQ ID NO: 187113 - RNA, 1701 nt, Artificial Sequence
  derived and/or modified sequence opt5 from hemagglutinin__InfluenzaA__ADC32434
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagcacgccaucgacgagauuaccaacaaggucaauuccgugaucgagaaaaugaacacgcaguuuacagcuguuggaaaggaguucaaucaucuugagaagagaauugaaaaccugaauaaaaagguggaugacggcuuccucgauaucuggaccuacaacgccgagcugcugguccuccuggaaaaugagcggacccuugacuaucacgauagcaacgugaaaaaucuguacgagaagguccgcucucagcucaaaaacaacgccaaggaaauugggaauggauguuuugaguucuaucauaagugcgacaacacauguauggaauccgugaaaaauggcaccuacgauuauccuaaguacagcgaggaagcuaaacugaacagagaggagaucgacgggguuaaacuugaaucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 187114 - RNA, 1701 nt, Artificial Sequence; identical to SEQ ID NO: 187113
  derived and/or modified sequence opt5 from hemagglutinin__InfluenzaA__ADC32435

SEQ ID NO: 187115 - RNA, 1701 nt, Artificial Sequence
  derived and/or modified sequence opt5 from hemagglutinin__InfluenzaA__ADC34940
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaacgcuucaacuggaccggcgugacacagaauggcaccucuuccgcuugcaagagagggagcgacaacuccuuuuucucucggcugaauuggcucacacaucugaaguuuaaauauccugcccuuaacgucaccaugcccaauaacgagaaguucgauaaacuguacaucuggggagugcaccauccuggcacggacaacgaucagauuuuucuccacgcgcaggccagcgggcgcaucacaguuucuaccaagagaucccaacagacagugauuccgaauaucggaagccggccccgcgucagaaacauuccuucccggaucucuaucuauuggaccauugugaaacccggcgacauccugcugauuaauagcaccgggaaccucaucgcuccucgcggauacuucaagauuagauccggcaagagcucuaucaugaaauccgacgcccccaucggcaaguguaauagcgagugcauuacaccgaacgggucuaucccuaaugauaaacccuuucagaacgugaaucggauuacguacggagcuuguccucgcuaugucaagcagaacacccugaaacuugccacaggcaugagaaauguucccgaaaagcaaacccgggggaucuucggagcgauugccggcuuuaucgagaacgggugggaaggaaugguggacggcugguacggcuuccgccaccagaauagcgaggggaucggacaggcugccgaucugaaauccacacaagcugccauuaaccagaucaauggcaagcucaacagacugauugggaagaccaacgagaaauuccaucagaucgaaaaggaguuuucugaaguggagggacggauucaggaccuugaaaaauaugucgaggauacgaagaucgaccuguggagcuacaaugccgagcuccugguggcucuggaaaaccaacacacaauugaucucaccgacuccgagaugaauaaacuguucgaaagaaccaagaagcagcuucgcgagaacgcggaagauaugggcaaugggugcuuuaaaaucuaucauaagugugacaacgccugcaucggcagcauucggaauggaacauacgaucacgacguuuauagagacgaggcucugaacaaucgcuuccagaucaaaggcguggagcucaagucuggguacaaagauuggauucuguggaucuccuuugccauuagcugcuuccuucugugugucgcccuccugggauuuaucaugugggcuugccagaagggcaacauccgguguaauauuugcaucuga

SEQ ID NO: 187116 - RNA, 1701 nt, Artificial Sequence; identical to SEQ ID NO: 187028
  derived and/or modified sequence opt5 from hemagglutinin__InfluenzaA__ADC38987

SEQ ID NO: 187117 - RNA, 1701 nt, Artificial Sequence
  derived and/or modified sequence opt5 from hemagglutinin__InfluenzaA__ADC38997
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaugugcuuguccuguggggaauccaccaccccuccaccucugccgaccaacagagccucuaccagaacgcugaugccuacguguucgugggcacauccagauauagcaagaaauuuaagccugaaauugcuauccggccgaaaguccgcgaccaggaggggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgaaggaggcuggaccgggaugguggauggaugguacggcuaucaucaccagaaugagcaaggcucuggguacgcugcggaccugaaaagcacacagaacgccaucgaugaaauuaccaauaaggucaacuccgugaucgagaaaaugaauacgcaguuuacagcuguuggaaaggaguucaaccaccuugaaaagagaauugagaaucugaacaaaaagguggacgauggcuuccucgacaucuggaccuacaaugccgaacugcugguccuccuggagaacgaacggacccuugauuaucaugacagcaaugugaaaaaccuguacgagaagguccgcucucagcucaaaaacaaugccaaggagauugggaacggauguuuugaguucuaucacaagugcgauaauacauguauggaguccgugaaaaacggcaccuacgacuauccuaaguacagcgaagaggcuaaacugaauagagaagagaucgaugggguuaaacuugagucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 187118 - RNA, 1701 nt, Artificial Sequence; identical to SEQ ID NO: 186794
  derived and/or modified sequence opt5 from hemagglutinin__InfluenzaA__ADC39007

SEQ ID NO: 187119 - RNA, 1698 nt, Artificial Sequence
  derived and/or modified sequence opt5 from hemagglutinin__InfluenzaA__ADC45604
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaaaacucucacaaugggaaacuuugccugcucaagggaaucgcuccccugcagcugggcaacuguagcguggccggguggauucucggaaauccugagugcgaacugcuuaucuccaaagagucuuggagcuacauuguugaaaagccgaaccccgagaauggcaccuguuauccugggcauuuugccgauuacgaggaacugagagagcaacucuccucugugagcuccuucgaacgguuugagaucuuccccaaggagagcucuuggccuaaccacacggucaccggaguguccgcuagcugcucucauaauggcgaauccagcuuuuaucgcaaccugcuuuggcugacaggcaaaaaugggcucuaccccaaccugucuaaguccuaugccaauaacaaagagaaggaaguucuggugcucuggggaguccaccacccuccgaacaucggcgaccagaaagcucuguaccauaccgagaaugccuacgugagcguggucuccucucacuauagcagaaaguucacacccgaaauugcgaagcggccuaaaguucgcgaucaggaggggagaaucaacuacuauuggacccuucuggagcccggagacacgauuaucuuugaagccaauggcaaccucauugcuccucgguacgccuucgcucugucccgcgggcuuggaagcggcaucauuaauucuaacgcccccauggauaagugugacgcgaaaugccagacaccgcaaggcgccaucaauuccagccugccuuuucagaacgugcaucccgugaccaucggggaguguccuaaguaugucagaucugcuaaacuccggauggugacaggacugcgcaauauucccagcauccaguccagaggccuguucggggccauugcuggauuuaucgaaggcggguggaccggaaugguugauggcugguacggcuaucaccaccagaacgagcaagggucuggauacgccgccgaccaaaagagcacccagaaugcuauuaacggcaucacaaauaaagugaacuccgucaucgaaaagaugaauacgcaguucaccgcgguggggaaggaguuuaacaaacucgagcggcgcauggaaaaccugaauaagaaaguugaugacggauucauugauaucuggacauacaacgccgagcuucuggugcuccuggaaaaugagagaacccuugacuuccaugacagcaacgucaagaaucuguaugaaaaagugaagucucagcucaagaacaaugcuaaagagauuggcaacgggugcuuugaguucuaccacaaguguaaugaugaaugcauggaguccgucaaaaacggcacauaugacuaccccaaguauagcgaagagucuaaacugaaucgggagaagaucgauggagugaagcuggaauccaugggcguuuaccagauucucgccaucuauagcaccguggccuccucucugguccuucuggugagccucggggcuaucuccuuuuggaugugcucuaacggaagccugcagugucgcauuugcaucuga

SEQ ID NO: 187120 - RNA, 1698 nt, Artificial Sequence
  derived and/or modified sequence opt5 from hemagglutinin__InfluenzaA__ADC45626
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauaaccacaaugggaaacuuugccugcucaagggaaucgcgccccugcagcugggcaacuguucuguugcuggguggauucucggaaauccugagugcgaacugcuuaucagcaaagaguccuggucuuacauuguggaaaagccgaaccccgagaauggcaccuguuauccugggcauuuugccgacuacgaggaacugagagagcaacucagcuccgucucuagcuucgaacgguuugagaucuuccccaaggaguccagcuggccuaaccacacggugaccggaguuucugccuccugcagccauaauggcgaaucuuccuuuuauaaaaaccugcuuuggcugacaggcaagaaugggcucuaccccaaccugagcaaaucuuaugcuaauaacaaggagaaagaagugcugguccucuggggagugcaccacccuccgaacaucggcaaucagaugacccuguaccauaaggagaacgccuacguguccgucguuagcucccacuauucucgcaaguucacacccgaaauugcuaaaagaccuaaggugcgggaucaggaggggcgcaucaauuacuauuggacccuucuggagcccggagacacgauuaucuuugaagccagcggcaaccucauugcgccuagauacgccuucgcucugucccggggguuuggaagcggcaucauuaauucuaacgcccccauggaugagugugacgcuaaaugccagacaccgcaaggcgccaucaauuccagccuuccuuuccagaacgugcaucccgucaccaucggggaauguccuaaguaugugcgcucugcgaaacugagaaugguuacaggacuccggaauauucccagcauccagucccgcggccuguuuggggccauugcuggauucaucgagggcggguggaccggaaugguggauggcugguacggcuaucaccaccagaacgaacaagggucuggauacgccgcugaccaaaagagcacccagaaugccauuaacggcaucacaaauaaagucaacuccgugaucgagaagaugaauacgcaguuuaccgccguugggaaggaguucaacaaacuggaaagacggauggagaaccucaauaagaaaguggaugacggauucauugaugucuggacauacaacgcugaacugcuugugcugcucgagaaugaacgcacccuggacuuucaugacagcaacgucaagaaucuuuaugagaaagugaagaaccagcugaagaauaacgcgaaagagaucggcaaugggugcuucgaauuuuaccacaaguguaacgaugagugcauggaaucuguuaaaaauggcacauaugacuaccccaaguauuccgaggagagcaaacucucuagagaaaagauugauggagugaagcuggaguccaugggcgucuaccagauccuggccauuuauagcaccguggcuuccucucucguucugcuugugagccugggggccaucuccuucuggaugugcucuaacggaagccuccagugucggaucugcauuuga

SEQ ID NO: 187121 - RNA, 1698 nt, Artificial Sequence
  derived and/or modified sequence opt5 from hemagglutinin__InfluenzaA__ADC45637
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauaaccacaaugggaaacuuugccugcucaagggaaucgcgccccugcagcugggcaacuguucuguugcuggguggauucucggaaauccugagugcgaacugcuuaucagcaaagaguccuggucuuacauuguggaaaagccgaaccccgagaauggcaccuguuauccugggcauuuugccgacuacgaggaacugagagagcaacucagcuccgucucuagcuucgaacgguuugagaucuuccccaaggaguccagcuggccuaaccacacggugaccggaguuucugccuccugcagccauaauggcgaaucuuccuuuuauaaaaaccugcuuuggcugacaggcaagaaugggcucuaccccaaccugagcaaaucuuaugcuaauaacaaggagaaagaagugcugguccucuggggagugcaccacccuccgaacaucggcgaucagaugacccuguaccauaaggagaaugccuacguguccgucguuagcucccacuauucucgcaaguucacacccgaaauugcuaaaagaccuaaggugcgggaccaggaggggcgcaucaacuacuauuggacccuucuggagcccggagauacgauuaucuuugaagccagcggcaaucucauugcgccuagauacgccuucgcucugucccggggguuuggaagcggcaucauuaacucuaaugcccccauggacgagugugaugcuaaaugccagacaccgcaaggcgccaucaacuccagccuuccuuuccagaaugugcaucccgucaccaucggggaauguccuaaguaugugcgcucugcgaaacugagaaugguuacaggacuccggaacauucccagcauccagucccgcggccuguuuggggccauugcuggauucaucgagggcggguggaccggaaugguggacggcugguacggcuaucaccaccagaaugaacaagggucuggauacgccgcugaucaaaagagcacccagaacgccauuaauggcaucacaaacaaagucaauuccgugaucgagaagaugaacacgcaguuuaccgccguugggaaggaguucaauaaacuggaaagacggauggagaaccucaacaagaaaguggacgauggauucauugacgucuggacauacaaugcugaacugcuugugcugcucgagaacgaacgcacccuggacuuucaugauagcaaugucaagaaccuuuaugagaaagugaagaaucagcugaagaacaaugcgaaagagaucggcaacgggugcuucgaauuuuaccacaaguguaaugacgagugcauggaaucuguuaaaaacggcacauaugauuaccccaaguauuccgaggagagcaaacucucuagagaaaagauugacggagugaagcuggaguccaugggcgucuaccagauccuggccauuuauagcaccguggcuuccucucucguucugcuugugagccugggggccaucuccuucuggaugugcucuaauggaagccuccagugucggaucugcauuuga

SEQ ID NO: 187122 - RNA, 1698 nt, Artificial Sequence
  derived and/or modified sequence opt5 from hemagglutinin__InfluenzaA__ADC45648
augaaggugaaacugcucguccugcuuugcaccuucgccgcuacauacgccgacacgaucuguauuggcuaucacgcgaacaauagcaccgauacaguugacaccgugcuggagaagaacgugacagucacccauuccgugaaucuccuggaaaacucucacaaugggaaacuuugccugcucaagggaaucgcuccccugcagcugggcaacuguagcauugccggguggguucucggaaauccugagugcgaacugcuuaucuccaaagagucuuggagcuacauuguggaaaagccgaaccccgagaauggcacauguuauccugggcauuuugccgauuacgaggaacugagagagcaacucuccucugucagcuccuucgaacgguuugagaucuuccccaaggagagcucuuggccuaaccacaccgugacgggaguuuccgcuagcugcucucauaauggcgaauccagcuuuuaucgcaaccugcuuuggcugaccggcaaaaaugggcucuaccccaaccugucuaaguccuaugccaauaacaaagagaaggaagugcugguccucuggggagugcaccacccuccgaacaucggcgaccagaaagcucuguaccauacagagaaugccuacgugagcgucguuuccucucacuauagcagaaaguucacccccgaaauugcgaagcggccuaaagugcgcgaucaggaggggagaaucaacuacuauuggacacuucuggagcccggagacaccauuaucuuugaagccaauggcaaccucauugcuccucgguacgccuucgcucugucccgcggguuuggaagcggcaucauuaauucuaacgcccccauggauaagugugacgcgaaaugccagacgccgcaaggcgccaucaauuccagccuuccuuuccagaacgugcaucccgucacaaucggggaguguccuaaguaugugagaucugcuaaacugcggaugguuaccggacuccgcaauauucccagcauccaguccagaggccuguuuggggccauugcuggauucaucgaaggcggguggacaggaaugguggauggcugguacggcuaucaccaccagaacgagcaagggucuggauacgccgccgaccaaaagagcacccagaaugcuauuaacggcaucaccaauaaagucaacuccgugaucgaaaagaugaauacacaguuuacggcgguugggaaggaguucaacaaacuggagcggcgcauggaaaaccucaauaagaaaguggaugacggauucauugauaucuggaccuacaacgccgagcugcuuguccugcucgaaaaugagagaacacuggacuuucaugacagcaacgugaagaaucuuuaugaaaaagucaagucucagcugaagaacaaugcuaaagagauuggcaacgggugcuucgaguuuuaccacaaguguaaugaugaaugcauggaguccgugaaaaacggcaccuaugacuaccccaaguauagcgaagagucuaaacucaaucgggagaagaucgauggaguuaagcuggaauccaugggcguguaccagauucuggccaucuauagcacagucgccuccucucucgugcugcuuguuagccugggggcuaucuccuucuggaugugcucuaacggaagccuccagugucgcauuugcaucuga

SEQ ID NO: 187123 - RNA, 1698 nt, Artificial Sequence
  derived and/or modified sequence opt5 from hemagglutinin__InfluenzaA__ADC45659
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaagaaaagcucuuggccuaaccacacggugaccggaguuuccgccagcugcucucauaauggcgaguccagcuuuuaucgcaaccugcuuuggcugacagaaaagaauggccucuaccccaaccugucuaaauccuaugcuaauaacaaggagaaagaagugcugguccucuggggagugcaccacccuccgaacaucggggaccagaaggcccuguaccauaccgagaaugcuuacgugagcgucguuuccucucacuauagcagaaaguucacacccgaaauugccaaacggccuaaggugcgcgaucaggagggcagaaucaacuacuauuggacccuucuggagcccggggacacgauuaucuuugaagcgaauggaaaccucauugccccucgguacgcuuucgcccugucccgcggcuuugggagcggaaucauuaauucuaacgcucccauggauaaaugugacgccaagugccagacaccgcaaggcgcgaucaauuccagccuuccuuuccagaacgugcaucccgucaccaucggcgaguguccuaaauaugugagaucugccaagcugcggaugguuacagggcuccgcaauauucccagcauccaguccagaggacuguuuggcgcuauugccggguucaucgaaggaggcuggaccgggaugguggauggaugguacggcuaucaccaccagaacgagcaaggcucuggguacgcugccgaccagaaaagcacccagaaugccauuaacggaaucacaaauaaggucaacuccgugaucgaaaagaugaauacgcaguuuaccgcuguuggcaaagaguucaacaagcuggagcggcgcauggaaaaccucaauaaaaagguggaugacggguucauugauaucuggacauacaacgcggagcugcuuguccugcucgaaaaugagagaacccuggacuuucaugacagcaacgugaaaaaucuuuaugaaaaggucaagucucaacugaaaaacaaugccaaggagauuggaaacggcugcuucgaguuuuaccacaaauguaaugaugaaugcauggaguccgugaagaacgggacauaugacuaccccaaauauagcgaagagucuaagcucaaucgggagaagaucgauggcguuaaacuggaauccaugggaguguaccagauucuggcuaucuauagcaccgucgccuccucucucgugcugcuuguuagccugggcgccaucuccuucuggaugugcucuaacgggagccuccagugucgcauuugcaucuga

SEQ ID NO: 187124 - RNA, 1698 nt, Artificial Sequence
  derived and/or modified sequence opt5 from hemagglutinin__InfluenzaA__ADC45670
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaggcuccgccagcugcucucauaauggcgaauccagcuuuuaucgcaaccugcuuuggcugacagggaaaaauggacucuaccccaaccugucuaaguccuaugcuaauaacaaagagaaggaaguucuggugcucuggggcguccaccacccuccgaacaucggggaccagaaagcccuguaccauaccgagaaugcuuacgugagcguggucuccucucacuauagcagaaaguucacacccgaaauugccaagcggccuaaaguucgcgaucaggagggaagaaucaacuacuauuggacccuucuggagcccggcgacacgauuaucuuugaagcgaaugggaaccucauugccccucgguacgcuuucgcccugucccgcggauuuggcagcggcaucauuaauucuaacgcucccauggauaagugugacgccaaaugccagacaccgcaaggggcgaucaauuccagccuuccuuuccagaacgugcaucccgugaccaucggagaguguccuaaguaugucagaucugccaaacugcggauggugacaggccuccgcaauauucccagcauccaguccagagggcuguuuggagcuauugccggcuucaucgaagggggauggaccggcaugguugauggcugguacggguaucaccaccagaacgagcaaggaucuggcuacgcugccgaccaaaagagcacccagaaugccauuaacgggaucacaaauaaagugaacuccgucaucgaaaagaugaauacgcaguuuaccgcugugggaaaggaguucaacaaacuggagcggcgcauggaaaaccucaauaagaaaguugaugacggcuucauugauaucuggacauacaacgcggagcugcuugugcugcucgaaaaugagagaacccuggacuuucaugacagcaacgucaagaaucuuuaugaaaaagugaagucucagcugaagaacaaugccaaagagauugggaacggcugcuucgaguuuuaccacaaguguaaugaugaaugcauggaguccgucaaaaacggaacauaugacuaccccaaguauagcgaagagucuaaacucaaucgggagaagaucgauggcgugaagcuggaauccauggggguuuaccagauucuggcuaucuauagcaccguggccuccucucucguccugcuugugagccugggagccaucuccuucuggaugugcucuaacggcagccuccagugucgcauuugcaucuga

SEQ ID NO: 187125 - RNA, 1698 nt, Artificial Sequence
  derived and/or modified sequence opt5 from hemagglutinin__InfluenzaA__ADC45681
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauaaccacaaugggaaacuuugccugcucaagggaaucgcgccccugcagcugggcaacuguucuguugcuggguggauucucggaaauccugagugcgaacugcuuaucagcaaagaguccuggucuuacauuguggaaaagccgaaccccgagaauggcaccuguuauccugggcauuuugccgacuacgaggaacugagagagcaacucagcuccgccucuagcuucgaacgguuugagaucuuccccaaggaguccagcuggccuaaccacacggucaccggagugucugcuuccugcagccauaauggcgaaucuuccuuuuauaaaaaccugcuuuggcugacaggcaagaaugggcucuaccccaaccugcgcaaaagcuaugccaauaacaaggagaaagaaguucuggugcucuggggaguccaccacccuccgaacaucggcgaucagaugacccuguaccauaaggagaaugcuuacgugucuguggucuccagccacuauuccagaaaguucacacccgaaauugccaaacggccuaagguucgcgaccaggaggggagaaucaacuacuauuggacccuucuggagcccggagauacgauuaucuuugaagcgucuggcaaucucauugccccucgguacgcuuucgcccugagccgcggguuuggauccggcaucauuaacagcaaugcucccauggacgagugugaugccaaaugccagacaccgcaaggcgcgaucaacucuucccuuccuuuccagaaugugcaucccgugaccaucggggaauguccuaaguaugucagaagcgccaaacugcggauggugacaggacuccgcaacauucccucuauccagagcagaggccuguuuggggcuauugccggauucaucgagggcggguggaccggaaugguugacggcugguacggcuaucaccaccagaaugaacaaggguccggauacgcugccgaucagaagucuacccagaacgccauuaauggcaucacaaacaaagugaauagcgucaucgagaagaugaacacgcaguuuaccgcuguggggaaggaguucaauaaacuggaacggcgcauggagaaccucaacaagaaaguugacgauggauucauugacguguggacauacaaugcggaacugcuuguccugcucgagaacgaaagaacccuggacuuucaugauuccaaugugaagaaccuuuaugagaaagucaagaaucaacugaagaacaaugccaaagagaucggcaacgggugcuucgaauuuuaccacaaguguaaugacgagugcauggaaagcgugaaaaacggcacauaugauuaccccaaguauucugaggaguccaaacucagccgggaaaagauugacggaguuaagcuggagucuaugggcguguaccagauccuggcuauuuauuccaccgucgccagcucccucgugcugcuuguuucucugggggccaucagcuucuggaugugcuccaauggaucucuccagugucgcaucugcauuuga

SEQ ID NO: 187126 - RNA, 1698 nt, Artificial Sequence
  derived and/or modified sequence opt5 from hemagglutinin__InfluenzaA__ADC45692
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaaaagucuuggagcuacauuguggagaagccgaaccccgaaaauggcaccuguuauccugggcauuuugccgauuacgaggagcugagagaacaacucuccucugucagcuccuucgagcgguuugaaaucuuccccaaagagagcucuuggccuaaccacacggugaccggaguuuccgccagcugcucucauaauggcgaguccagcuuuuaucgcaaccugcuuuggcugacaggcaagaaugggcucuaccccaaccugucuaaauccuaugcuaauaacaaggaaaaagaggugcugguccucuggggagugcaccacccuccgaacaucggcgaccagaaggcccuguaccauaccgaaaaugcuuacgugagcgucguuuccucucacuauagcagaaaguucacacccgagauugccaaacggccuaaggugcgcgaucaggaagggagaaucaacuacuauuggacccuucuggagcccggagacacgauuaucuuugaggcgaauggcaaccucauugccccucgguacgcuuucgcccugucccgcggguuuggaagcggcaucauuaauucuaacgcucccauggauaaaugugacgccaagugccagacaccgcaaggcgcgaucaauuccagccuuccuuuccagaacgugcaucccgucaccaucggggaauguccuaaauaugugagaucugccaagcugcggaugguuacaggacuccgcaauauucccagcauccaguccagaggccuguuuggggcuauugccggauucaucgagggcggguggaccggaaugguggauggcugguacggcuaucaccaccagaacgaacaagggucuggauacgcugccgaccagaaaagcacccagaaugccauuaacggcaucacaaauaaggucaacuccgugaucgagaagaugaauacgcaguuuaccgcuguugggaaagaguucaacaagcuggaacggcgcauggagaaccucaauaaaaagguggaugacggauucauugauaucuggacauacaacgcggaacugcuuguccugcucgagaaugaaagaacccuggacuuucaugacagcaacgugaaaaaucuuuaugagaaggucaagucucaacugaaaaacaaugccaaggaaauuggcaacgggugcuucgaguuuuaccacaaauguaaugaugagugcauggaauccgugaagaacggcacauaugacuaccccaaauauagcgaggaaucuaagcucaaucgggagaagaucgauggaguuaaacuggaguccaugggcguguaccagauucuggcuaucuauagcaccgucgccuccucucucgugcugcuuguuagccugggggccaucuccuucuggaugugcucuaacggaagccuccagugucgcauuugcaucuga

SEQ ID NO: 187127 - RNA, 1698 nt, Artificial Sequence; identical to SEQ ID NO: 186194
  derived and/or modified sequence opt5 from hemagglutinin__InfluenzaA__ADC45703

SEQ ID NO: 187128 - RNA, 1698 nt, Artificial Sequence
  derived and/or modified sequence opt5 from hemagglutinin__InfluenzaA__ADC45714
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauaaccacaaugggaaacuuugccugcucaagggaaucgcgccccugcagcugggcaacuguucuguugcuggguggauucucggaaauccugagugcgaacugcuuaucagcaaagaguccuggucuuacauuguggaaaagccgaaccccgagaauggcaccuguuauccugggcauuuugccgacuacgaggaacugagagagcaacucagcuccgucucuagcuucgaacgguuugagaucuuccccaaggaguccagcuggccuaaccacacggugaccggaguuucugccuccugcagccauaauggcgaaucuuccuuuuauaaaaaccugcuuuggcugacaggcaagaaugggcucuaccccaaccugagcaaaucuuaugcuaauaacaaggagaaagaagugcugguccucuggggagugcaccacccuccgaacaucggcgaucagaccacacuguaccauaaggagaaugccuacguguccgucguuagcucccacuauucucgcaaguucacccccgaaauugcuaaaagaccuaaggugcgggaccaggaggggcgcaucaacuacuauuggacgcuucuggagcccggagauacaauuaucuuugaagccagcggcaaucucauugcgccuagauacgccuucgcucugucccggggguuuggaagcggcaucauuaacucuaaugcccccauggacgagugugaugcuaaaugccagaccccgcaaggcgccaucaacuccagccuuccuuuccagaaugugcaucccgucacaaucggggaauguccuaaguaugugcgcucugcgaaacugagaaugguuaccggacuccggaacauucccagcauccagucccgcggccuguuuggggccauugcuggauucaucgagggcggguggaccggaaugguggacggcugguacggcuaucaccaccagaaugaacaagggucuggauacgccgcugaucaaaagagcacacagaacgccauuaauggcaucacgaacaaagucaauuccgugaucgagaagaugaacacccaguuuacagccguugggaaggaguucaauaaacuggaaagacggauggagaaccucaacaagaaaguggacgauggauucauugacgucuggaccuacaaugcugaacugcuugugcugcucgagaacgaacgcacacuggacuuucaugauagcaaugucaagaaccuuuaugagaaagugaagaaucagcugaagaacaaugcgaaagagaucggcaacgggugcuucgaauuuuaccacaaguguaaugacgagugcauggaaucuguuaaaaacggcaccuaugauuaccccaaguauuccgaggagagcaaacucucuagagaaaagauugacggagugaagcuggaguccaugggcgucuaccagauccuggccauuuauagcacgguggcuuccucucucguucugcuugugagccugggggccaucuccuucuggaugugcucuaauggaagccuccagugucggaucugcauuuga

SEQ ID NO: 187129 - RNA, 1698 nt, Artificial Sequence; identical to SEQ ID NO: 186194
  derived and/or modified sequence opt5 from hemagglutinin__InfluenzaA__ADC45725

SEQ ID NO: 187130 - RNA, 1698 nt, Artificial Sequence
  derived and/or modified sequence opt5 from hemagglutinin__InfluenzaA__ADC45736
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgaccagaaagcccuguaccauaccgagaauacauacgugagcgucguuuccucucacuauagcagaaaguucacccccgaaauugcuaagcggccuaaagugcgcgaucaggaggggagaaucaacuacuauuggacgcuucuggagcccggagacacaauuaucuuugaagccaauggcaaccucauugcgccucgguacgccuucgcucugucccgcggguuuggaagcggcaucauuaauucuaacgcccccauggauaagugugacgcuaaaugccagaccccgcaaggcgccaucaauuccagccuuccuuuccagaacgugcaucccgucacaaucggggaguguccuaaguaugugagaucugcgaaacugcggaugguuaccggacuccgcaauauucccagcauccaguccagaggccuguuuggggccauugcuggauucaucgaaggcggguggaccggaaugguggauggcugguacggcuaucaccaccagaacgagcaagggucuggauacgccgcugaccaaaagagcacacagaaugccauuaacggcaucacgaauaaagucaacuccgugaucgaaaagaugaauacccaguuuacagccguugggaaggaguucaacaaacuggagcggcgcauggaaaaccucaauaagaaaguggaugacggauucauugauaucuggaccuacaacgcugagcugcuuguccugcucgaaaaugagagaacacuggacuuucaugacagcaacgugaagaaucuuuaugaaaaagucaagucucagcugaagaacaaugcgaaagagauuggcaacgggugcuucgaguuuuaccacaaguguaaugaugaaugcauggaguccgugaaaaacggcaccuaugacuaccccaaguauagcgaagagucuaaacucaaucgggagaagaucgauggaguuaagcuggaauccaugggcguguaccagauucuggccaucuauagcacggucgcuuccucucucgugcugcuuguuagccugggggccaucuccuucuggaugugcucuaacggaagccuccagugucgcauuugcaucuga

SEQ ID NO: 187131 - RNA, 1698 nt, Artificial Sequence; identical to SEQ ID NO: 185512
  derived and/or modified sequence opt5 from hemagglutinin__InfluenzaA__ADC45747

SEQ ID NO: 187132 - RNA, 1698 nt, Artificial Sequence
  derived and/or modified sequence opt5 from hemagglutinin__InfluenzaA__ADC45758
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaaaacuccuuuuaucgcaaucugcuuuggcugacaggcaaaaacgggcucuaccccaaucugagcaagucuuaugcuaacaacaaagagaaggaagugcugguccucuggggagugcaccacccuccgaauaucgccgaccagaaaacccuguaccauacagagaacgcuuacguguccgucguuagcucccacuauucuagaaaguucacccccgaaauugccaagcggccuaaagugcgcgaucaggagggcagaaucaauuacuauuggacgcuucuggagcccggggacacaauuaucuuugaagcgaacggaaaucucauugccccucgguacgcuuucgcccugagccgcggcuuuggguccggaaucauuaacagcaaugcucccauggauaagugugacgccaaaugccagaccccgcaaggcgcgaucaacucuucccuuccuuuccagaaugugcaucccgucacaaucggcgaguguccuaaguaugugagaagcgccaaacugcggaugguuaccgggcuccgcaacauucccucuauccagagcagaggacuguuuggcgcuauugccggguucaucgaaggaggcuggaccgggaugguggauggaugguacggcuaucaccaccagaaugagcaaggcuccggguacgcugccgaccagaagucuacacagaacgccauuaauggaaucacgaacaaagucaauagcgugaucgaaaagaugaacacccaguuuacagcuguuggcaaggaguucaacaaacuggagcggcgcauggaaaaucucaacaagaaaguggaugacggguucauugauaucuggaccuacaaugcggagcugcuuguccugcucgaaaacgagagaacacugaauuuucaugacuccaacgugaagaaucuuuaugaaaaagucaagagccaacugaagaacaaugccaaagagauuggaaacggcugcuucgaguuuuaccacaaguguaaugacgaaugcauggagucugugaaaaacgggaccuaugauuaccccaaguauuccgaagagagcaaacucaaucgggagaagaucgacggcguuaagcuggaaucuaugggaguguaccagauucuggcuaucuauuccacggucgccagcucccucgugcugcuuguuucucugggcgccaucagcuucuggaugugcuccaacgggucucuccagugucgcauuugcaucuga

SEQ ID NO: 187133 - RNA, 1698 nt, Artificial Sequence; identical to SEQ ID NO: 186650
  derived and/or modified sequence opt5 from hemagglutinin__InfluenzaA__ADC45780

SEQ ID NO: 187134 - RNA, 1698 nt, Artificial Sequence; identical to SEQ ID NO: 186155
  derived and/or modified sequence opt5 from hemagglutinin__InfluenzaA__ADC45791

SEQ ID NO: 187135 - RNA, 1698 nt, Artificial Sequence
  derived and/or modified sequence opt5 from hemagglutinin__InfluenzaA__ADC45813
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaaaacucucacaaugggaaacuuugccugcucaagggaauugcgccccugcagcugggcaacuguagcguggcuggguggauccucggaaauccugagugcgaacugcuuauuuccaaagagucuuggagcuacaucguugaaaagccgaaccccgagaauggcaccuguuauccugggcauuuugccgauuacgaggaacugagagagcaacucuccucugugagcuccuucgaacgguuugagaucuuccccaaggagagcucuuggccuaaccacacggucaccggaguguccgccagcugcucucauaauggcgaauccagcuuuuaucgcaaccugcuuuggcugacaaugaaaaauggccucuaccccaaccugucuaaguccuaugcuaauaacaaagagaaggaaguucuggugcucuggggaguccaccacccuccgaacauuggggaccagaaaacccuguacaauacagagaacgccuacgugagcguggucuccucucauuauagcagaaaguucacccccgaaaucgcuaagcggccuaaaguucgcgaucaggagggcagaauuaauuacuauuggacgcuucuggagcccggggacacaaucauuuuugaagccaacggaaaucucaucgcgccucgguacgccuucgcucugucccgcggcuuugggagcggaauuaucaacucuaaugcccccauggauaagugugacgcuaaaugccagaccccgcaaggcgccaucaacuccagccuuccuuuccagaaugugcaccccgugacaauuggcgaguguccuaaguaugucagaucugcgaaacugcggauggugaccgggcuccgcaacauccccagcauucaguccagaggacuguuuggcgccaucgcuggguucauugaaggaggcuggaccgggaugguugauggaugguacggcuaucaucaccagaaugagcaaggcucuggguacgccgcugaccagaaguccacacagaacgccaucaauggaaucacgaacaaagugaauagcgucauugaaaagaugaacacccaguuuacagccgugggcaaggaguucaacaaacuggagcggcgcauggaaaaucucaacaagaaaguugaugacggguucaucgauauuuggaccuacaaugcugagcugcuugugcugcucgaaaacgagagaacacuggacuuucacgacagcaaugucaagaaccuuuaugaaaaagugaagucucaacugaagaauaacgcgaaagagaucggaaauggcugcuucgaguuuuaccauaaguguaacgaugaaugcauggaguccgucaaaaaugggaccuaugacuaccccaaguauagcgaagagucuaaacucaaccgggagaagauugauggcgugaagcuggaauccaugggaguuuaccagauccuggccaucuauagcacgguggcuuccucucucguccugcuugugagccugggcgccauuuccuucuggaugugcucuaaugggagccuccagugucgcaucugcauuuga

SEQ ID NO: 187136 - RNA, 1698 nt, Artificial Sequence; identical to SEQ ID NO: 186155
  derived and/or modified sequence opt5 from hemagglutinin__InfluenzaA__ADC45824

SEQ ID NO: 187137 - RNA, 1698 nt, Artificial Sequence
  derived and/or modified sequence opt5 from hemagglutinin__InfluenzaA__ADC45835
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaaaacuccuuuuaucgcaaucugcuuuggcugacaggcaaaaacgggcucuaccccaaucugagcaagucuuaugcuaacaacaaagagaaggaagugcugguccucuggggagugcaccacccuccgaauaucgccgaccagaaaacccuguaccauacagagaacgcuuacguguccgucguuagcucccacuauucuagaaaguucacccccgaaauugccaagcggccuaaagugcgcgaucaggagggcagaaucaauuacuauuggacgcuucuggagcccggggacacaauuaucuuugaagcgaacggaaaucucauugccccucgguacgcuuucgcccugagccgcggcuuuggguccggaaucauuaacagcaaugcucccauggauaagugugacgccaaaugccagaccccgcaaggcgcgaucaacucuucccuuccuuuccagaaugugcaucccgucacaaucggcgaguguccuaaguaugugagaagcgccaaacugcggaugguuaccgggcuccgcaacauucccucuauccagagcagaggacuguuuggcgcuauugccggguucaucgaaggaggcuggaccgggaugguggauggaugguacggcuaucaccaccagaaugagcaaggcuccggguacgcugccgaccagaagucuacacagaacgccauuaauggaaucacgaacaaagucaauagcgugaucgaaaagaugaacacccaguuuacagcuguuggcaaggaguucaacaaacuggagcggcgcauggaaaaucucaacaagaaaguggaugacggguucauugauaucuggaccuacaaugcggagcugcuuguccugcucgaaaacgagagaacacuggacuuucaugacuccaaugugaagaaccuuuaugaaaaagucaagagccaacugaagaauaacgccaaagagauuggaaauggcugcuucgaguuuuaccacaaguguaacgaugaaugcauggagucugugaaaaaugggaccuaugacuaccccaaguauuccgaagagagcaaacucaaccgggagaagaucgauggcguuacgcuggaaucuaugggaguguaccagauucuggcuaucuauuccacagucgccagcucccucgugcugcuuguuucucugggcgccaucagcuucuggaugugcuccaaugggucucuccagugucgcauuugcaucuga

SEQ ID NO: 187138 - RNA, 1698 nt, Artificial Sequence; identical to SEQ ID NO: 185512
  derived and/or modified sequence opt5 from hemagglutinin__InfluenzaA__ADC45846

SEQ ID NO: 187139 - RNA, 1701 nt, Artificial Sequence; identical to SEQ ID NO: 185693
  derived and/or modified sequence opt5 from hemagglutinin__InfluenzaA__ADC53558

SEQ ID NO: 187140 - RNA, 1701 nt, Artificial Sequence; identical to SEQ ID NO: 185784
  derived and/or modified sequence opt5 from hemagglutinin__InfluenzaA__ADD14087

SEQ ID NO: 187141 - RNA, 1701 nt, Artificial Sequence; identical to SEQ ID NO: 185693
  derived and/or modified sequence opt5 from hemagglutinin__InfluenzaA__ADD14089

SEQ ID NO: 187142 - RNA, 1701 nt, Artificial Sequence; identical to SEQ ID NO: 185693
  derived and/or modified sequence opt5 from hemagglutinin__InfluenzaA__ADD14093

SEQ ID NO: 187143 - RNA, 1701 nt, Artificial Sequence
  derived and/or modified sequence opt5 from hemagglutinin__InfluenzaA__ADD14095
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccuggugcucccucgguacgcguuugccauggaacgcaacgcugggucuggaaucauuaucuccgauacccccgugcaugacugcaauacaaccugucaaaccccuaaaggcgccaucaacacaagccugcccuuccagaauauucacccgaucacgauuggcaagugcccuaaguaugucaaaucuaccaaacuuagacuggcuacagggcuccggaacgugcccagcauccagucccgcggacuguuuggcgccauugccggguucaucgagggaggcuggaccgggaugguugacggaugguacggcuaucaucaccagaaugaacaaggcucuggguacgcugcggaucuuaagagcacacagaacgccaucgacgagauuaccaauaaggugaacuccgucaucgagaaaaugaauacgcaguuuacagcugugggaaaggaguucaaccaccuggagaagagaauugaaaaucucaacaaaaagguugaugacggcuuccuggauaucuggaccuacaaugccgagcugcucgugcugcuugaaaacgagcggacccuggacuaucaugauagcaaugucaaaaaccucuacgagaaggugcgcucucagcugaaaaacaaugccaaggaaauugggaacggauguuuugaguucuaucacaagugcgacaauacauguauggaauccgucaaaaacggcaccuacgauuauccuaaguacagcgaggaagcuaaacuuaauagagaggagaucgacggggugaagcuggaaucuacacggaucuaucaaauucucgccaucuacuccacgguugcgagcucccuggugcuggucgugucucucggcgcuauuagcuuuuggaugugcuccaacggaucucugcagugccgcaucuguauuuga

SEQ ID NO: 187144 - RNA, 1701 nt, Artificial Sequence; identical to SEQ ID NO: 185693
  derived and/or modified sequence opt5 from hemagglutinin__InfluenzaA__ADD14097

SEQ ID NO: 187145 - RNA, 1701 nt, Artificial Sequence; identical to SEQ ID NO: 185693
  derived and/or modified sequence opt5 from hemagglutinin__InfluenzaA__ADD14099

SEQ ID NO: 187146 - RNA, 1701 nt, Artificial Sequence; identical to SEQ ID NO: 185693
  derived and/or modified sequence opt5 from hemagglutinin__InfluenzaA__ADD14101

SEQ ID NO: 187147 - RNA, 1701 nt, Artificial Sequence
  derived and/or modified sequence opt5 from hemagglutinin__InfluenzaA__ADD14103
augaaggccauccuggugguccuccugugcaccuucgcuacagccaacgcggacacgcuuuguauuggcuaccacgcuaauaacagcaccgauacaguugacaccgugcuggagaagaaugugacagucacccauuccgugaaccuccuggaagauaagcacaaugggaaacuuugcaagcugagaggaguugcuccccuccaucugggcaaauguaacaucgccggguggauucugggaaauccugagugcgaaucucucagcacagccuccucuuggagcuauaucguggagaccuccucuagcgacaacggcacguguuacccgggggauuuuauugacuaugaagaacugcgggagcagcuuuccagcgucucuuccuucgaacgcuuugagaucuuccccaagaccagcucuuggccuaaucacgauuccaacaagggagugacagccgcuugcccccaugccggcgcgaaaucuuuuuacaagaaucugaucuggcucguuaaaaagggcaacagcuauccuaaacuguccaagagcuacauuaaugacaaggggaaagaagugcuuguccuguggggaauccaccaccccuccaccucugccgaucaacagagccucuaucagaacgcugacgccuacguguucgugggcacauccagauacagcaagaaauuuaagccugagauugcuauccggccgaaaguccgcgaucaggaggggagaaugaauuauuacuggacccugguugaacccggagacaagauuacguucgaggccacaggcaaccugguggugccucgguaugcguuugccauggaacgcaacgcugggucuggaaucauuaucuccgauacccccguccaugacuguaauacaaccugccaaaccccuaaaggcgccaucaacacaagccuccccuuccagaauauucacccgaucacgauuggcaaguguccuaaguacgugaaaucuaccaagcugagacuugcuacagggcugcggaacguucccagcauccagucccgcggacucuuuggcgccauugccggguucaucgagggaggcuggaccgggaugguggacggaugguauggcuaccaucaccagaaugaacaaggcucuggguaugcugcggaucugaaaagcacacagaacgccaucgacgagauuaccaauaaggucaacuccgugaucgagaaaaugaauacgcaguuuacagcuguuggaaaggaguucaaccaccuugauaagagaauugagaaucugaacaaaaagaucgacgauggcuuccucgacauuuggaccuacaaugccgaacugcuggugcuccuggagaacgaacggacccuugauuaccaugacagcaaugucaaaaaccuguaugagaaggugcgcucucagcucaaaaacaaugccaaggagaucgggaacggaugcuuugaguucuaccacaagugugauaauacaugcauggaauccgucaaaaacggcaccuaugacuacccuaaguauagcgaagaggcuaaacugaauagagaagagaucgauggggugaaacuugagucuacacggauuuaccaaauccuggccauuuauuccacgguugcgagcucccucgugcuggucgugucucugggcgcuaucagcuuuuggaugugcuccaacggaucucuccagugucgcauuugcaucuga

SEQ ID NO: 187148 - RNA, 1701 nt, Artificial Sequence
  derived and/or modified sequence opt5 from hemagglutinin__InfluenzaA__ADD14111
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagauuuccucuagcgacaacggaaccugcuauccgggggauuuuaucgacuacgaagaacugcgggagcagcuuuccagcgucucuuccuucgaacgcuuugagaucuuccccaagacgagcucuuggccuaaucacgauuccaacaagggagugaccgccgcuuguccccaugccggcgcgaaaucuuuuuauaagaaucugauuuggcucguuaaaaagggcaacagcuacccuaaacuguccaagagcuauaucaaugacaaggggaaagaagugcuuguccuguggggcauucaccaccccuccacaucugccgaucaacagagccucuaccagaacgcugacgccuacguguucgugggcaccuccagauauagcaagaaauuuaagccugagaucgcuauucggccgaaaguccgcgaucaggaggggagaaugaauuacuauuggacacugguugaacccggagacaagaucaccuucgaggccacgggcaaccugguggugccucgguacgcguuugccauggaacgcaacgcugggucuggaauuaucaucuccgauacacccguccaugacugcaauaccacaugucaaaccccuaaaggcgccauuaacaccagccuccccuuccagaauauccacccgauuacaaucggcaagugcccuaaguaugugaaaucuacgaagcugagacuugcuaccgggcugcggaacguucccagcauucagucccgcggacucuuuggcgccaucgccggguucaucgagggaggcuggacagggaugguggacggaugguacggcuaucaucaccagaaugaacaaggcucuggguacgcugcggaucugaaaagcacccagaacgccauugacgagaucacaaauaaggucaacuccgugauugagaaaaugaauacccaguuuacggcuguuggaaaggaguucaaccaccuugagaagagaaucgaaaaucugaacaaaaagguggaugacggcuuccucgauauuuggacauacaaugccgagcugcugguccuccuggaaaacgagcggacccuugacuaucaugauagcaaugugaaaaaccuguacgagaagguccgcucucagcucaaaaacaaugccaaggaaaucgggaacggauguuuugaguucuaucacaagugcgacaauaccuguauggaauccgugaaaaacggcacauacgauuauccuaaguacagcgaggaagcuaaacugaauagagaggagaucgacgggguuaaacuugaaucuacccggauuuaucaaauccuggccauuuacuccacaguggcgagcucccucguccuggugguuucucugggcgcuaucagcuuuuggaugugcuccaacggaucucuccagugccgcauuuguaucuga

SEQ ID NO: 187149 - RNA, 1701 nt, Artificial Sequence; identical to SEQ ID NO: 185693
  derived and/or modified sequence opt5 from hemagglutinin__InfluenzaA__ADD14115

SEQ ID NO: 187150 - RNA, 1701 nt, Artificial Sequence; identical to SEQ ID NO: 185693
  derived and/or modified sequence opt5 from hemagglutinin__InfluenzaA__ADD14117

SEQ ID NO: 187151 - RNA, 1701 nt, Artificial Sequence; identical to SEQ ID NO: 185693
  derived and/or modified sequence opt5 from hemagglutinin__InfluenzaA__ADD14119

SEQ ID NO: 187152 - RNA, 1701 nt, Artificial Sequence; identical to SEQ ID NO: 185693
  derived and/or modified sequence opt5 from hemagglutinin__InfluenzaA__ADD14121

SEQ ID NO: 187153 - RNA, 1701 nt, Artificial Sequence; identical to SEQ ID NO: 185693
  derived and/or modified sequence opt5 from hemagglutinin__InfluenzaA__ADD14123

SEQ ID NO: 187154 - RNA, 1701 nt, Artificial Sequence; identical to SEQ ID NO: 185693
  derived and/or modified sequence opt5 from hemagglutinin__InfluenzaA__ADD14127

SEQ ID NO: 187155 - RNA, 1701 nt, Artificial Sequence
  derived and/or modified sequence opt5 from hemagglutinin__InfluenzaA__ADD14129
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugccucucuccaucugggcaaaugcaacaucgccggguggauucugggaaaucccgagugugaaagccucuccacagcuucuagcugguccuacaucguggagaccucuagcuccgacaacggcacgugcuauccuggggauuuuauugacuacgaagaacugcgggagcagcuuagcucugucuccagcuucgaacgcuuugagaucuucccgaagaccucuuccuggcccaaucacgauagcaacaagggagugacagccgcuuguccucaugccggcgcgaaaucuuuuuauaagaaucugaucuggcucguuaaaaagggcaacuccuaccccaaacugagcaaguccuauauuaaugacaaggggaaagaagugcuuguccuguggggaauccaccacccuucuaccagcgccgaucaacagucccucuaccagaacgcugacgccuacguguucgugggcacaagcagauauucuaagaaauuuaagcccgagauugcuauccggccuaaaguccgcgaucaggaggggagaaugaauuacuauuggacccugguugaaccgggagacaagauuacguucgaggccacaggcaaccugguggugccccgguacgcguuugccauggaacgcaacgcuggguccggaaucauuaucagcgauaccccuguccaugacugcaauacaaccugucaaacccccaaaggcgccaucaacacaucucucccuuuccagaauauucaccccaucacgauuggcaagugcccgaaguaugugaaaagcaccaagcugagacuugcuacagggcugcggaacguuccuuccauccagucucgcggacucuuuggcgccauugccggguucaucgagggaggcuggaccgggaugguggacggaugguacggcuaucaucaccagaaugaacaaggcagcggguacgcugcggaucugaaauccacacagaacgccaucgacgagauuaccaauaaggucaacagcgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauucuaaugugaaaaaccuguacgagaagguccgcucccagcucaaaaacaaugccaaggaaauugggaacggauguuuugaguucuaucacaagugcgacaauacauguauggaaagcgugaaaaacggcaccuacgauuaucccaaguacucugaggaagcuaaacugaauagagaggagaucgacgggguuaaacuugaauccacacggaucuaucaaauucuggccaucuacagcacgguggcguccucucucguccuggugguuagccugggcgcuauuuccuuuuggaugugcucuaacggaagccuccagugccgcaucuguauuuga

SEQ ID NO: 187156 - RNA, 1701 nt, Artificial Sequence
  derived and/or modified sequence opt5 from hemagglutinin__InfluenzaA__ADD14133
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacguggacgcuuacguguucgucggcacauccagauauagcaagaaauuuaagccugagauugccauccggccgaaaguucgcgaucaggaggggagaaugaauuacuauuggacccugguggaacccggagacaagauuacguucgaggcuacaggcaaccugguggucccucgguacgccuuugcgauggaacgcaacgccggguucggaaucauuaucucugauacccccgugcaugacugcaauacaaccugucaaaccccuaaaggcgcuaucaacacaucccuccccuuucagaauauucacccgaucacgauuggcaagugcccuaaguauguuaaaagcaccaagcugagacuugccacagggcugcggaacgugcccucuauccagagccgcggacucuucggcgcuauugccggguuuaucgagggaggcuggaccgggauggucgacggaugguacggcuaucaucaccagaaugaacaaggcuccggguacgccgcugaucugaaaucuacacagaacgcgaucgacgagauuaccaauaaggugaacagcguuaucgagaaaaugaauacgcaguucacagccgugggaaaggaguucaaccaccuugagaagagaauugaaaaucugaacaaaaaggucgaugacggcuuucucgauaucuggaccuacaaugcugagcugcuggugcuccuggaaaacgagcggacccuugacuaucaugauuccaaugucaaaaaccuguacgagaaggugcgcagccagcucaaaaacaaugccaaggaaauugggaacggauguuucgaguuuuaucacaagugcgacaauacauguauggaaucuguuaaaaacggcaccuacgauuauccuaaguacuccgaggaagccaaacugaauagagaggagaucgacggggugaaacuugaaagcacacggaucuaucaaauucuggcuaucuacucuacggucgccuccagccucgugcugguugugucccugggcgcgauuucuuucuggaugugcagcaacggaucccuccagugccgcaucuguauuuga

SEQ ID NO: 187157 - RNA, 1701 nt, Artificial Sequence; identical to SEQ ID NO: 185784
  derived and/or modified sequence opt5 from hemagglutinin__InfluenzaA__ADD14135

SEQ ID NO: 187158 - RNA, 1701 nt, Artificial Sequence; identical to SEQ ID NO: 185693
  derived and/or modified sequence opt5 from hemagglutinin__InfluenzaA__ADD14137

SEQ ID NO: 187159 - RNA, 1701 nt, Artificial Sequence; identical to SEQ ID NO: 186441
  derived and/or modified sequence opt5 from hemagglutinin__InfluenzaA__ADD14139

SEQ ID NO: 187160 - RNA, 1701 nt, Artificial Sequence; identical to SEQ ID NO: 185693
  derived and/or modified sequence opt5 from hemagglutinin__InfluenzaA__ADD14143

SEQ ID NO: 187161 - RNA, 1701 nt, Artificial Sequence; identical to SEQ ID NO: 185693
  derived and/or modified sequence opt5 from hemagglutinin__InfluenzaA__ADD14145

SEQ ID NO: 187162 - RNA, 1701 nt, Artificial Sequence; identical to SEQ ID NO: 185693
  derived and/or modified sequence opt5 from hemagglutinin__InfluenzaA__ADD14147

SEQ ID NO: 187163 - RNA, 1701 nt, Artificial Sequence
  derived and/or modified sequence opt5 from hemagglutinin__InfluenzaA__ADD14151
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuugucccagagccggcgcgaaaucuuuuuauaagaaucugaucuggcucguuaaaaagggcaacagcuacccuaaacuguccaagagcuauauuaaugacaaggggaaagaagugcuuguccuguggggaauccaucaccccuccaccucugccgaucaacagagccucuaccagaacgcugacgccuacguguucgugggcacaucccgguauagcaagaaauuuaagccugagauugcuauccgcccgaaagucagagaucaggaggggcggaugaauuacuauuggacccugguugaacccggagacaagauuacguucgaggccacaggcaaccugguggugccucgcuacgcguuugccauggaaagaaacgcugggucuggaaucauuaucuccgauacccccguccacgacugcaauacaaccugucaaaccccuaaaggcgccaucaacacaagccuccccuuccagaauauucauccgaucacgauuggcaagugcccuaaguaugugaaaucuaccaagcugcggcuugcuacagggcugcgcaacguucccagcauccaguccagaggacucuuuggcgccauugccggguucaucgagggaggcuggaccgggaugguggacggaugguacggcuaucaccaucagaaugaacaaggcucuggguacgcugcggaucugaaaagcacacagaacgccaucgacaagauuaccaauaaagucaacuccgugaucgagaagaugaauacgcaguuuacagcuguuggaaaggaguucaaccaccuugaaaaacggauugagaaucugaacaagaaaguggaugacggcuuccucgauaucuggaccuacaaugccgaacugcugguccuccuggagaacgaacgcacccuugacuaucacgauagcaaugugaagaaccuguacgagaaagucagaucucagcucaagaacaaugccaaggagauugggaacggauguuuugaguucuaucauaaaugcgacaauacauguauggaguccgugaagaacggcaccuacgauuauccuaaauacagcgaagaggcuaagcugaaucgggaagagaucgacgggguuaaacuugagucuacacgcaucuaucaaauucuggccaucuacuccacgguggcgagcucccucguccuggugguuucucugggcgcuauuagcuuuuggaugugcuccaacggaucucuccagugcagaaucuguauuuga

SEQ ID NO: 187164 - RNA, 1701 nt, Artificial Sequence; identical to SEQ ID NO: 185693
  derived and/or modified sequence opt5 from hemagglutinin__InfluenzaA__ADD14153

SEQ ID NO: 187165 - RNA, 1701 nt, Artificial Sequence; identical to SEQ ID NO: 185693
  derived and/or modified sequence opt5 from hemagglutinin__InfluenzaA__ADD14155

SEQ ID NO: 187166 - RNA, 1701 nt, Artificial Sequence; identical to SEQ ID NO: 185693
  derived and/or modified sequence opt5 from hemagglutinin__InfluenzaA__ADD14157

SEQ ID NO: 187167 - RNA, 1701 nt, Artificial Sequence; identical to SEQ ID NO: 185693
  derived and/or modified sequence opt5 from hemagglutinin__InfluenzaA__ADD14162

SEQ ID NO: 187168 - RNA, 1701 nt, Artificial Sequence; identical to SEQ ID NO: 185693
  derived and/or modified sequence opt5 from hemagglutinin__InfluenzaA__ADD14172

SEQ ID NO: 187169 - RNA, 1701 nt, Artificial Sequence; identical to SEQ ID NO: 185693
  derived and/or modified sequence opt5 from hemagglutinin__InfluenzaA__ADD14182

SEQ ID NO: 187170 - RNA, 1701 nt, Artificial Sequence; identical to SEQ ID NO: 185693
  derived and/or modified sequence opt5 from hemagglutinin__InfluenzaA__ADD14192

SEQ ID NO: 187171 - RNA, 1701 nt, Artificial Sequence; identical to SEQ ID NO: 185693
  derived and/or modified sequence opt5 from hemagglutinin__InfluenzaA__ADD14202

SEQ ID NO: 187172 - RNA, 1701 nt, Artificial Sequence
  derived and/or modified sequence opt5 from hemagglutinin__InfluenzaA__ADD21447
augaaggccauccugguguuccuccuguacaccuuugcuacagccaacgcggacacgcuuugcauuggcuaucacgcuaauaacagcaccgauacagucgacaccguucuggagaaaaaugugacagugacccauuccgucaaccuccuggaagauagacacaaugggaaacuuuguaagcugcggggaguggcuccccuccaucugggcaagugcaacaucgccggguggcugcucggaaauccugagugugaacugcuuuucacagccucuagcugguccuacauuguugagaccucuaacagcgacaauggcacgugcuauccgggggauuuuaucaacuacgaggagcugcgcgagcagcucuccucugugagcuccuucgaaagauuugagauguuccccaaaucuucuuccuggccuaaucacgaaaccaaccggggagucacagccgcuugucccuaugccggcgcgaauagcuuuuaccgcaaccugauuuggcuugugaagaaggagaauagcuauccuaaacuguccaagagcuacaucaacaacaaagagaaggaaguucucgugcuguggggcauccaucaucccccuaccucugccgaccaacagucccuguaccagaaugcugaugccuaugucuucguggggagcuccaaauacaacaagaaguuuagaccggagauugcugcccggcccaaagugcgcggacagacaggcagaaugaauuauuacuggacccucgucgaaccuggggacacgaucacauucgaggcgaccgaaaaccugguugugccccgguaugccuuugcuaugaagcgcggaucuggcagcgggauuaucauuuccgauacaccugugcacgacugcaauaccaccugucaaacacccaaaggagccaucaacacgagccuuccguuccagaauauucacccugucaccaucggcgagugccccaaguacgugaaaucuacaaaccugagaauggcuaccggccuccggaauaucccuuccauucagagccgcgggcuguuuggagccaucgccggcuucauugaagggggauggacaggcaugaucgaugggugguauggauaccaccaucagaacgaacaaggcucuggcuacgcugcggacagaaagagcacccagaaugccauugaugggaucacgaacaaaguuaauuccgugaucgagaagaugaacacacaguucaccgcugucggaaaggaauuuaaucaccuugagaaacggauugaaaaccugaacaagaaaguggacgacggccuccuggauguuuggaccuauaaugccgagcugcucgugcugcuugagaacgaacgcacacuggacuaccacgauucuaaugucaagaaccucuaugagaaagugagaagccagcugaagaauaacgccaaggaaaucgggaauggauguuucgaguuuuaccauaaaugcgacgauaccuguauggaauccguccggaacggcgcuuaugacuaccccaaguauagcgaggaggccaaacuuaauagagaagagauugauggggugaagcuggaaucuacacgcaucuaccaaauucucgcgaucuacuccacgguugcuagcucucuggugcugcucgucucccugggcgccaucagcuucuggaugugcuccaacggaucucuucagugccggauuuguaucuga

SEQ ID NO: 187173 - RNA, 1701 nt, Artificial Sequence
  derived and/or modified sequence opt5 from hemagglutinin__InfluenzaA__ADD21457
augaaggccauccugguguuccuccuguacaccuuugcuacagccaacgcggacacgcuuugcauuggcuaucacgcuaauaacagcaccgauacagucgacaccguucuggagaaaaaugugacagugacccauuccgucaaccuccuggaagauagacacaaugggaaacuuuguaagcugcggggaguggcuccccuccaucugggcaagugcaacaucgccggguggcugcucggaaauccugagugugaacugcuuuucacagccucuagcugguccuacauuguugagaccucuaacagcgacaauggcacgugcuauccgggggauuuuaucaacuacgaggagcugcgcgagcagcucuccucugugagcuccuucgaaagauuugagauguuccccaaauccucuuccuggccuaaucacgaaaccaaccggggagucacagccgcuugucccuaugccggcgcgaauagcuuuuaccgcaaccugauuuggcuugugaagaaggaaaauucuuauccuaaacuguccaagagcuacaucaacaacaaagagaaggaaguucucgugcuguggggcauccaucaucccccuaccucugccgaccaacagucccuguaccagaaugcugaugccuaugucuucguggggagcuccaaauacaacaagaaguuuagaccggagauugcugcccggcccaaagugcgcggacagacaggcagaaugaauuauuacuggacccucgucgaaccuggggacacgaucacauucgaggcgaccggaaaccugguugugccccgguaugccuuugcuaugaagcgcggcucugggagcggaauuaucauuuccgauacaccugugcacgacugcaauaccaccugucaaacacccaaaggcgccgucaacacgagccuuccguuccagaauauccacccugugaccauuggcgaaugccccaaguacguuaaaucuacaaaccugagaauggcuaccgggcuccggaauaucccuuccauccagagccgcggacuguuuggcgccauugccggguucaucgagggaggcuggacagggaugauugauggaugguauggcuaccaccaucagaacgagcaaggcucuggguacgcugcggacagaaagagcacccagaaugccaucgauggaauuacgaacaaagugaauagcgucaucgaaaagaugaacacacaguucaccgcugugggcaaggaguuuaaucaccuugaaaaacggaucgagaaccugaacaagaaaguugacgacgggcuccuggauguguggaccuauaaugccgaacugcucguccugcuugagaacgagcgcacacuggacuaccacgauucuaaugugaagaaccucuaugaaaaagucagaagccagcugaagaauaacgccaaggagauuggaaauggcuguuucgaauuuuaccauaaaugcgacgauaccuguauggaguccgugcggaacgggacauaugacuaccccaaguauagcgaagaggcuaaacuuaauagagaggaaaucgauggcguuaagcuggagucuacgcgcauuuaccaaauccucgccauuuacuccaccguggcgagcucucugguccugcucgugucccugggagcuaucagcuucuggaugugcuccaacggcucucuucagugccggaucuguauuuga

SEQ ID NO: 187174 - RNA, 1698 nt, Artificial Sequence
  derived and/or modified sequence opt5 from hemagglutinin__InfluenzaA__ADD21467
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaaggagagcucuuggccuaaucauaccgucacaggaguguccgcuagcugcucucacaacggcaaguccagcuuuuaccgcaaucugcuuuggcugaccggcaaaaacgggcucuaucccaaucugucuaaguccuacgccaacaauaaagaaaaggagguucuggugcucuggggaguccaucacccuccgaacaucagagaucagcgggcucuguaccacacagaaaacgccuaugugagcguggucuccucucauuacagccgcagauucacccccgagauugcgaaacggccuaagguucgcggccaggaagggagaaucaauuauuacuggacgcuucuggagcccggagacacaauuaucuuugaggccaacggcaaucucauugcuccuugguaugccuucgcucugucccggggguuuggaagcggcaucauuaccucuaacgcccccauggaugaaugugacgcgaagugccagacaccgcaaggcgccaucaauuccagccuuccuuuccagaacgugcaccccgugaccaucggggaguguccuaaauacgcucgcucugccaagcugagaauggucaccggacuccggaauauucccagcauccagucccgcggccuguuuggggcuauugccggauucaucgaaggcggguggacaggaaugguggauggcugguauggcuaccaucaccagaacgagcaagggucuggauacgccgcugaccagaaaagcacgcagaaugcgauuaacggcaucaccaauaagguuaacuccgugaucgaaaagaugaauacacaguuuaccgccgucgggaaagaguucaacaaacuggagagacggauggaaaaucucaacaagaagguggaugacggauuccuggauauuuggacauauaacgcugagcuucugguucuccuggaaaaugagcgcacccuugacuuucacgacagcaacgugaaaaaucuguacgaaaaggucaaaucucaacucaagaacaaugccaaagagaucggcaacgggugcuucgaguuuuaucauaaguguaauaacgaaugcauggaguccgugaagaauggcacguacgauuaucccaaauacagcgaagagucuaagcugaacagagagaaaauugacggagucaagcuggaauccaugggcguguaucagauccucgccauuuacagcacaguugcuuccucucuggugcuucuggucagccucggggccaucuccuucuggaugugcucuaauggaagccugcagugucggaucugcauuuga

SEQ ID NO: 187175 - RNA, 1701 nt, Artificial Sequence
  derived and/or modified sequence opt5 from hemagglutinin__InfluenzaA__ADD21560
augaagaccaucauugccuucagccacauccugugccucauuuacgcucagaaacugcccggcuccgacaacucuauggccacacuuugucuggggcaucacgcggugccuaauggaacgcucgucaagaccaucacagaugaccaaauugagguuaccaacgcuacagaacuggugcagagcuccucuaccggcagaaucugcaauagcccgcaucacauccuugaugggaaaaacuguacacugauugacgcccuccugggagauccccauugcgacgauuuucagaauaaggagugggaccuguucguggaacgguccaccgccuauucuaacuguuacccuuauuacguccccgauuaugcuagccuccgcucccugguggccagcucuggcacgcuugaguuuacccaggaauccuucaauuggacagggguuacccaagacggaagcucuuacacaugcagacggaaauccgugaacagcuuuuucucucgccugaauuggcuccacaaccuggauuauaaguacccugcucuuaaugucaccaugcccaacaaugacaaguuugauaaacuguacaucuggggcgugcaccauccuggcacggacagagaccagacaaaccucuauguucaggccuccgggcgggugaccgucagcacaaagcgcucccagcaaaccgugauuccgaauaucggaucuagacccugggugcggggcgucagcuccauuaucagcauuuacuggaccaucguuaaaccuggggauauccugcugauuaacucuacaggaaaccucaucgcgccccgcggcuauuucaagauucaguccgggaaaagcucuaucaugagaagcgacgccccuauuggaaauuguaacuccgagugcaucacgcccaauggcucuaucccgaacgauaagccuuuucagaaugugaaccggauuaccuacggcgcuuguccccgcuaugugaagcagaauacacugaaacuugccaccgggaugagaaacgucccugagaagcaaacacggggaaucuucggcgcuauugccggguuuaucgaaaauggaugggagggcaugguggacgggugguacggauuccgccaccagaacagcgaaggcaccggccaggcggccgaucugaaauccacgcaagcugccauuaaucagaucacagggaagcucaacagaguuaucaaaaagaccaaugagaaauuucaucagauugagaaggaguucagcgaaguggaaggacggauccaggaccuggagaaguaugucgaagauaccaaaauugaccuuuggucuuacaacgcugagcugcucguggcccuggagaaucaacacacaaucgaucugaccgacuccgaaaugaacaaacucuucgagagaacacgcaagcagcugcgggaaaacgccgaggauaugggcaaugggugcuuuaagauuuaccacaaaugugacaacgcuugcaucggaagcauuagaaauggcacguaugaccaugauguuuaccgcgacgaagcgcuuaacaaucgguuccagaucaagucugugcagcugaaguccggguauaaagauuggauccucuggauuagcuuugccauguccugcuuccugcuuugugucgugcugcucggcuuuaucauguggaccugccaaaagggaaacauuaaauguaauaucugcauuuga

SEQ ID NO: 187176 - RNA, 1701 nt, Artificial Sequence; identical to SEQ ID NO: 185680
  derived and/or modified sequence opt5 from hemagglutinin__InfluenzaA__ADD21734

SEQ ID NO: 187177 - RNA, 1701 nt, Artificial Sequence; identical to SEQ ID NO: 185693
  derived and/or modified sequence opt5 from hemagglutinin__InfluenzaA__ADD21744

SEQ ID NO: 187178 - RNA, 1701 nt, Artificial Sequence
  derived and/or modified sequence opt5 from hemagglutinin__InfluenzaA__ADD21764
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugagucugggaucauuaucuccgauacccccguccaugacugcaauacaaccugucaaaccccuaaaggagccaucaacacaagccuccccuuccagaauauucacccgaucacgauuggcaagugcccuaaguaugugaaaucuaccaagcugagacuugcuacaggccugcggaacguucccagcauccagucccgcgggcucuuuggagccauugccggcuucaucgaagggggauggaccggcaugguggacgggugguacggauaucaucaccagaaugagcaaggcucuggcuacgcugcggaucugaaaagcacacagaacgccaucgacgagauuaccaauaaggucaacuccgugaucgaaaagaugaauacgcaguuuacagcuguugggaaggaguucaaccaccuugaaaagagaauugagaaucugaacaaaaagguggaugacggauuccucgauaucuggaccuacaaugccgaacugcugguccuccuggagaacgagcggacccuugacuaucaugauagcaaugugaaaaaccuguacgaaaagguccgcucucagcucaaaaacaaugccaaggagauuggcaacggguguuuugaguucuaucacaagugcgacaauacauguauggaguccgugaaaaacggaaccuacgauuauccuaaguacagcgaagaggcuaaacugaauagagaggaaaucgacggcguuaaacuugagucuacacggaucuaucaaauucuggccaucuacuccacgguggcgagcucccucguccuggugguuucucugggggcuauuagcuuuuggaugugcuccaacggcucucuccagugccgcaucuguauuuga

SEQ ID NO: 187179 - RNA, 1701 nt, Artificial Sequence
  derived and/or modified sequence opt5 from hemagglutinin__InfluenzaA__ADD21774
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucuccccuuccagaauauucacccgaucacaauuggcaagugcccuaaguaugugaaaagcacgaagcugagacuugcuaccgggcugcggaacguucccuccgugcagucucgcggacucuuuggcgccaucgccggguucauugagggaggcuggacagggauggucgacggaugguacggcuaucaucaccagaaugaacaaggcagcggguacgcugcggaucugaaauccacccagaacgccaucgacgagaucacaaauaaggugaacagcguuauugagaaaaugaauacccaguuuacggcugugggaaaggaguucaaccaccuugagaagagaaucgaaaaucugaacaaaaaggucgaugacggcuuccucgauauuuggacauacaaugccgagcugcuggugcuccuggaaaacgagcggacccuugacuaucaugauucuaaugucaaaaaccuguacgagaaggugcgcucccagcucaaaaacaaugccaaggaaaucgggaacggauguuuugaguucuaucacaagugcgacaauaccuguauggaaagcguuaaaaacggcacauacgauuauccuaaguacucugaggaagcuaaacugaauagagaggagauugacggggugaaacuugaauccacccggaucuaucaaauccuggccauuuacagcacagucgcguccucucucgugcugguugugagccugggcgcuaucuccuuuuggaugugcucuaacggaagccuccagugccgcauuuguaucuga

SEQ ID NO: 187180 - RNA, 1701 nt, Artificial Sequence; identical to SEQ ID NO: 185693
  derived and/or modified sequence opt5 from hemagglutinin__InfluenzaA__ADD21784

SEQ ID NO: 187181 - RNA, 1701 nt, Artificial Sequence; identical to SEQ ID NO: 186853
  derived and/or modified sequence opt5 from hemagglutinin__InfluenzaA__ADD21794

SEQ ID NO: 187182 - RNA, 1701 nt, Artificial Sequence; identical to SEQ ID NO: 185693
  derived and/or modified sequence opt5 from hemagglutinin__InfluenzaA__ADD21804

SEQ ID NO: 187183 - RNA, 1701 nt, Artificial Sequence
  derived and/or modified sequence opt5 from hemagglutinin__InfluenzaA__ADD21814
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccucuuggauucuggggaauccugagugugaaagccucuccacagccucuagcugguccuacaucguggagaccucuagcuccgacaacggaacgugcuauccgggcgauuuuauugacuacgaggagcugcgggagcagcuuagcucugucuccagcuucgaacgcuuugagaucuuccccaagaccucuuccuggccuaaucacgauagcaacaagggggugacagccgcuuguccccaugccggagcgaaaucuuuuuauaagaaucugaucuggcucguuaaaaagggcaacuccuacccuaaacugagcaaguccuauauuaaugacaagggcaaagaagugcuuguccugugggggauccaccaccccucuaccagcgccgaucaacagucccucuaccagaacgcugacgccuacguguucgugggaacaagcagauauucuaagaaauuuaagccugagauugcuauccggccgaaaguccgcgaucaggagggcagaaugaauuacuauuggacccugguugaacccggggacaagauuacguucgaggccacaggaaaccugguggugccucgguacgcguuugccauggaacgcaacgcuggcuccgggaucauuaucagcgauacccccguccaugacugcaauacaaccugucaaaccccuaaaggagccaucaacacaucucuccccuuccagaauauucacccgaucacgauuggcaagugcccuaaguaugugaaaagcaccaagcugagacuugcuacaggccugcggaacguucccuccauccagucucgcgggcucuuuggagccauugccggcuucaucgaagggggauggaccggcaugguggacgggugguacggauaucaucaccagaaugaacaaggcagcggcuacgcugcggaucugaaauccacacagaacgccaucgacgagauuaccaauaaggucaacagcgugaucgagaaaaugaauacgcaguuuacagcuguugggaaggaguucaaccaccuugaaaagagaauugaaaaucugaacaaaaagguggaugacggauuccucgauaucuggaccuacaaugccgagcugcugguccuccuggaaaacgagcggacccuugacuaucaugauucuaaugugaaaaaccuguacgagaagguccgcucccagcucaaaaacaaugccaaggaaauuggcaacggguguuuugaguucuaucacaagugcgacaauacauguauggaaagcgugaaaaacggaaccuacgauuauccuaaguacucugaggaagcuaaacugaauagagaggagaucgacggcguuaaacuugaauccacacggaucuaucaaauucuggccaucuacagcacgguggcguccucucucguccuggugguuagccugggggcuauuuccuuuuggaugugcucuaacggcagccuccagugccgcaucuguauuuga

SEQ ID NO: 187184 - RNA, 1701 nt, Artificial Sequence; identical to SEQ ID NO: 186853
  derived and/or modified sequence opt5 from hemagglutinin__InfluenzaA__ADD21824

SEQ ID NO: 187185 - RNA, 1701 nt, Artificial Sequence; identical to SEQ ID NO: 186853
  derived and/or modified sequence opt5 from hemagglutinin__InfluenzaA__ADD21834

SEQ ID NO: 187186 - RNA, 1701 nt, Artificial Sequence; identical to SEQ ID NO: 186857
  derived and/or modified sequence opt5 from hemagglutinin__InfluenzaA__ADD21844

SEQ ID NO: 187187 - RNA, 1701 nt, Artificial Sequence; identical to SEQ ID NO: 186857
  derived and/or modified sequence opt5 from hemagglutinin__InfluenzaA__ADD21854

SEQ ID NO: 187188 - RNA, 1701 nt, Artificial Sequence; identical to SEQ ID NO: 186795
  derived and/or modified sequence opt5 from hemagglutinin__InfluenzaA__ADD21864

SEQ ID NO: 187189 - RNA, 1701 nt, Artificial Sequence
  derived and/or modified sequence opt5 from hemagglutinin__InfluenzaA__ADD21884
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcggcaacgggacgugcuauccgggagacuuuauugauuacgaagaacugcgggagcagcuuuccagcgucucuuccuucgaacgcuuugagaucuuccccaagaccagcucuuggccuaaucacgacuccaacaagggcgugacagccgcuuguccccaugccggcgcgaaaucuuuuuauaagaaucugaucuggcucguuaaaaaggggaacagcuacccuaaacuguccaagagcuauauuaaugauaagggaaaagaagugcuuguccuguggggcauccaccaccccuccaccucugccgaccaacagagccucuaccagaacgcugaugccuacguguucguggggacauccagauauagcaagaaauuuaagccugagauugcuauccggccgaaaguccgcgaccaggagggaagaaugaauuacuauuggacccugguugaacccggcgauaagauuacguucgaggccacagggaaccugguggugccucgguacgcguuugccauggaacgcaacgcuggaucuggcaucauuaucuccgacacccccguccaugauugcaauacaaccugucaaaccccuaaaggcgccaucaacacaagccuccccuuccagaauauucacccgaucacgauugggaagugcccuaaguaugugaaaucuaccaagcugagacuugcuacaggacugcggaacguucccagcauccagucccgcggccucuuuggggccauugccggauucaucgagggcggguggaccggaaugguggacggcugguacggcuaucaucaccagaaugaacaagggucuggauacgcugcggaccugaaaagcacacagaacgccaucgaugagauuaccaauaaggucaacuccgugaucgagaaaaugaauacgcaguuuacagcuguuggcaaggaguucaaccaccuugagaagagaauugaaaaucugaacaaaaagguggacgauggguuccucgacaucuggaccuacaaugccgagcugcugguccuccuggaaaacgagcggacccuugauuaucaugacagcaaugugaaaaaccuguacgagaagguccgcucucagcucaaaaacaaugccaaggaaauuggaaacggcuguuuugaguucuaucacaagugcgauaauacauguaugggguccgugaaaaacggcaccuacgacuauccuaaguacagcgaagaggcuaaacugaauagagaagagaucgauggaguuaaacuugagucuacacggaucuaucaaauucuggccaucuacuccacgguggcgagcucccucguccuggugguuucucugggcgcuauuagcuuuuggaugugcuccaacgggucucuccagugccgcaucuguauuuga

SEQ ID NO: 187190 - RNA, 1701 nt, Artificial Sequence; identical to SEQ ID NO: 186795
  derived and/or modified sequence opt5 from hemagglutinin__InfluenzaA__ADD21894

SEQ ID NO: 187191 - RNA, 1701 nt, Artificial Sequence
  derived and/or modified sequence opt5 from hemagglutinin__InfluenzaA__ADD22501
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccaaguauagcaaaaaguuuaaaccugagauugcuaucagaccgaagguccgggaucaggaggggcgcaugaauuacuauuggacccugguugaacccggagacaaaauuacguucgaggccacaggcaaccugguggugccuagauacgcguuugccauggaacggaacgcugggucuggaaucauuaucuccgauacccccguccaugacugcaauacaaccugucaaaccccuaagggcgccaucaacacaagccuccccuuccagaauauucacccgaucacgauuggcaagugcccuaaauaugugaagucuaccaaacugcgccuugcuacagggcugagaaacguucccagcauccagucccggggacucuuuggcgccauugccggguucaucgagggaggcuggaccgggaugguggacggaugguacggcuaucaucaccagaaugaacaaggcucuggguacgcugcggaucuuaagagcacacagaacgccaucgacgagauuaccaauaaagucaacuccgugaucgagaagaugaauacgcaguuuacagcuguuggaaaggaguucaaccaccuggagaaacgcauugaaaaucugaacaagaaaaucgaugacggcuuccucgauauuuggaccuacaaugccgagcugcuggugcuccuggaaaacgagagaacccuugacuaucaugauagcaaugucaagaaccuguacgagaaagugcggauccagcucaagaacaaugccaaggaaaucgggaacggauguuuugaguucuaucacaaaugcgacaauacauguauggaaucugucaagaacggcaccuacgauuauccuaaauacuccgaggaagcuaagcugaaucgcgaggagauugacggggugaaacuugaaagcacaagaaucuaucaaauucuggccaucuacucuacgguugcguccagccucgugcuggucgugucccugggcgcuauuucuuuuuggaugugcagcaacggaucccuccagugccggaucuguauuuga

SEQ ID NO: 187192 - RNA, 1701 nt, Artificial Sequence; identical to SEQ ID NO: 186795
  derived and/or modified sequence opt5 from hemagglutinin__InfluenzaA__ADD22511

SEQ ID NO: 187193 - RNA, 1701 nt, Artificial Sequence
  derived and/or modified sequence opt5 from hemagglutinin__InfluenzaA__ADD22521
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacacauacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacgagauuacgaauaaggucaacuccgugaucgagaaaaugaauacacaguuuaccgccguuggaaaggaguucaaccaccuugagaagagaauugaaaaucugaacaaaaagaucgaugacggcuuccucgauauuuggaccuacaaugcugagcugcuggugcuccuggaaaacgagcggacacuugacuaucaugauagcaaugucaaaaaccuguacgagaaggugcgcucucagcucaaaaacaaugccaaggaaaucgggaacggauguuuugaguucuaucacaagugcgacaauaccuguauggaauccgucaaaaacggcacauacgauuauccuaaguacagcgaggaagccaaacugaauagagaggagaucgacggggugaaacuugaaucuacgcggauuuaucaaauccuggcuauuuacuccaccguugccagcucccucgugcuggucgugucucugggcgcgaucagcuuuuggaugugcuccaacggaucucuccagugccgcauuuguaucuga

SEQ ID NO: 187194 - RNA, 1701 nt, Artificial Sequence; identical to SEQ ID NO: 185693
  derived and/or modified sequence opt5 from hemagglutinin__InfluenzaA__ADD22531

SEQ ID NO: 187195 - RNA, 1701 nt, Artificial Sequence
  derived and/or modified sequence opt5 from hemagglutinin__InfluenzaA__ADD22541
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcggcaacgggacgugcuauccgggagacuuuauugauuacgaagaacugcgggagcagcuuuccagcgucucuuccuucgaacgcuuugagaucuuccccaagaccagcucuuggccuaaucacgacuccaacaagggcgugacagccgcuuguccccaugccggcgcgaaaucuuuuuauaagaaucugaucuggcucguuaaaaaggggaacagcuacccuaaacuguccaagagcuauauuaaugauaagggaaaagaagugcuuguccuguggggcauccaccaccccuccaccucugccgaccaacagagccucuaccagaacgcugaugccuacguguucguggggacauccaaguauagcaaaaaguuuaaaccugagauugcuaucagaccgaagguccgggaccaggagggacgcaugaauuacuauuggacccugguugaacccggcgauaaaauuacguucgaggccacagggaaccugguggugccuagauacgcguuugccauggaacggaacgcuggaucuggcaucauuaucuccgacacccccguccaugauugcaauacaaccugucaaaccccuaagggcgccaucaacacaagccuccccuuccagaauauucacccgaucacgauugggaagugcccuaaauaugugaagucuaccaaacugcgccuugcuacaggacugagaaacguucccagcauccagucccggggccucuuuggggccauugccggauucaucgagggcggguggaccggaaugguggacggcugguacggcuaucaucaccagaaugaacaagggucuggauacgcugcggaccuuaagagcacacagaacgccaucgaugagauuaccaauaaagucaacuccgugaucgagaagaugaauacgcaguuuacagcuguuggcaaggaguucaaccaccuggagaaacgcauugaaaaucugaacaagaaaguggacgauggguuccucgacaucuggaccuacaaugccgagcugcugguccuccuggaaaacgagagaacccuugauuaucaugacagcaaugugaagaaccuguacgagaaaguccggucucagcucaagaacaaugccaaggaaauuggaaacggcuguuuugaguucuaucacaaaugcgauaauacauguauggaauccgugaagaacgggaccuacgacuauccuaaauacagcgaggaagcuaagcugaaucgcgaggagaucgauggcguuaaacuugaaucuacaagaaucuaucaaauucuggccaucuacuccacgguggcgagcucccucguccuggugguuucucugggagcuauuagcuuuuggaugugcuccaacggcucucuccagugccggaucuguauuuga

SEQ ID NO: 187196 - RNA, 1701 nt, Artificial Sequence; identical to SEQ ID NO: 186795
  derived and/or modified sequence opt5 from hemagglutinin__InfluenzaA__ADD22554

SEQ ID NO: 187197 - RNA, 1701 nt, Artificial Sequence; identical to SEQ ID NO: 186795
  derived and/or modified sequence opt5 from hemagglutinin__InfluenzaA__ADD22564

SEQ ID NO: 187198 - RNA, 1701 nt, Artificial Sequence
  derived and/or modified sequence opt5 from hemagglutinin__InfluenzaA__ADD22574
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacacauacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacacucaaaggcgcuaucaacacgagccugccuuuccagaauauucaccccaucaccauuggcaagugcccgaaguaugugaaaucuacaaaacuuagacuggccaccgggcuccggaacguuccuagcauccagucccgcggacuguuuggcgcuauugccggguucaucgagggaggcuggacagggaugguggacggaugguacggcuaucaucaccagaaugaacaaggcucuggguacgccgcugaucuuaagagcacccagaacgcgaucgacgagauuacgaauaaggucaacuccgugaucgagaaaaugaauacacaguuuaccgccguuggaaaggaguucaaccaccuggagaagagaauugaaaaucucaacaaaaagaucgaugacggcuuccuggauauuuggaccuacaaugcugagcugcucgugcugcuugaaaacgagcggacacuggacuaucaugauagcaaugucaaaaaccucuacgagaaggugcgcucucagcugaaaaacaaugccaaggaaaucgggaacggauguuuugaguucuaucacaagugcgacaauaccuguauggaauccgucaaaaacggcacauacgauuaucccaaguacagcgaggaagccaaacuuaauagagaggagaucgacggggugaagcuggaaucuacgcggauuuaucaaauccucgcuauuuacuccaccguugccagcucccuggugcuggucgugucucucggcgcgaucagcuuuuggaugugcuccaacggaucucugcagugccgcauuuguaucuga

SEQ ID NO: 187199 - RNA, 1701 nt, Artificial Sequence; identical to SEQ ID NO: 186795
  derived and/or modified sequence opt5 from hemagglutinin__InfluenzaA__ADD22584

SEQ ID NO: 187200 - RNA, 1701 nt, Artificial Sequence; identical to SEQ ID NO: 185693
  derived and/or modified sequence opt5 from hemagglutinin__InfluenzaA__ADD22594

SEQ ID NO: 187201 - RNA, 1701 nt, Artificial Sequence; identical to SEQ ID NO: 186795
  derived and/or modified sequence opt5 from hemagglutinin__InfluenzaA__ADD22604

SEQ ID NO: 187202 - RNA, 1701 nt, Artificial Sequence; identical to SEQ ID NO: 186795
  derived and/or modified sequence opt5 from hemagglutinin__InfluenzaA__ADD22614

SEQ ID NO: 187203 - RNA, 1701 nt, Artificial Sequence; identical to SEQ ID NO: 186795
  derived and/or modified sequence opt5 from hemagglutinin__InfluenzaA__ADD22624

SEQ ID NO: 187204 - RNA, 1701 nt, Artificial Sequence
  derived and/or modified sequence opt5 from hemagglutinin__InfluenzaA__ADD22634
augaaggccauccuggugguccuccugugcaccuucgcuacagccaacgcggacacgcuuuguauuggcuaccacgcuaauaacagcaccgauacaguugacaccgugcuggagaagaaugugacagucacccauuccgugaaccuccuggaagauaagcacaaugggaaacuuugcaagcugagaggaguugcuccccuccaucugggcaaauguaacaucgccggguggauucugggaaauccugagugcgaaucucucagcacagccuccucuuggagcuauaucguggagaccuccucuagcgacaacggcacguguuacccgggggauuuuauugacuaugaagaacugcgggagcagcuuuccagcgucucuuccuucgaacgcuuugagaucuuccccaagaccagcucuuggccuaaucacgauuccaacaagggagugacagccgcuugcccccaugccggcgcgaaaucuuuuuacaagaaucugaucuggcucguuaaaaagggcaacagcuauccuaaacuguccaagagcuacauuaaugacaaggggaaagaagugcuuguccuguggggaauccaccaccccuccaccucugccgaucaacagagccucuaucagaacgcugacgccuacguguucgugggcacauccagauacagcaagaaauuuaagccugagauugcuauccggccgaaaguccgcgaucaggaggggagaaugaauuauuacuggacccugguugaacccggagacaagauuacguucgaggccacaggcaaccugguggugccucgguaugcguuugccauggaacgcaacgcugggucuggaaucauuaucuccgauacccccguccaugacuguaauacaaccugccaaaccccuaaaggcgccaucaacacaagccuccccuuccagaauauucacccgaucacgauuggcaaguguccuaaguacgugaaaucuaccaagcugagacuugcuacagggcugcggaacguucccagcauccagucccgcggacucuuuggcgccauugccggguucaucgagggaggcuggaccgggaugguggacggaugguauggcuaccaucaccagaaugaacaaggcucuggguaugcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagaucgaugacggcuuccucgauauuuggaccuacaaugccgagcugcuggugcuccuggaaaacgagcggacccuugacuaccaugauagcaaugucaaaaaccuguaugagaaggugcgcucucagcucaaaaacaaugccaaggaaaucgggaacggaugcuuugaguucuaccacaagugugacaauacaugcauggaauccgucaaaaacggcaccuaugauuacccuaaguauagcgaggaagcuaaacugaauagagaggagaucgacggggugaaacuugaaucuacacggauuuaccaaauccuggccauuuauuccacgguugcgagcucccucgugcuggucgugucucugggcgcuaucagcuuuuggaugugcuccaacggaucucuccagugucgcauuugcaucuga

SEQ ID NO: 187205 - RNA, 1701 nt, Artificial Sequence
  derived and/or modified sequence opt5 from hemagglutinin__InfluenzaA__ADD22645
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcggcaacgggacgugcuauccgggagacuuuauugauuacgaagaacugcgggagcagcuuuccagcgucucuuccuucgaacgcuuugagaucuuccccaagaccagcucuuggccuaaucacgacuccaacaagggcgugacagccgcuuguccccaugccggcgcgaaaucuuuuuauaagaaucugaucuggcucguuaaaaaggggaacagcuacccuaaacuguccaagagcuauauuaaugauaagggaaaagaagugcuuguccuguggggcauccaccaccccuccaccucugccgaccaacagagccucuaccagaacgcugaugccuacguguucguggggacauccagauauagcaagaaauuuaagccugagauugcuauccggccgaaaguccgcgaccaggagggaagaaugaauuacuauuggacccugguugaacccggcgauaagauuacguucgaggccacagggaaccugguggugccucgguacgcguuugccauggaacgcaacgcuggaucuggcaucauuaucuccgacacccccguccaugauugcaauacaaccugucaaaccccuaaaggcgccaucaacacaagccuccccuuccagaauauucacccgaucacgauugggaagugcccuaaguaugugaaaucuaccaagcugagacuugcuacaggacugcggaacguucccagcauccagucccgcggccucuuuggggccauugccggauucaucgagggcggguggaccggaaugguggacggcugguacggcuaucaucaccagaaugaacaagggucuggauacgcugcggaccugaaaagcacacagaacgccaucgaugagauuaccaauaaggucaacuccgugaucgagaaaaugaauacgcaguuuacagcuguuggcaaggaguucaaccaccuugagaagagaauugaaaaucugaacaaaaagguggacgauggguuccucgacaucuggaccuacaaugccgagcugcugguccuccuggaaaacgagcggacccuugauuaucaugacagcaaugugaaaaaccuguacgagaagguccgcucucagcucaaaaacaaugccaaggaaauuggaaacggcuguuuugaguucuaucacaagugcgauaauacauguauggaauccgugaaaaacgggaccuacgacuauccuaaguacagcgaggaagcuaaacugaauagagaggagaucgaaggcguuaaacuugagucuacacggaucuaucaaauucuggccaucuacuccacgguggcgagcucccucguccuggugguuucucugggagcuauuagcuuuuggaugugcuccaacggcucucuccagugccgcaucuguauuuga

SEQ ID NO: 187206 - RNA, 1701 nt, Artificial Sequence
  derived and/or modified sequence opt5 from hemagglutinin__InfluenzaA__ADD22665
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcggcaacgggacgugcuauccgggagacuuuauugauuacgaagaacugcgggagcagcuuuccagcgucucuuccuucgaacgcuuugagaucuuccccaagaccagcucuuggccuaaucacgacuccaacaagggcgugacagccgcuuguccccaugccggcgcgaaaucuuuuuauaagaaucugaucuggcucguuaaaaaggggaacagcuacccuaaacuguccaagagcuauauuaaugauaagagaaaagaagugcuuguccuguggggaauccaccaccccuccaccucugccgaccaacagagccucuaccagaacgcugaugccuacguguucgugggcacauccaaguauagcaaaaaguuuaaaccugagauugcuauccggccgaagguccgcgaccaggaggggagaaugaauuacuauuggacccugguugaacccggagauaaaauuacguucgaggccacaggcaaccugguggugccucgguacgcguuugccauggaacgcaacgcugggucuggaaucauuaucuccgacacccccguccaugauugcaauacaaccugucaaaccccuaagggcgccaucaacacaagccuccccuuccagaauauucacccgaucacgauuggcaagugcccuaaauaugugaagucuaccaaacugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaccuuaagagcacacagaacgccaucgaugagauuaccaauaaagucaacuccgugaucgagaagaugaauacgcaguuuacagcuguuggaaaggaguucaaccaccuggagaaaagaauugaaaaucugaacaagaaaguggacgauggcuuccucgacaucuggaccuacaaugccgagcugcugguccuccuggaaaacgagcggacccuugauuaucaugacagcaaugugaagaaccuguacgagaaaguccgcucucagcucaagaacaaugccaaggaaauugggaacggauguuuugaguucuaucacaaaugcgauaauacauguauggaauccgugaagaacggcaccuacgacuauccuaaauacagcgaggaagcuaagcugaauagagaggagaucgaugggguuaaacuugaaucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 187207 - RNA, 1701 nt, Artificial Sequence; identical to SEQ ID NO: 186795
  derived and/or modified sequence opt5 from hemagglutinin__InfluenzaA__ADD22675

SEQ ID NO: 187208 - RNA, 1701 nt, Artificial Sequence; identical to SEQ ID NO: 186795
  derived and/or modified sequence opt5 from hemagglutinin__InfluenzaA__ADD22685

SEQ ID NO: 187209 - RNA, 1701 nt, Artificial Sequence; identical to SEQ ID NO: 186795
  derived and/or modified sequence opt5 from hemagglutinin__InfluenzaA__ADD22695

SEQ ID NO: 187210 - RNA, 1701 nt, Artificial Sequence
  derived and/or modified sequence opt5 from hemagglutinin__InfluenzaA__ADD22722
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauagacacaaugggaaacuuuguaagcugcggggaguugcgccccuccaucugggcaagugcaacaucgccggguggauucugggaaauccugagugugaaucucucagcacagcuuccucuuggagcuacaucguggagaccuccucuagcggcaacgggacgugcuauccgggagacuuuauugauuacgaagaacugcgcgagcagcuuuccagcgucucuuccuucgaaagauuugagaucuuccccaaaaccagcucuuggccuaaucacgacuccaacaagggcgugacagccgcuuguccccaugccggcgccaagagcuuuuauaaaaaucugaucuggcucguuaagaaagggaacucuuacccuaagcuguccaaaagcuauauuaaugauaagggaaaggaagugcuuguccuguggggcauccaccaccccuccaccucugccgaccaacagagccucuaccagaacgcugaugccuacguguucguggggacauccagcuauucuaaaaaguuuaaaccugagauugcuauccggccgaagguccgcgaccaggagggaagaaugaauuacuauuggacccugguugaacccggcgauaaaauuacguucgaggccacagggaaccugguggugccucgguacgcguuugccauggaacgcaacgcuggauccggcaucauuaucagcgacacccccguccaugauugcaauacaaccugucaaaccccuaagggcgccaucaacacaucucuccccuuccagaauauucacccgaucacgauugggaaaugcccuaaguauguuaagagcaccaaacugagacuugcuacaggacugcggaacgugcccuccauccagucucgcggccucuuuggggccauugccggauucaucgagggcggguggaccggaaugguggacggcugguacggcuaucaucaccagaaugaacaagggagcggauacgcugcggaccugaaguccacacagaacgccaucgaugagauuaccaauaaagucaacagcgugaucgagaagaugaauacgcaguuuacagcuguuggcaaagaguucaaccaccuugagaagagaauugaaaaucugaacaagaaaguggacgauggguuccucgacaucuggaccuacaaugccgagcugcugguccuccuggaaaacgagcggacccuugauuaucaugacucuaaugugaagaaccuguacgagaaaguccgcucccagcucaagaacaaugccaaagaaauuggaaacggcuguuuugaguucuaucacaagugcgauaauacauguauggaaagcgugaagaacgggaccuacgacuauccuaaauacucugaggaagcuaagcugaauagagaggagaucgauggcguuaaacuugaauccacacggaucuaucaaauucuggccaucuacagcacgguggcguccucucucguccuggugguuagccugggagcuauuuccuuuuggaugugcucuaacggcagccuccagugccgcaucuguauuuga

SEQ ID NO: 187211 - RNA, 1701 nt, Artificial Sequence; identical to SEQ ID NO: 187193
  derived and/or modified sequence opt5 from hemagglutinin__InfluenzaA__ADD22732

SEQ ID NO: 187212 - RNA, 1701 nt, Artificial Sequence
  derived and/or modified sequence opt5 from hemagglutinin__InfluenzaA__ADD22742
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcggcaacgggacgugcuauccgggagacuuuauugauuacgaagaacugcgggagcagcuuuccagcgucucuuccuucgaacgcuuugagaucuuccccaagaccagcucuuggccuaaucacgacuccaacaagggcgugacagccgcuuguccccaugccggcgcgaaaucuuuuuauaagaaucugaucuggcucguuaaaaaggggaacagcuacccuaaacuguccaagagcuauauuaaugauaagggaaaagaagugcuuguccuguggggcauccaccaccccuccaccucugccgaccaacagagccucuaccagaacgcugaugccuacguguucguggggacauccagcuauucuaagaaauuuaagccugagauugcuaucagaccgaaaguccgggaccaggagggacgcaugaauuacuauuggacccugguugaacccggcgauaagauuacguucgaggccacagggaaccugguggugccuagauacgcguuugccauggaacggaacgcuggauccggcaucauuaucagcgacacccccguccaugauugcaauacaaccugucaaaccccuaaaggcgccaucaacacaucucuccccuuccagaauauucacccgaucacgauugggaagugcccuaaguaugugaaaagcaccaagcugcgccuugcuacaggacugagaaacguucccuccauccagucucggggccucuuuggggccauugccggauucaucgagggcggguggaccggaaugguggacggcugguacggcuaucaucaccagaaugaacaagggagcggauacgcugcggaccugaaauccacacagaacgccaucgaugagauuaccaauaaggucaacagcgugaucgagaaaaugaauacgcaguuuacagcuguuggcaaggaguucaaccaccuugagaagcgcauugaaaaucugaacaaaaagguggacgauggguuccucgacaucuggaccuacaaugccgagcugcugguccuccuggaaaacgagagaacccuugauuaucaugacucuaaugugaaaaaccuguacgagaagguccggucccagcucaaaaacaaugccaaggaaauuggaaacggcuguuuugaguucuaucacaagugcgauaauacauguauggaaagcgugaaaaacgggaccuacgacuauccuaaguacucugaggaagcuaaacugaaucgcgaggagaucgauggcguuaaacuugaauccacaagaaucuaucaaauucuggccaucuacagcacgguggcguccucucucguccuggugguuagccugggagcuauuuccuuuuggaugugcucuaacggcagccuccagugccggaucuguauuuga

SEQ ID NO: 187213 - RNA, 1701 nt, Artificial Sequence; identical to SEQ ID NO: 185693
  derived and/or modified sequence opt5 from hemagglutinin__InfluenzaA__ADD22752

SEQ ID NO: 187214 - RNA, 1701 nt, Artificial Sequence; identical to SEQ ID NO: 185784
  derived and/or modified sequence opt5 from hemagglutinin__InfluenzaA__ADD22762

SEQ ID NO: 187215 - RNA, 1701 nt, Artificial Sequence; identical to SEQ ID NO: 186795
  derived and/or modified sequence opt5 from hemagglutinin__InfluenzaA__ADD22772

SEQ ID NO: 187216 - RNA, 1701 nt, Artificial Sequence; identical to SEQ ID NO: 186795
  derived and/or modified sequence opt5 from hemagglutinin__InfluenzaA__ADD22782

SEQ ID NO: 187217 - RNA, 1701 nt, Artificial Sequence
  derived and/or modified sequence opt5 from hemagglutinin__InfluenzaA__ADD22792
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcggcaacgggacgugcuauccgggagacuuuauuaauuacgaagaacugcgggagcagcuuuccagcgucucuuccuucgaacgcuuugagaucuuccccaagaccagcucuuggccuaaccacgauuccaauaagggcgugacagccgcuuguccccaugccggcgcgaaaucuuuuuauaagaaccugaucuggcucguuaaaaaggggaauagcuacccuaaacuguccaagagcuauauuaacgacaagggaaaagaagugcuuguccuguggggcauccaccaccccuccaccucugccgaucaacagagccucuaccagaaugcugacgccuacguguucguggggacauccagauauagcaagaaauuuaagccugagauugcuauccggccgaaaguccgcgaucaggagggaagaaugaacuacuauuggacccugguugaacccggcgacaagauuacguucgaggccacagggaaccugguggugccucgguacgcguuugccauggaacgcaaugcuggaucuggcaucauuaucuccgauacccccguccaugacugcaacacaaccugucaaaccccuaaaggcgccaucaauacaagccuccccuuccagaacauucacccgaucacgauugggaagugcccuaaguaugugaaaucuaccaagcugagacuugcuacaggacugcggaauguucccagcauccagucccgcggccucuuuggggccauugccggauucaucgagggcggguggaccggaaugguggauggcugguacggcuaucaucaccagaacgaacaagggucuggauacgcugcggaccugaaaagcacacagaaugccaucgacgagauuaccaacaaggucaauuccgugaucgagaaaaugaacacgcaguuuacagcuguuggcaaggaguucaaucaccuugagaagagaauugaaaaccugaauaaaaagguggaugacggguuccucgauaucuggaccuacaacgccgagcugcugguccuccuggaaaaugagcggacccuugacuaucaugauagcaacgugaaaaaccuguacgagaagguccgcucucagcucaaaaauaacgccaaggaaauuggaaauggcuguuuugaguucuaucacaagugcgacaacacauguauggaauccgugaaaaaugggaccuacgauuauccuaaguacagcgaggaagcuaaacugaacagagaggagaucgacggcguuaaacuugaaucuacacggaucuaucaaauucuggccaucuacuccacgguggcgagcucccucguccuggugguuucucugggagcuauuagcuuuuggaugugcuccaauggcucucuccagugccgcaucuguauuuga

SEQ ID NO: 187218 - RNA, 1701 nt, Artificial Sequence; identical to SEQ ID NO: 187193
  derived and/or modified sequence opt5 from hemagglutinin__InfluenzaA__ADD22802

SEQ ID NO: 187219 - RNA, 1701 nt, Artificial Sequence; identical to SEQ ID NO: 186795
  derived and/or modified sequence opt5 from hemagglutinin__InfluenzaA__ADD22812

SEQ ID NO: 187220 - RNA, 1701 nt, Artificial Sequence
  derived and/or modified sequence opt5 from hemagglutinin__InfluenzaA__ADD22822
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucugccgacaacggcacgugcuauccgggggauuuuauugacuacgaagaacugcgggagcagcuuagcuccgucagcucuuucgaacgcuuugagaucuuccccaagaccuccagcuggccuaaucacgauucuaacaagggagugacagcugccuguccccaugcgggcgccaaauccuuuuauaagaaucugaucuggcucguuaaaaagggcaacagcuacccuaaacugucuaaguccuauauuaaugacaaggggaaagaagugcuuguccuguggggaauccaccaccccagcaccuccgcugaucaacagucucucuaccagaacgccgacgcuuacguguucgugggcacaagcaaguauuccaaaaaguuuaaaccugagauugccaucagaccgaagguccgggaucaggaggggcgcaugaauuacuauuggacccugguugaacccggagacaaaauuacguucgaggcgacaggcaaccugguggugccuagauacgccuuugcuauggaacggaacgccgggagcggaaucauuaucucugauacccccguccaugacugcaauacaaccugucaaaccccuaagggcgcuaucaacacaucccuccccuuccagaauauucacccgaucacgauuggcaagugcccuaaauauguuaagagcaccaaacugcgccuugccacagggcugagaaacgugcccucuauccagagccggggacucuuuggcgccauugcuggguucaucgagggaggcuggaccgggaugguggacggaugguacggcuaucaucaccagaaugaacaaggcuccggguacgcggccgaucugaagucuacacagaacgcuaucgacgagauuaccaauaaagucaacagcgugaucgagaagaugaauacgcaguuuacagccguuggaaaggaguucaaccaccuugagaaacgcauugaaaaucugaacaagaaaaucgaugacggcuuccucgauauuuggaccuacaaugccgagcugcuggugcuccuggaaaacgagagaacccuugacuaucaugauuccaaugucaagaaccuguacgagaaagugcggagccagcucaagaacaaugcuaaggaaaucgggaacggauguuuugaguucuaucacaaaugcgacaauauguguauggaaucugucaagaacggcacauacgauuauccuaaauacuccgaggaagccaagcugaaucgcgaggagaucgacggggugaaacuugaaagcaccagaauuuaucaaauccuggcgauuuacucuacaguugcuuccagccucgugcuggucgugucccugggcgccaucucuuuuuggaugugcagcaacggaucccuccagugccggauuuguaucuga

SEQ ID NO: 187221 - RNA, 1701 nt, Artificial Sequence; identical to SEQ ID NO: 186795
  derived and/or modified sequence opt5 from hemagglutinin__InfluenzaA__ADD22832

SEQ ID NO: 187222 - RNA, 1701 nt, Artificial Sequence; identical to SEQ ID NO: 186795
  derived and/or modified sequence opt5 from hemagglutinin__InfluenzaA__ADD22842

SEQ ID NO: 187223 - RNA, 1701 nt, Artificial Sequence
  derived and/or modified sequence opt5 from hemagglutinin__InfluenzaA__ADD22852
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucgucauuuccgauacccccgugcaugacugcaauacaaccugucaaaccccuaaaggcgccaucaacacaagccuccccuuccagaauauccacccgauuacgaucggcaagugcccuaaguauguuaaaucuaccaagcugagacuugcuacagggcugcggaacgugcccagcauucagucccgcggacucuuuggcgccaucgccggguucauugagggaggcuggaccgggauggucgacggaugguacggcuaucaucaccagaaugaacaaggcucuggguacgcugcggaucugaaaagcacacagaacgccaucgacgagaucaccaauaaggugaacuccguuauugagaaaaugaauacgcaguuuacagcugugggaaaggaguucaaccaccuugagaagagaaucgaaaaucugaacaaaaaggucgaugacggcuuccucgauauuuggaccuacaaugccgagcugcuggugcuccuggaaaacgagcggacccuugacuaucaugauagcaaugucaaaaaccuguacgagaaggugcgcucucagcucaaaaacaaugccaaggaaaucgggaacggauguuuugaguucuaucacaagugcgacaauacauguauggaauccguuaaaaacggcaccuacgauuauccuaaguacagcgaggaagcuaaacugaauagagaggagauugacggggugaaacuugaaucuacacggaucuaucaaauccuggccauuuacuccacggucgcgagcucccucgugcugguugugucucugggcgcuaucagcuuuuggaugugcuccaacggaucucuccagugccgcauuuguaucuga

SEQ ID NO: 187224 - RNA, 1701 nt, Artificial Sequence
  derived and/or modified sequence opt5 from hemagglutinin__InfluenzaA__ADD22941
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccaucuccuggucuuacauuguggagaccagcuccucuggcaacgggacgugcuauccgggagacuuuaucgauuacgaagaacugcgggagcagcuuagcuccgucagcucuuucgaacgcuuugagaucuuccccaagaccuccagcuggccuaaucacgacucuaacaagggcgugacagccgcuuguccccaugccggcgcgaaauccuuuuauaagaaucugauuuggcucguuaaaaaggggaacagcuacccuaaacugucuaaguccuauaucaaugauaagggaaaagaagugcuuguccuguggggcauucaccaccccagcaccuccgccgaccaacagucucucuaccagaacgcugaugccuacguguucguggggacaagcagauauuccaagaaauuuaagccugagaucgcuauucggccgaaaguccgcgaccaggagggaagaaugaauuacuauuggacccugguugaacccggcgauaagaucacguucgaggccacagggaaccugguggugccucgguacgcguuugccauggaacgcaacgcuggaagcggcauuaucaucucugacacccccguccaugauugcaauacaaccugucaaaccccuaaaggcgccauuaacacaucccuccccuuccagaauauccacccgauuacgaucgggaagugcccuaaguaugugaaaagcaccaagcugagacuugcuacaggacugcggaacguucccucuauucagagccgcggccucuuuggggccaucgccggauucaucgagggcggguggaccggaaugguggacggcugguacggcuaucaucaccagaaugaacaaggguccggauacgcugcggaccugaaaucuacacagaacgccauugaugagaucaccaauaaggucaacagcgugauugagaaaaugaauacgcaguuuacagcuguuggcaaggaguucaaccaccuugagaagagaaucgaaaaucugaacaaaaagguggacgauggguuccucgacauuuggaccuacaaugccgagcugcugguccuccuggaaaacgagcggacccuugauuaucaugacuccaaugugaaaaaccuguacgagaagguccgcagccagcucaaaaacaaugccaaggaaaucggaaacggcuguuuugaguucuaucacaagugcgauaauacauguauggaaucugugaaaaacgggaccuacgacuauccuaaguacuccgaggaagcuaaacugaauagagaggagaucgauggcguuaaacuugaaagcacacggauuuaucaaauccuggccauuuacucuacgguggcguccagccucguccuggugguuucccugggagcuaucucuuuuuggaugugcagcaacggcucccuccagugccgcauuuguaucuga

SEQ ID NO: 187225 - RNA, 1701 nt, Artificial Sequence; identical to SEQ ID NO: 186795
  derived and/or modified sequence opt5 from hemagglutinin__InfluenzaA__ADD22951

SEQ ID NO: 187226 - RNA, 1701 nt, Artificial Sequence; identical to SEQ ID NO: 186795
  derived and/or modified sequence opt5 from hemagglutinin__InfluenzaA__ADD22961

SEQ ID NO: 187227 - RNA, 1701 nt, Artificial Sequence; identical to SEQ ID NO: 186795
  derived and/or modified sequence opt5 from hemagglutinin__InfluenzaA__ADD22971

SEQ ID NO: 187228 - RNA, 1701 nt, Artificial Sequence; identical to SEQ ID NO: 186795
  derived and/or modified sequence opt5 from hemagglutinin__InfluenzaA__ADD23072

SEQ ID NO: 187229 - RNA, 1701 nt, Artificial Sequence
  derived and/or modified sequence opt5 from hemagglutinin__InfluenzaA__ADD23082
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcggcaacgggacgugcuauccgggagacuuuauugauuacgaagaacugcgggagcagcuuuccagcgucucuuccuucgaacgcuuugagaucuuccccaagaccagcucuuggccuaaucacgacuccaacaagggcgugacagccgcuuguccccaugccggcgcgaaaucuuuuuauaagaaucugaucuggcucguuaaaaaggggaacagcuacccuaaacuguccaagagcuauauuaaugauaagggaaaagaagugcuuguccuguggggcauccaccaccccuccaccucugccgaccaacagagccucuaccagaacgcugauacauacguguucguggggaccuccagauauagcaagaaauuuaagccugagauugccauccggccgaaaguccgcgaccaggagggaagaaugaauuacuauuggacgcugguugaacccggcgauaagauuacauucgaggcuaccgggaaccugguggugccucgguacgccuuugcgauggaacgcaacgccggaucuggcaucauuaucuccgacacacccguccaugauugcaauaccaccugucaaacaccuaaaggcgcuaucaacacgagccuccccuuccagaauauucacccgaucaccauugggaagugcccuaaguaugugaaaucuacaaagcugagacuugccaccggacugcggaacguucccagcauccagucccgcggccucuuuggggcuauugccggauucaucgagggcggguggacaggaaugguggacggcugguacggcuaucaucaccagaaugaacaagggucuggauacgccgcugaccugaaaagcacccagaacgcgaucgaugagauuacgaauaaggucaacuccgugaucgagaaaaugaauacacaguuuaccgccguuggcaaggaguucaaccaccuugagaagagaauugaaaaucugaacaaaaagguggacgauggguuccucgacaucuggaccuacaaugcugagcugcugguccuccuggaaaacgagcggacacuugauuaucaugacagcaaugugaaaaaccuguacgagaagguccgcucucagcucaaaaacaaugccaaggaaauuggaaacggcuguuuugaguucuaucacaagugcgauaauaccuguauggaauccgugaaaaacgggacauacgacuauccuaaguacagcgaggaagccaaacugaauagagaggagaucgauggcguuaaacuugaaucuacgcggaucuaucaaauucuggcuaucuacuccaccguggccagcucccucguccuggugguuucucugggagcgauuagcuuuuggaugugcuccaacggcucucuccagugccgcaucuguauuuga

SEQ ID NO: 187230 - RNA, 1701 nt, Artificial Sequence
  derived and/or modified sequence opt5 from hemagglutinin__InfluenzaA__ADD23102
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaaaugcaacaucgccggguggauucugggaaauccugagugugaaucucucagcacagcuuccucuuggagcuacaucguggagaccuccucuagcggcaacgggacgugcuauccgggagacuuuauugauuacgaagaacugcgggagcagcuuuccagcgucucuuccuucgaaaaguuugagaucuuccccaagaccagcucuuggccuaaucacgacuccaacaaaggcgugacagccgcuuguccccaugccggcgccaagagcuuuuauaaaaaucugaucuggcucguuaagaaagggaacucuuacccuaagcuguccaagagcuauauuaaugauaaaggaaaggaagugcuuguccuguggggcauccaccaccccuccaccucugccgaccaacagagccucuaccagaacgcugaugccuacguguucguggggacaucccgcuauagcaaaaaguuuaaaccugagauugcuaucagaccgaagguccgggaccaggagggacgcaugaauuacuauuggacccugguugaacccggcgauaaaauuacguucgaggccacagggaaccugguggugccuagauacgcguuugccauggaacggaacgcuggaucuggcaucauuaucuccgacacccccguccaugauugcaauacaaccugucaaaccccuaagggcgccaucaacacaagccuccccuuccagaauauucacccgaucacgauugggaagugcccuaaauaugugaagucuaccaaacugcgccuugcuacaggacugagaaacguucccagcauccagucccggggccucuuuggggccauugccggauucaucgagggcggguggaccggaaugguggacggcugguacggcuaucaucaccagaaugaacaagggucuggauacgcugcggaccuuaagagcacacagaacgccaucgaugagauuaccaauaaagucaacuccgugaucgagaagaugaauacgcaguuuacagcuguuggcaaggaguucaaccaccuggagaaacgcauugaaaaucugaacaagaaaguggacgauggguuccucgacaucuggaccuacaaugccgagcugcugguccuccuggaaaacgagagaacccuugauuaucaugacagcaaugugaagaaccuguacgagaaaguccggucucagcucaagaacaaugccaaggaaauuggaaacggcuguuuugaguucuaucacaaaugcgauaauacauguauggaauccgugaagaacgggaccuacgacuauccuaaauacagcgaggaagcuaagcugaaucgcgaggagaucgauggcguuaaacuugaaucuacaagaaucuaucaaauucuggccaucuacuccacgguggcgagcucccucguccuggugguuucucugggagcuauuagcuuuuggaugugcuccaacggcucucuccagugccggaucuguauuuga

SEQ ID NO: 187231 - RNA, 1701 nt, Artificial Sequence; identical to SEQ ID NO: 186795
  derived and/or modified sequence opt5 from hemagglutinin__InfluenzaA__ADD23112

SEQ ID NO: 187232 - RNA, 1701 nt, Artificial Sequence; identical to SEQ ID NO: 186795
  derived and/or modified sequence opt5 from hemagglutinin__InfluenzaA__ADD23122

SEQ ID NO: 187233 - RNA, 1701 nt, Artificial Sequence; identical to SEQ ID NO: 185693
  derived and/or modified sequence opt5 from hemagglutinin__InfluenzaA__ADD23132

SEQ ID NO: 187234 - RNA, 1701 nt, Artificial Sequence; identical to SEQ ID NO: 186857
  derived and/or modified sequence opt5 from hemagglutinin__InfluenzaA__ADD23142

SEQ ID NO: 187235 - RNA, 1701 nt, Artificial Sequence
  derived and/or modified sequence opt5 from hemagglutinin__InfluenzaA__ADD23162
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagggccucuaccagaacgcugacgccuacguguucguggggacaagcagauauuccaagaaauuuaagccugagauugcuauccggccgaaaguccgcgaucaggagggaagaaugaauuacuauuggacccugguugaacccggcgacaagauuacguucgaggccacagggaaccugguggugccucgguacgcguuugccauggaacgcaacgcuggaagcggcaucauuaucucugauacccccguccaugacugcaauacaaccugucaaaccccuaaaggcgccaucaacacaucccuccccuuccagaauauucacccgaucacgauugggaagugcccuaaguaugugaaaagcaccaagcugagacuugcuacaggacugcggaacguucccucuauccagagccgcggccucuuuggggccauugccggauucaucgagggcggguggaccggaaugguggacggcugguacggcuaucaucaccagaaugaacaaggguccggauacgcugcggaucugaaaucuacacagaacgccaucgacaagauuaccaauaaagucaacagcgugaucgagaagaugaauacgcaguuuacagcuguuggcaaggaguucaaccaccuugagaaaagaauugagaaucugaacaagaaaguggaugacggguuccucgauaucuggaccuacaaugccgaacugcugguccuccuggagaacgaacggacccuugacuaucaugauuccaaugugaagaaccuguacgagaaaguccgcagccagcucaagaacaaugccaaggagauuggaaacggcuguuuugaguucuaucacaaaugcgacaauacauguauggaaucugugaagaacgggaccuacgauuauccuaaauacuccgaagaggcuaagcugaauagagaagagaucgacggcguuaaacuugagagcacacggaucuaucaaauucuggccaucuacucuacgguggcguccagccucguccuggugguuucccugggagcuauuucuuuuuggaugugcagcaacggcucccuccagugccgcaucuguauuuga

SEQ ID NO: 187236 - RNA, 1701 nt, Artificial Sequence; identical to SEQ ID NO: 186857
  derived and/or modified sequence opt5 from hemagglutinin__InfluenzaA__ADD23172

SEQ ID NO: 187237 - RNA, 1701 nt, Artificial Sequence; identical to SEQ ID NO: 186857
  derived and/or modified sequence opt5 from hemagglutinin__InfluenzaA__ADD23182

SEQ ID NO: 187238 - RNA, 1701 nt, Artificial Sequence; identical to SEQ ID NO: 186857
  derived and/or modified sequence opt5 from hemagglutinin__InfluenzaA__ADD23192

SEQ ID NO: 187239 - RNA, 1701 nt, Artificial Sequence; identical to SEQ ID NO: 186857
  derived and/or modified sequence opt5 from hemagglutinin__InfluenzaA__ADD23202

SEQ ID NO: 187240 - RNA, 1701 nt, Artificial Sequence; identical to SEQ ID NO: 186857
  derived and/or modified sequence opt5 from hemagglutinin__InfluenzaA__ADD23220

SEQ ID NO: 187241 - RNA, 1701 nt, Artificial Sequence; identical to SEQ ID NO: 186853
  derived and/or modified sequence opt5 from hemagglutinin__InfluenzaA__ADD23230

SEQ ID NO: 187242 - RNA, 1701 nt, Artificial Sequence; identical to SEQ ID NO: 186857
  derived and/or modified sequence opt5 from hemagglutinin__InfluenzaA__ADD23240

SEQ ID NO: 187243 - RNA, 1701 nt, Artificial Sequence
  derived and/or modified sequence opt5 from hemagglutinin__InfluenzaA__ADD23260
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccugagggcgccaucaacacaagccuccccuuccagaauauucacccgaucacgauuggcaaaugcccuaaguaugugaagucuaccaaacugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaucuuaagagcacacagaacgccaucgacaaaauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaagcuggaaucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 187244 - RNA, 1701 nt, Artificial Sequence; identical to SEQ ID NO: 186046
  derived and/or modified sequence opt5 from hemagglutinin__InfluenzaA__ADD23280

SEQ ID NO: 187245 - RNA, 1701 nt, Artificial Sequence
  derived and/or modified sequence opt5 from hemagglutinin__InfluenzaA__ADD23290
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaccugguggugccucgguacgcguuugccauggaacgcaaugcugggucuggaaucauuaucuccgacacccccguccaugauugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggacggaugguacggcuaucaucaccagaacgaacaaggcucuggguacgcugcggaccugaaaagcacacagaaugccaucgauaagauuaccaacaaagucaauuccgugaucgagaagaugaacacgcaguuuacagcuguuggaaaggaguucaaucaccuugagaaaagaauugagaaccugaauaagaaaguggacgauggcuuccucgacaucuggaccuacaacgccgaacugcugguccuccuggagaaugaacggacccuugauuaucaugacagcaacgugaagaaccuguacgagaaaguccgcucucagcucaagaauaacgccaaggagauugggaauggauguuuugaguucuaucacaaaugcgauaacacauguauggaauccgugaagaauggcaccuacgacuauccuaaauacagcgaagaggcuaagcugaacagagaagagaucgaugggguuaaacuugagucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 187246 - RNA, 1701 nt, Artificial Sequence; identical to SEQ ID NO: 186857
  derived and/or modified sequence opt5 from hemagglutinin__InfluenzaA__ADD23300

SEQ ID NO: 187247 - RNA, 1701 nt, Artificial Sequence; identical to SEQ ID NO: 187245
  derived and/or modified sequence opt5 from hemagglutinin__InfluenzaA__ADD23310

SEQ ID NO: 187248 - RNA, 1701 nt, Artificial Sequence; identical to SEQ ID NO: 186857
  derived and/or modified sequence opt5 from hemagglutinin__InfluenzaA__ADD23320

SEQ ID NO: 187249 - RNA, 1701 nt, Artificial Sequence
  derived and/or modified sequence opt5 from hemagglutinin__InfluenzaA__ADD23330
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaccugguggugccucgguacgcguuugccauggaacgcaaugcugggucuggaaucauuaucuccgacacccccguccaugauugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggacggaugguacggcuaucaucaccagaacgaacaaggcucuggguacgcugcggaccugaaaagcacacagaaugccaucgauaagauuaccaacaaagucaauuccgugaucgagaagaugaacacgcaguuuacagcuguuggaaaggaguucaaucaccuugagaaaagaauugagaaccugaauaagaaaguggacgauggcuuccucgacaucuggaccuacaacgccgaacugcugguccuccuggagaaugaacggacccuugauuaucaugacagcaacgugaagaaccuguacgagaaaguccgcucucagcucaagacaaaugccaaggagauugggaacggauguuuugaguucuaucacaaaugcgauaauaccuguauggaauccgugaagaacggcacauacgacuauccuaaauacagcgaagaggcuaagcugaauagagaagagaucgaugggguuaaacuugagucuacgcggaucuaucaaauucuggccaucuacuccaccguggcgagcucccucguccuggugguuucucugggcgcuauuagcuuuuggaugugcuccaacggaucucuccagugccgcaucuguauuuga

SEQ ID NO: 187250 - RNA, 1701 nt, Artificial Sequence
  derived and/or modified sequence opt5 from hemagglutinin__InfluenzaA__ADD23355
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaaauguuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacaucccgcuauagcaagaaauuuaagccugagauugcuaucagaccgaaaguccgggaccaggaggggcgcaugaacuacuauuggacccugguugaacccggagauaagauuacguucgaggccacaggcaaccugguggugccuagauacgcguuugccauggaacggaaugcugggucuggaaucauuaucuccgacacccccguccaugauugcaacacaaccugucaaaccccuaaaggcgccaucaauacaagccuccccuuccagaacauucacccgaucacgauuggcaagugcccuaaguaugugaaaucuaccaagcugcgccuugcuacagggcugagaaauguucccagcauccagucccggggacucuuuggcgccauugccggguucaucgagggaggcuggaccgggaugguggacggaugguacggcuaucaucaccagaacgaacaaggcucuggguacgcugcggaccugaaaagcacacagaaugccaucgauaagauuaccaacaaagucaauuccgugaucgagaagaugaacacgcaguuuacagcuguuggaaaggaguucaaucaccuugaaaaacgcauugagaaccugaauaagaaaguggacgauggcuuccucgacaucuggaccuacaacgccgaacugcugguccuccuggagaaugaaagaacccuugauuaucaugacagcaacgugaagaaccuguacgagaaaguccggucucagcucaagaauaacgccaaggagauugggaauggauguuuugaguucuaucacaaaugcgauaacacauguauggaguccgugaagaauggcaccuacgacuauccuaaauacagcgaagaggcuaagcugaaccgcgaagagaucgaugggguuaaacuugagucuacaagaaucuaucaaauucuggccaucuacuccacgguggcgagcucccucguccuggugguuucucugggcgcuauuagcuuuuggaugugcuccaauggaucucuccagugccggaucuguauuuga

SEQ ID NO: 187251 - RNA, 1701 nt, Artificial Sequence; identical to SEQ ID NO: 187245
  derived and/or modified sequence opt5 from hemagglutinin__InfluenzaA__ADD23375

SEQ ID NO: 187252 - RNA, 1701 nt, Artificial Sequence; identical to SEQ ID NO: 186857
  derived and/or modified sequence opt5 from hemagglutinin__InfluenzaA__ADD23385

SEQ ID NO: 187253 - RNA, 1701 nt, Artificial Sequence
  derived and/or modified sequence opt5 from hemagglutinin__InfluenzaA__ADD23405
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaauccuuuuauaagaaccugaucuggcucguuaaaaagggcaauucuuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaccugguggugccucgguacgcguuugccauggaacgcaaugcugggucuggaaucauuaucuccgacacccccguccaugauugcaacacaaccugucaaaccccuaaaggcgccaucaauacaagccuccccuuccagaacauucacccgaucacggugggcaagugcccuaaguauguuaaaucuaccaagcugagacuugcuacagggcugcggaaugugcccagcauucagucccgcggacucuuuggcgccaucgccggguucauugagggaggcuggaccgggauggucgacggaugguacggcuaucaucaccagaacgaacaaggcucuggguacgcugcggaccugaaaagcacacagaaugccaucgauaagaucaccaacaaagugaauagcguuauugagaagaugaacacgcaguuuacagcugugggaaaggaguucaaucaccuugagaaaagaaucgagaaccugaauaagaaagucgacgauggcuuccucgacauuuggaccuacaacgccgaacugcuggugcuccuggagaaugaacggacccuugauuaucaugacagcaacgucaagaaccuguacgagaaagugcgcucucagcucaagaauaacgccaaggagaucgggaauggauguuuugaguucuaucacaaaugcgauaacacauguauggaauccguuaagaauggcaccuacgacuauccuaaauacagcgaagaggcuaagcugaacagagaagagauugauggggugaaacuugagucuacacggaucuaucaaauccuggccauuuacuccacggucgcgagcucccucgugcugguugugucucugggcgcuaucagcuuuuggaugugcuccaauggaucucuccagugccgcauuuguaucuga

SEQ ID NO: 187254 - RNA, 1701 nt, Artificial Sequence
  derived and/or modified sequence opt5 from hemagglutinin__InfluenzaA__ADD23415
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaccugguggugccucgguacgcguuugccauggaacgcaaugcugagucugggaucauuaucuccgacacccccguccaugauugcaacacaaccugucaaaccccuaaaggagccaucaauacaagccuccccuuccagaacauucacccgaucacgauuggcaagugcccuaaguaugugaaaucuaccaagcugagacuugcuacaggccugcggaauguucccagcauccagucccgcgggcucuuuggagccauugccggcuucaucgaagggggauggaccggcaugguggacgggugguacggauaucaucaccagaacgagcaaggcucuggcuacgcugcggaccugaaaagcacacagaaugccaucgauaagauuaccaacaaagucaauuccgugaucgagaagaugaacacgcaguuuacagcuguugggaaggaguucaaucaccuugagaaaagaauugaaaaccugaauaagaaaguggacgauggauuccucgacaucuggaccuacaacgccgagcugcugguccuccuggaaaaugagcggacccuugauuaucaugacagcaacgugaagaaccuguacgagaaaguccgcucucagcucaagaauaacgccaaggaaauuggcaauggguguuuugaguucuaucacaaaugcgauaacacauguauggaauccgugaagaauggaaccuacgacuauccuaaauacagcgaggaagcuaagcugaacagagaggagaucgauggcguuaaacuugaaucuacacggaucuaucaaauucuggccaucuacuccacgguggcgagcucccucguccuggugguuucucugggggcuauuagcuuuuggaugugcuccaauggcucucuccagugccgcaucuguauuuga

SEQ ID NO: 187255 - RNA, 1701 nt, Artificial Sequence; identical to SEQ ID NO: 186857
  derived and/or modified sequence opt5 from hemagglutinin__InfluenzaA__ADD23435

SEQ ID NO: 187256 - RNA, 1701 nt, Artificial Sequence
  derived and/or modified sequence opt5 from hemagglutinin__InfluenzaA__ADD23465
augaaggccauccuggcugugcuccuguacaccuucgccacagcgaacgcugacacgcuuugcauuggcuaucacgccaauaacagcaccgauacagucgacaccguucuggagaaaaaugugacagugacccauuccgucaaccuccuggaagauaagcacaaugggaaacuuuguaagcugagaggaguggcuccccuccaucugggcaaaugcaacaucgccggguggauucugggaaauccugagugugaaucucucagcacagccuccucuuggagcuacaucguugagaccuccucuagcgacaacggcacgugcuauccgggggauuuuauugacuacgaagaacugcgggagcagcuuuccagcgugucuuccuucgaacgcuuugagaucuuccccaagaccagcucuuggccuaaucacgauuccaacaagggagucacagcugccuguccccaugcgggcgccaagagcuuuuauaaaaaucugaucuggcucgugaaaaagggcaacucuuacccuaaacuguccaagagcuauauuaaugacaaggggaaagaaguucuugugcuguggggaauccaccaccccuccaccucugcugaucaacagagccucuaccagaacgccgacgcuuacgucuucgugggcacauccagauauagcaagaaauuuaagccugagauugccauccggccgaaagugcgcgaucaggaggggagaaugaauuacuauuggacccuggucgaacccggagacaagauuacguucgaggcgacaggcaaccugguugugccucgguacgccuuugcuauggaacgcaacgccgggucuggaaucauuaucuccgauacccccgugcaugacugcaauacaaccugucaaaccccuaaaggcgcuaucaacacaagccuccccuuccagaauauucacccgaucacgauuggcaagugcccuaaguaugucaaaucuaccaagcugagacuugccacagggcugcggaacgugcccagcauccagucccgcggacucuuuggcgccauugcuggguucaucgagggaggcuggaccgggaugguugacggaugguacggcuaucaucaccagaaugaacaaggcucuggguacgcggccgaucugaaaagcacacagaacgcuaucgacaagauuaccaauaaagugaacuccgucaucgagaagaugaauacgcaguuuacagccgugggaaaggaguucaaccaccuugagaaaagaauugagaaucugaacaagaaaguugaugacggcuuccucgauaucuggaccuacaaugccgaacugcuggugcuccuggagaacgaacggacccuugacuaucaugauagcaaugucaagaaccuguacgagaaagugcgcucucagcucaagaacaaugcuaaggagauugggaacggauguuuugaguucuaucacaaaugcgacaauacauguauggaauccgucaagaacggcaccuacgauuauccuaaauacagcgaagaggccaagcugaauagagaagagaucgacggggugaaacuugagucuacacggaucuaucaaauucuggcgaucuacuccacgguugcuagcucccucgugcuggucgugucucugggcgccauuagcuuuuggaugugcuccaacggaucucuccagugccgcaucuguauuuga

SEQ ID NO: 187257 - RNA, 1701 nt, Artificial Sequence; identical to SEQ ID NO: 186857
  derived and/or modified sequence opt5 from hemagglutinin__InfluenzaA__ADD23475

SEQ ID NO: 187258 - RNA, 1701 nt, Artificial Sequence; identical to SEQ ID NO: 186857
  derived and/or modified sequence opt5 from hemagglutinin__InfluenzaA__ADD23485

SEQ ID NO: 187259 - RNA, 1701 nt, Artificial Sequence
  derived and/or modified sequence opt5 from hemagglutinin__InfluenzaA__ADD23495
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgcggagcuuuuauaaaaaucugaucuggcucguuaagaaaggcaacucuuacccuaagcuguccaaaagcuauauuaaugacaaggggaaggaagugcuuguccuguggggaauccaccaccccuccaccucugccgaucaacagagccucuaccagaacgcugacgccuacguguucgugggcacauccagauauagcaaaaaguuuaaaccugagauugcuauccgcccgaaggucagagaucaggaggggcggaugaauuacuauuggacccugguugaacccggagacaaaauuacguucgaggccacaggcaaccugguggugccucgcuacgcguuugccauggaaagaaacgcugggucuggaaucauuaucuccgauacccccguccaugacugcaauacaaccugucaaaccccuaagggcgccaucaacacaagccuccccuuccagaauauucacccgaucacgauuggcaaaugcccuaaguaugugaagucuaccaaacugcggcuugcuacagggcugcgcaacguucccagcauccaguccagaggacucuuuggcgccauugccggguucaucgagggaggcuggaccgggaugguggacggaugguacggcuaucaucaccagaaugaacaaggcucuggguacgcugcggaucuuaagagcacacagaacgccaucgacgagauuaccaauaaagucaacuccgugaucgagaagaugaauacgcaguuuacagcuguuggaaaagaguucaaccaccuggagaagcggauugaaaaucugaacaagaaaguggaugacggcuuccucgauaucuggaccuacaaugccgagcugcugguccuccuggaaaacgagcgcacccuugacuaucaugauagcaaugugaagaaccuguacgagaaagucagaucucagcucaagaacaaugccaaagaaauugggaacggauguuuugaguucuaucacaagugcgacaauacauguauggaauccgugaagaacggcaccuacgauuauccuaaauacagcgaggaagcuaagcugaaucgggaggagaucgacgggguuaaacuugaaucuacacgcaucuaucaaauucuggccaucuacuccacgguggcgagcucccucguccuggugguuucucugggcgcuauuagcuuuuggaugugcuccaacggaucucuccagugcagaaucuguauuuga

SEQ ID NO: 187260 - RNA, 1701 nt, Artificial Sequence
  derived and/or modified sequence opt5 from hemagglutinin__InfluenzaA__ADD23505
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugauugaacccggagacaagaucacguucgaggccacaggcaaccugguugugccucgguacgcguuugccauggaacgcaacgcugggucuggaauuaucaucuccgauacccccgcccaugacugcaauacaaccugucaaaccccuaaaggcgcuauuaacacaagccuccccuuccagaauauccacccgauuacgaucggcaagugcccuaaguaugugaaaucuaccaagcugagacuugccacagggcugcggaacguccccagcauucagucccgcggacucuuuggcgccaucgcuggguucaucgagggaggcuggaccgggaugguggacggaugguacggcuaucaucaccagaaugaacaaggcucuggguacgcggccgaucugaaaagcacacagaacgcuauugacaagaucaccaauaaaguuaacuccgugauugagaagaugaauacgcaguuuacagccgucggaaaggaguucaaccaccuugagaaaagaaucgagaaucugaacaagaaaguggaugacggcuuccucgauauuuggaccuacaaugccgaacugcugguucuccuggagaacgaacggacccuugacuaucaugauagcaaugugaagaaccuguacgagaaaguccgcucucagcucaagaacaaugcuaaggagaucgggaacggauguuuugaguucuaucacaaaugcgacaauacauguauggaauccgugaagaacggcaccuacgauuauccuaaauacagcgaagaggccaagcugaauagagaagagaucgacggggucaaacuugagucuacacggauuuaucaaauccuggcgauuuacuccacgguggcuagcucccucguucugguggucucucugggcgccaucagcuuuuggaugugcuccaacggaucucuccagugccgcauuuguaucuga

SEQ ID NO: 187261 - RNA, 1701 nt, Artificial Sequence; identical to SEQ ID NO: 186857
  derived and/or modified sequence opt5 from hemagglutinin__InfluenzaA__ADD23515

SEQ ID NO: 187262 - RNA, 1701 nt, Artificial Sequence; identical to SEQ ID NO: 186857
  derived and/or modified sequence opt5 from hemagglutinin__InfluenzaA__ADD23994

SEQ ID NO: 187263 - RNA, 1701 nt, Artificial Sequence
  derived and/or modified sequence opt5 from hemagglutinin__InfluenzaA__ADD24004
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaacggcgccaucaauacaagccuccccuuccagaacauucacccgaucacgauuggcaaaugcccuaaguaugugaagucuaccaaacugagacuugcuacagggcugcggaauguucccagcauccagucccgcggacucuuuggcgccauugccggguucaucgagggaggcuggaccgggaugguggacggaugguacggcuaucaucaccagaacgaacaaggcucuggguacgcugcggaucuuaagagcacacagaaugccaucgacgagauuaccaacaaagucaauuccgugaucgagaagaugaacacgcaguuuacagcuguuggaaaagaguucaaucaccuggagaagagaauugaaaaccugaauaagaaaaucgaugacggcuuccucgauauuuggaccuacaacgccgagcugcuggugcuccuggaaaaugagcggacccuugacuaucaugauagcaacgucaagaaccuguacgagaaagugcgcucucagcucaagaauaacgccaaagaaaucgggaauggauguuuugaguucuaucacaagugcgacaacacauguauggaauccgucaagaauggcaccuacgauuauccuaaauacagcgaggaagcuaagcugaacagagaggagaucgacggggugaaacuugaaucuacacggauuuaucaaauccuggccauuuacuccacgguugcgagcucccucgugcuggucgugucucugggcgcuaucagcuuuuggaugugcuccaauggaucucuccagugccgcauuuguaucuga

SEQ ID NO: 187264 - RNA, 1701 nt, Artificial Sequence; identical to SEQ ID NO: 186795
  derived and/or modified sequence opt5 from hemagglutinin__InfluenzaA__ADD24014

SEQ ID NO: 187265 - RNA, 1701 nt, Artificial Sequence
  derived and/or modified sequence opt5 from hemagglutinin__InfluenzaA__ADD52537
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucuccccuuccagaauauucacccgaucacaauuggcaagugcccuaaguaugugaaaagcacgaagcugagacuugcuaccgggcugcggaacguucccuccauccagucucgcggacucuuuggcgccauugccggguucaucgagggaggcuggacagggaugguggacggaugguacggcuaucaucaccagaaugaacaaggcagcggguacgcugcggaucugaaauccacccagaacgccaucgacggaauuacaaauaaggucaacagcgugaucgagaaaaugaauacccaguuuacggcuguuggcaaggaguucaaccaccuugaaaagagaauugagaaucugaacaaaaagguggaugacggguuccucgauaucuggacauacaaugccgaacugcugguccuccuggagaacgaacggacccuugacuaucaugauucuaaugugaaaaaccuguacgagaagguccgcucccagcucaaaaacaaugccaaggagauuggaaacggcuguuuugaguucuaucacaagugcgacaauaccuguauggagagcgugaaaaacgggacauacgauuauccuaaguacucugaagaggcuaaacugaauagagaagagaucgacggcguuaaacuugaguccacccggaucuaucaaauucuggccaucuacagcacaguggcguccucucucguccuggugguuagccugggagcuauuuccuuuuggaugugcucuaacggcagccuccagugccgcaucuguauuuga

SEQ ID NO: 187266 - RNA, 1701 nt, Artificial Sequence; identical to SEQ ID NO: 186857
  derived and/or modified sequence opt5 from hemagglutinin__InfluenzaA__ADD64203

SEQ ID NO: 187267 - RNA, 1701 nt, Artificial Sequence
  derived and/or modified sequence opt5 from hemagglutinin__InfluenzaA__ADD64204
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcagauauuccaagaaauuuaagccggagauugcuauccggcccaaaguccgcgaucaggaggggagaaugaauuacuauuggacccugauugaaccuggagagaagaucacguucgaagccacaggcaaccugguugugccccgguacgcguuugccauggagcgcaacgcugggagcggaauuaucaucucugacaccccugugcaugauugcaauacaaccugucaaacccccaaaggcgccauuaacacaucccucccguuccagaauauccacccuauuacgaucggcaagugccccaaguaugucaaaagcaccaagcugagacuugcuacagggcugcggaacgugccuucuauucagagccgcggacucuuuggcgccaucgccggguucaucgaaggaggcuggaccgggaugguugacggaugguacggcuaucaucaccagaaugagcaaggcuccggguacgcugcggaccugaaaucuacacagaacgccauugaugagaucaccaauaaggugaacagcgucauugagaaaaugaauacgcaguuuacagcugugggaaaggaguucaaccaccuugaaaagagaaucgagaaucugaacaaaaagguugacgauggcuuccucgacauuuggaccuacaaugccgaacugcuggugcuccuggagaacgagcggacccuugauuaucaugacuccaaugucaaaaaccuguacgaaaaggugcgcagccagcucaaaaacaaugccagagagaucgggaacggauguuuugaguucuaucacaagugcgauaauacauguauggaaucugucaagaacggcaccuacgacuaucccaaauacuccgaagaggcuaagcugaaucgggaggaaaucgauggggugaaacuugagagcacacgcauuuaucaaauccuggccauuuacucuacgguugcguccagccucgugcuggucgugucccugggcgcuaucucuuuuuggaugugcagcaacggaucccuccagugcagaauuuguaucuga

SEQ ID NO: 187268 - RNA, 1701 nt, Artificial Sequence; identical to SEQ ID NO: 185693
  derived and/or modified sequence opt5 from hemagglutinin__InfluenzaA__ADD64205

SEQ ID NO: 187269 - RNA, 1701 nt, Artificial Sequence; identical to SEQ ID NO: 185693
  derived and/or modified sequence opt5 from hemagglutinin__InfluenzaA__ADD64206

SEQ ID NO: 187270 - RNA, 1701 nt, Artificial Sequence; identical to SEQ ID NO: 186491
  derived and/or modified sequence opt5 from hemagglutinin__InfluenzaA__ADD64207

SEQ ID NO: 187271 - RNA, 1701 nt, Artificial Sequence
  derived and/or modified sequence opt5 from hemagglutinin__InfluenzaA__ADD64208
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcagauauuccaagaaauuuaagccggagauugcuauccggcccaaaguccgcgaucaggaggggagaaugaauuacuauuggacccugguugaaccuggagacaagauuacguucgaggccacaggcaaccugguggugccccgguacgcguuugccauggaacgcaacgcugggagcggaaucauuaucucugauaccccuguccaugacugcaauacaaccugucaaacccccaaaggcgccaucaacacaucccucccguuccagaauauucacccuaucacgauuggcaagugccccaaguaugugaaaagcaccaagcugagacuugcuacagggcugcggaacguuccuucuauccagagccgcggacucuuuggcgccauugccggguucaucgagggaggcuggaccgggaugguggacggaugguacggcuaucaucaccagaaugaacaaggcuccggguacgcugcggaucugaaaucuacacagaacgccaucgacgagauuaccaauaaggucaacagcgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugaucccaaugugaaaaaccuguacgagaagguccgcucccagcucaaaaacaaugccaaggaaauugggaacggauguuuugaguucuaucacaagugcgacaauacauguauggaaagcgugaaaaacggcaccuacgauuaucccaaguacucugaggaagcuaaacugaauagagaggagaucgacgggguuaaacuugaauccacacggaucuaucaaauucuggccaucuacagcacgguggcgucuucccucguccuggugguuagccugggcgcuauuuccuuuuggaugugcucuaacggaagccuccagugccgcaucuguauuuga

SEQ ID NO: 187272 - RNA, 1701 nt, Artificial Sequence; identical to SEQ ID NO: 186491
  derived and/or modified sequence opt5 from hemagglutinin__InfluenzaA__ADD64209

SEQ ID NO: 187273 - RNA, 1701 nt, Artificial Sequence; identical to SEQ ID NO: 185693
  derived and/or modified sequence opt5 from hemagglutinin__InfluenzaA__ADD64210

SEQ ID NO: 187274 - RNA, 1701 nt, Artificial Sequence; identical to SEQ ID NO: 186491
  derived and/or modified sequence opt5 from hemagglutinin__InfluenzaA__ADD64211

SEQ ID NO: 187275 - RNA, 1701 nt, Artificial Sequence; identical to SEQ ID NO: 185693
  derived and/or modified sequence opt5 from hemagglutinin__InfluenzaA__ADD64212

SEQ ID NO: 187276 - RNA, 1701 nt, Artificial Sequence; identical to SEQ ID NO: 186491
  derived and/or modified sequence opt5 from hemagglutinin__InfluenzaA__ADD64213

SEQ ID NO: 187277 - RNA, 1701 nt, Artificial Sequence
  derived and/or modified sequence opt5 from hemagglutinin__InfluenzaA__ADD64214
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaaaauaagcacaacgggaaacuuuguaagcugagaggaguugcuccccuccaucugggcaaaugcaauaucgccggguggauucugggaaacccugagugugaaucuuuuagcacauccucuagcugguccuacaucguggagaccucuagcuccgauaauggcacgugcuauccgggggacuucauugauuacgaggaacuccgggagcagcugagcucugucuccagcuuugaacgcuucgagaucuuucccaagaccucuuccuggccuaaccacgacagcaauaagggagugacagccgccuguccccaugcuggcgccaaaucuuucuauaagaaccuuaucuggcugguuaaaaagggcaauuccuacccuaaacucaacaagagcuauauuaaugauaaggggaaagaagugcugguccuuuggggaauccaccaccccuccaccucugcggaccaacagagccuguaccagaacgccgaugcuuacguguuugugggcacauccagauauagcaagaaauucaagccugagauugccauccggccgaaaguccgcgaccaggaggggagaaugaacuacuauuggacccucguugaacccggagauaagauuacguuugaggcuacaggcaaucugguggugccucgguacgccuucgcgauggaacgcaacgccgggucuggaaucauuaucuccgacacccccguccaugauugcaauacaaccugucaaaccccuaaaggcgcuaucaacacaagccugcccuuucagaauauucacccgaucacgauuggcaagugcccuaaguaugugaaaucuaccaagcucagacuggccacagggcuucggaacguucccagcauccagucccgcggacuguucggcgcuauugccggguuuaucgagggaggcuggaccgggaugguggacggaugguacggcuaucaucaccagaaugaacaaggcucuggguacgccgcugaccucaaaagcacacagaacgcgaucgauggaauuaccaauaaggucaacuccgugaucgagaaaaugaauacgcaguucacagccguuggcaaggaguucaaccaccuggaaaagagaauugagaaucuuaacaaaaagguggacgauggguuucuggacaucuggaccuacaaugcugaacuccugguccugcucgagaacgaacggacccuggauuaucaugacagcaacgugaaaaaucuuuacgagaagguccgcucucagcugaaaaacaaugccaaggagauuggaaacggcuguuucgaauuuuaucacaagugcgauaauacauguauggaguccgugaaaaacgggaccuacgacuauccuaaguacagcgaagaggccaaacucaauagagaagagaucgauggcguuaagcuggagucuacacggaucuaucaaauucuugcuaucuacuccacgguggccagcucccugguccucgugguuucucugggagcgauuagcuucuggaugugcuccaacggcucucugcagugccgcaucuguauuuga

SEQ ID NO: 187278 - RNA, 1701 nt, Artificial Sequence; identical to SEQ ID NO: 185693
  derived and/or modified sequence opt5 from hemagglutinin__InfluenzaA__ADD64215

SEQ ID NO: 187279 - RNA, 1701 nt, Artificial Sequence; identical to SEQ ID NO: 186491
  derived and/or modified sequence opt5 from hemagglutinin__InfluenzaA__ADD64216

SEQ ID NO: 187280 - RNA, 1701 nt, Artificial Sequence; identical to SEQ ID NO: 186491
  derived and/or modified sequence opt5 from hemagglutinin__InfluenzaA__ADD64217

SEQ ID NO: 187281 - RNA, 1701 nt, Artificial Sequence
  derived and/or modified sequence opt5 from hemagglutinin__InfluenzaA__ADD74350
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguagccaugccggcgcgaaaucuuuuuauaagaaucuuauuuggcugguuaaaaagggcaacuccuaccccaaacucagcaaguccuauaucaaugacaaggggaaagaagugcugguccuuuggggcauucaccacccuucuaccagcgccgaucaacagucccuguaccagaacgcugacgccuacguguucgugggaagcucuagauauuccaagaaauuuaagcccgagaucgcuauucggccuaaaguccgcgaucaggaggggagaaugaauuacuauuggacacucguugaaccgggagacaagaucaccuucgaggccacgggcaaccugguggugccccgguacgcguuugccauggaacgcaacgcugggagcggaauuaucaucucugauacaccuguccaugacugcaauaccacaugucaaacccccaaaggcgccauuaacaccagccugccuuuccagaauauccaccccauuacaaucggcaagugcccgaaguaugugaaauccacgaagcucagacuggcuaccgggcuucggaacguuccuucuauucagagccgcggacuguuuggcgccaucgccggguucaucgagggaggcuggacagggaugguggacggaugguacggcuaucaucaccagaaugaacaaggcuccggguacgcugcggaucucaaaagcacccagaacgccauugacgagaucacaaauaaggucaacucugugauugagaaaaugaauacccaguuuacggcuguuggaaaggaguucaaccaccuggagaagagaaucgaaaaucuuaacaaaaagguggaugacggcuuccuggauauuuggacauacaaugccgagcuccugguccugcucgaaaacgagcggacccuggacuaucaugauuccaaugugaaaaaccuuuacgagaagguccgcagccagcugaaaaacaaugccaaggaaaucgggaacggauguuuugaguucuaucacaagugcgacaauaccuguauggaaucugugaaaaacggcacauacgauuaucccaaguacuccgaggaagcuaaacucaauagagaggagaucgacgggguuaagcuggaaagcacccggauuuaucaaauccuugccauuuacuccacaguggcgucuagccugguccucgugguuucccugggcgcuaucucuuuuuggaugugcagcaacggaucccugcagugccgcauuuguaucuga

SEQ ID NO: 187282 - RNA, 1701 nt, Artificial Sequence
  derived and/or modified sequence opt5 from hemagglutinin__InfluenzaA__ADD74360
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaggagcugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaagagaaaagaagugcuuguccugugggggauccaccaccccuccaccucugccgaucaacagagccucuaccagaacgcugacgccuacguguucgugggaacaucccgguauagcaagaaauuuaagccugagauugcuauccgcccgaaagucagagaucaggagggccggaugaauuacuauuggacccugguugaacccggggacaagauuacguucgaggccacaggaaaccugguggugccucgcuacgcguuugccauggaaagaaacgcuggcucugggaucauuaucuccgauacccccguccaugacugcaauacaaccugucaaaccccuaaaggagccaucaacacaagccuccccuuccagaauauucacccgaucacgauuggcaagugcccuaaguaugugaaaucuaccaagcugcggcuugcuacaggccugcgcaacguucccagcauccaguccagagggcucuuuggagccauugccggcuucaucgaagggggauggaccggcaugguggacgggugguacggauaucaucaccagaaugaacaaggcucuggcuacgcugcggaucugaaaagcacacagaacgccaucgacgagauuaccaauaaggucaacuccgugaucgagaaaaugaauacgcaguuuacagcuguugggaaggaguucaaccaccuugaaaagcggauugaaaaucugaacaaaaagguggaugacggauuccucgauaucuggaccuacaaugccgagcugcugguccuccuggaaaacgagcgcacccuugacuaucaugauagcaaugugaaaaaccuguacgagaaggucagaucucagcucaaaaacaaugccaaggaaauuggcaacggguguuuugaguucuaucacaagugcgacaauacauguauggaauccgugaaaaacggaaccuacgauuauccuaaguacagcgaggaagcuaaacugaaucgggaggagaucgacggcguuaaacuugaaucuacacgcaucuaucaaauucuggccaucuacuccacgguggcgagcucccucguccuggugguuucucugggggcuauuagcuuuuggaugugcuccaacggcucucuccagugcagaaucuguauuuga

SEQ ID NO: 187283 - RNA, 1701 nt, Artificial Sequence; identical to SEQ ID NO: 185693
  derived and/or modified sequence opt5 from hemagglutinin__InfluenzaA__ADD74370

SEQ ID NO: 187284 - RNA, 1701 nt, Artificial Sequence; identical to SEQ ID NO: 185693
  derived and/or modified sequence opt5 from hemagglutinin__InfluenzaA__ADD74398

SEQ ID NO: 187285 - RNA, 1701 nt, Artificial Sequence
  derived and/or modified sequence opt5 from hemagglutinin__InfluenzaA__ADD74428
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaggaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguuaagcccggagauaaaauuacguucgaagccacaggcaaccugguggugccucgguacgcguuugccauggagcgcaaugcugggucuggaaucauuaucuccgacacccccguccaugauugcaacacaaccugucaaaccccuaagggcgccaucaauacaagccuccccuuccagaacauucacccgaucacgauuggcaagugcccuaaauaugugaagucuaccaaacugagacuugcuacagggcugcggaauguucccagcauccagucccgcggacucuuuggcgccauugccggguucaucgaaggaggcuggaccgggaugguggacggaugguacggcuaucaucaccagaacgagcaaggcucuggguacgcugcggaccuuaagagcacacagaaugccaucgauaaaauuaccaacaaggucaauuccgugaucgaaaagaugaacacgcaguuuacagcuguuggaaaagaguucaaucaccuugagaagagaauugaaaaccugaauaaaaagguggacgauggcuuccucgacaucuggaccuacaacgccgagcugcugguccuccuggaaaaugagcggacccuugauuaucaugacagcaacgugaaaaaccuguacgaaaagguccgcucucagcucaagaauaacgccaaagagauugggaauggauguuuugaguucuaucacaagugcgauaacacauguauggaauccgugaaaaauggcaccuacgacuauccuaaguacagcgaggaagcuaaacugaacagagaggaaaucgaugggguuaagcuggagucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 187286 - RNA, 1701 nt, Artificial Sequence
  derived and/or modified sequence opt5 from hemagglutinin__InfluenzaA__ADD74438
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaacccacacggaucuaucaaauucuggccaucuacucuacgguggcguccagccucguccuggugguuucccugggcgcuauuucuuuuuggaugugcagcaacggaucccuccagugccgcaucuguauuuga

SEQ ID NO: 187287 - RNA, 1701 nt, Artificial Sequence; identical to SEQ ID NO: 185693
  derived and/or modified sequence opt5 from hemagglutinin__InfluenzaA__ADD74448

SEQ ID NO: 187288 - RNA, 1701 nt, Artificial Sequence; identical to SEQ ID NO: 185693
  derived and/or modified sequence opt5 from hemagglutinin__InfluenzaA__ADD74458

SEQ ID NO: 187289 - RNA, 1701 nt, Artificial Sequence
  derived and/or modified sequence opt5 from hemagglutinin__InfluenzaA__ADD74468
augaaggccauccuggugguccuccuguacaccuucgcuacagccaacgcggacacgcuuugcauuggcuaucacgcuaauaacagcaccgauacaguugacaccgugcuggagaagaaugugacagucacccauuccguggaucuccuggaagacaagcacaacgggaaacuuuguaagcugagaggaguugcuccccuccaucugggcaaaugcaauaucgccggguggauucugggaaacccugagugugaaucucucagcacagccuccucuuggagcuacaucguggagaccuccucuagcgauaauggcacgugcuauccgggggacuuuauugauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauuaccauccggccgaaaguccgcgaccaggaggggagaaugaacuacuauuggacgcugguugaacccggagauaagauuacauucgaggcuaccggcaaucugguggugccucgguacgccuuugcgauggaacgcaacgccgggucuggaaucauuaucuccgacacacccguccaugacugcaacaccaccugucaaacaccuaaaggcgcuaucaauacgagccuccccuuccagaacauucacccgaucaccauuggcaagugcccuaaguaugugaaaucuacaaagcugagacuugccaccgggcugcggaauguucccagcauccagucccgcggacucuuuggcgcuauugccggguucaucgagggaggcuggacagggaugguggauggaugguacggcuaucaucaccagaacgaacaaggcucuggguacgccgcugaccugaaaagcacccagaaugcgaucgaugagauuacgaacaaggucaauuccgugaucgagaaaaugaacacacaguuuaccgccguuggaaaggaguucaaucaccuugagaagagaauugaaaaccugaauaaaaagguggacgauggcuuccucgacaucuggaccuacaacgcugagcugcugguccuccuggaaaaugagcggacacuugauuaucaugacagcaacgugaaaaaucuguacgagaagguccgcucucagcucaaaaacaacgccaaggaaauugggaauggauguuuugaguucuaucacaagugcgauaacaccuguauggaauccgugaaaaauggcacauacgacuauccuaaguacagcgaggaagccaaacugaacagagaggagaucgaugggguuaaacuugaaucuacgcggaucuaucaaauucuggcuaucuacuccaccguggccagcucccucguccuggugguuucucugggcgcgauuagcuuuuggaugugcuccaauggaucucuccagugccgcaucuguauuuga

SEQ ID NO: 187290 - RNA, 1701 nt, Artificial Sequence
  derived and/or modified sequence opt5 from hemagglutinin__InfluenzaA__ADD74488
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggaacauccagauauagcaagaaauuuaagccugagaucgcuauucggccgaaaguccgcgaucaggaggggagaaugaauuacuauuggacccucguugaacccggagacaagaucacguucgaggccacaggcaaccugguggugccucgguacgcguuugccauggaacgcaacgcugggucuggaauuaucaucuccgauacccccguccaugacugcaauacaaccugucaaaccccuaaaggcgccauuaacacaagccugcccuuccagaauauccacccgauuacgaucggcaagugcccuaaguaugugaaaucuaccaagcucagacuggcuacagggcuucggaacguucccagcauucagucccgcggacuguuuggcgccaucgccggguucaucgagggaggcuggaccgggaugguggacggaugguacggcuaucaucaccagaaugaacaaggcucuggguacgcugcggaucucaaaagcacacagaacgccauugacgagaucaccaauaaggucaacuccgugauugagaaaaugaauacgcaguuuacagcuguuggaaaggaguucaaccaccuggagaagagaaucgaaaaucuuaacaaaaagguggaugacggcuuccuggauauuuggaccuacaaugccgagcuccugguccugcucgaaaacgagcggacccuggacuaucaugauagcaaugugaaaaaccuuuacgagaagguccgcucucagcugaaaaacaaugccaaggaaaucgggaacggauguuuugaguucuaucacaagugcgacaauacauguauggaauccgugaaaaacggcaccuacgauuauccuaaguacagcgaggaagcuaaacucaauagagaggagaucgacgggguuaagcuggaaucuacacggauuuaucaaauccuugccauuuacuccacgguggcgagcucccugguccucgugguuucucugggcgcuaucagcuuuuggaugugcuccaacggaucucugcagugccgcauuuguaucuga

SEQ ID NO: 187291 - RNA, 1701 nt, Artificial Sequence; identical to SEQ ID NO: 185693
  derived and/or modified sequence opt5 from hemagglutinin__InfluenzaA__ADD74498

SEQ ID NO: 187292 - RNA, 1701 nt, Artificial Sequence
  derived and/or modified sequence opt5 from hemagglutinin__InfluenzaA__ADD74508
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccguggaucuccuggaagacaagcacaacgggaaacuuuguaagcugagaggaguugcuccccuccaucugggcaaaugcaauaucgccggguggauucugggaaacccugagugugaaucucucagcacagccuccucuuggagcuacaucguggagaccuccucuagcgauaauggcacgugcuauccgggggacuuuauugauuacgaagaacugcgggagcagcuuuccagcgucucuuccuucgaacgcuuugagaucuuccccaagaccagcucuuggccuaaccacgacuccaauaagggagugacagccgcuuguccccaugccgaagcgaaaucuuuuuauaagaaccugaucuggcucguuaaaaagggcaauagcuacccuaaacuguccaagagcuauauuaacgauaagggcaaagaggugcuuguccugugggggauccaccaccccuccaccucugccgaccaacagagccucuaccagaaugcugaugccuacguguucgugggaacauccagauauagcaagaaauuuaagccugagauugcuauccggccgaaaguccgcgaccaggaaggcagaaugaacuacuauuggacccugguugagcccggggauaagauuacguucgaagccacaggaaaucugguggugccucgguacgcguuugccauggagcgcaacgcuggcucugggaucauuaucuccgacacccccguccaugacugcaacacaaccugucaaaccccuaaaggagccaucaauacaagccuccccuuccagaacauucacccgaucacgauuggcaagugcccuaaguaugugaaaucuaccaagcugagacuugcuacaggccugcggaauguucccagcauccagucccgcgggcucuuuggagccauugccggcuucaucgaagggggauggaccggcaugguggaugggugguacggauaucaucaccagaacgagcaaggcucuggcuacgcugcggaccugaaaagcacacagaaugccaucgaugagauuaccaacaaggucaauuccgugaucgaaaagaugaacacgcaguuuacagcuguugggaaggaguucaaucaccuugaaaagagaauugagaaccugaauaaaaagguggacgauggauuccucgacaucuggaccuacaacgccgaacugcugguccuccuggagaaugagcggacccuugauuaucaugacagcaacgugaaaaaucuguacgaaaagguccgcucucagcucaaaaacaacgccaaggagauuggcaauggguguuuugaguucuaucacaagugcgauaacacauguauggaguccgugaaaaauggaaccuacgacuauccuaaguacagcgaagaggcuaaacugaacagagaggaaaucgauggcguuaaacuugagucuacacggaucuaucaaauucuggccaucuacuccacgguggcgagcucccucguccuggugguuucucugggggcuauuagcuuuuggaugugcuccaauggcucucuccagugccgcaucuguauuuga

SEQ ID NO: 187293 - RNA, 1701 nt, Artificial Sequence
  derived and/or modified sequence opt5 from hemagglutinin__InfluenzaA__ADD74518
augaaggccauccuggugguccuccuguacaccuucgcuacagccaacgcggacacgcuuugcauuggcuaucacgcuaauaacagcaccgauacaguugacaccauccuggagaagaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccaagagcuauaucaaugacaaggggaaagaaauucuuguucuguggggaauccaccaccccuccaccucugccgaucaacagagccucuaccagaacgcugacgccuacguguucgucggcacauccagauauagcaagaaauuuaagccugagauugcuauccggccgaaagugcgcgaucaggaggggagaaugaauuacuauuggacccugguggaacccggagacaagauuacguucgaggccacaggcaaccuggucguuccucgguacgcguuugccauggaacgcaacaccgggucuggaaucaucauuuccgauacacccgugcaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguccccagcauccagucccgcggacucuuuggcgcuaucgccggguucauugagggaggcuggacagggaugguggacggaugguacggcuaucaucaccagaaugaacaaggcucuggguacgccgcugaucugaaaagcacccagaacgcgaucgacgagauuacgaauaagguuaacuccgugaucgagaaaaugaauacacaguuuaccgccgucggaaaggaguucaaccaccuugagaagagaauugaaaaucugaacaaaaagguggaugacggcuuccucgauaucuggaccuacaaugcugagcugcugguucuccuggaaaacgagcggacacuugacuaucaugauagcaaugugaaaaaccuguacgagaagguccgcucucagcucaaaaacaaugccaaggaaaucgggaacggauguuuugaguucuaucacaagugcgacaauaccuguauggaauccgugaaaaacggcacauacgauuauccuaaguacagcgaggaagccaaacugaauagagaggagauugacggggucaaacuugaaucuacgcggaucuaucaaauucuggcuaucuacuccaccguggccagcucccucguucugguggucucucugggcgcgauuagcuuuuggaugugcuccaacggaucucuccagugccgcaucuguauuuga

SEQ ID NO: 187294 - RNA, 1701 nt, Artificial Sequence
  derived and/or modified sequence opt5 from hemagglutinin__InfluenzaA__ADD74528
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuucagccugagauugcuauccggccgaagguccgcgaccaagaggggagaaugaacuacuauuggacccugguugaacccggagauaaaauuacguucgaggccacaggcaaccugguggugccucgguacgcguuugccauggaacgcaaugcugggucuggaaucauuaucuccgacacccccguccaugauugcaacacaaccugucagaccccuaagggcgccaucaauacaagccuccccuuccagaacauucacccgaucacgauuggcaaaugcccuaaguaugugaagucuaccaaacugagacuugcuacagggcugcggaauguucccagcauccagucccgcggacucuuuggcgccauugccggguucaucgagggaggcuggaccgggaugguggacggaugguacggcuaucaucaccaaaacgaacagggcucuggguacgcugcggaccuuaagagcacacagaaugccaucgauaaaauuaccaacaaggucaauuccgugaucgagaaaaugaacacgcaguuuacagcuguuggaaaggaguucaaucaccuugaaaagagaauugagaaccugaauaaaaagguggacgauggcuuccucgacaucuggaccuacaacgccgaacugcugguccuccuggagaaugaacggacccuugauuaucaugacagcaacgugaaaaaccuguacgagaagguccgcucucaacucaaaaauaacgccaaggagauugggaauggauguuuugaguucuaucacaagugcgauaacacauguauggaguccgugaaaaauggcaccuacgacuauccuaaguacagcgaagaggcuaaacugaacagagaagagaucgaugggguuaagcuggagucuacacggaucuaucagauucuggccaucuacuccacgguggcgagcucccucguccuggugguuucucugggcgcuauuagcuuuuggaugugcuccaauggaucucuccagugccgcaucuguauuuga

SEQ ID NO: 187295 - RNA, 1701 nt, Artificial Sequence
  derived and/or modified sequence opt5 from hemagglutinin__InfluenzaA__ADD74538
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguagacugcggggaguugcgccccuccaucugggcaagugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgcgagcagcuuuccagcgucucuuccuucgaaagauuugagaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaagugcuuguccuguggggaauccaccaccccuccaccucugccgaucaacagagccucuaccagaacgcugacgccuacguguucgugggcacaucccgguauagcaaaaaguuuaaaccugagauugcuauccgcccgaaggucagagaucaggaggggcggaugaauuacuauuggacccugguugaacccggagacaaaauuacguucgaggccacaggcaaccugguggugccucgcuacgcguuugccauggaaagaaacgcugggucuggaaucauuaucuccgauacccccgucuaugacugcaauacaaccugucaaaccccuaagggcgccaucaacacaagccuccccuuccagaauauucauccgaucacgauuggcaaaugcccuaaguacgugaagucuaccaaacugcggcuugcuacagggcugcgcaacguucccagcauccaguccagaggacucuuuggcgccauugccggguucaucgagggaggcuggaccgggaugguggacggaugguauggcuaccaccaucagaaugaacaaggcucuggguacgcugcggaucuuaagagcacacagaacgccaucgacgagauuaccaauaaagucaacuccgugaucgagaagaugaauacgcaguuuacagcuguuggaaaagaguucaaccaccuggagaagcggauugaaaaucugaacaagaaaguggaugacggcuuccucgauaucuggaccuauaaugccgagcugcugguccuccuggaaaacgagcgcacccuugacuaccacgauagcaaugugaagaaccuguaugagaaagucagaucucagcucaagaacaaugccaaagaaauugggaacggauguuuugaguucuaccauaagugcgacaauacauguauggaauccgugaagaacggcaccuaugauuacccuaaauauagcgaggaagcuaagcugaaucgggaggagaucgacgggguuaaacuugaaucuacacgcaucuaccaaauucuggccaucuacuccacgguggcgagcucccucguccuggugguuucucugggcgcuauuagcuuuuggaugugcuccaacggaucucuccagugcagaaucuguauuuga

SEQ ID NO: 187296 - RNA, 1701 nt, Artificial Sequence; identical to SEQ ID NO: 187290
  derived and/or modified sequence opt5 from hemagglutinin__InfluenzaA__ADD74548

SEQ ID NO: 187297 - RNA, 1701 nt, Artificial Sequence; identical to SEQ ID NO: 186857
  derived and/or modified sequence opt5 from hemagglutinin__InfluenzaA__ADD74558

SEQ ID NO: 187298 - RNA, 1701 nt, Artificial Sequence; identical to SEQ ID NO: 187245
  derived and/or modified sequence opt5 from hemagglutinin__InfluenzaA__ADD74568

SEQ ID NO: 187299 - RNA, 1701 nt, Artificial Sequence
  derived and/or modified sequence opt5 from hemagglutinin__InfluenzaA__ADD74578
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacauccucuagcugguccuacaucguggagaccucuagcuccgacaacggcacgugcuauccgggggauuuuauugacuacgaagaacugcgggagcagcuuagcucugucuccagcuucgaacgcuuugagaucuuccccaagaccucuuccuggccuaaucacgauagcaacaagggagugacagccgccuguccccaugcuggcgccaaaucuuuuuauaagaaucugaucuggcucguuaaaaagggcaacuccuacccuaaacugagcaaguccuauauuaaugacaaggggaaagaagugcuuguccuguggggaauccaccaccccucuaccagcacagaucaacagucccucuaccagaacgcggacgccuacguguucgugggcaccagcagauauucuaagaaauuuaagccugagauugcuauccggccgaaaguccgcgaucaggaggggagaaugaauuacuauuggacgcugguugaacccggagacaagauuacauucgaggccaccggcaaccugguggugccucgguacgcuuuugccauggaacgcaacgcgggguccggaaucauuaucagcgauacacccguccaugacugcaauaccaccugucaaacaccuaaaggcgccaucaacacgucucuccccuuccagaauauucacccgaucaccauuggcaagugcccuaaguaugugaaaagcacaaagcugagacuugcuaccgggcugcggaacguucccuccauccagucucgcggacucuuuggcgccauugcuggguucaucgagggaggcuggacagggaugguggacggaugguacggcuaucaucaccagaaugaacaaggcagcggguacgccgccgaucugaaauccacccagaacgcuaucgacgagauuacgaauaaggucaacagcgugaucgagaaaaugaauacacaguuuaccgcgguuggaaaggaguucaaccaccuugagaagagaauugaaaaucugaacaaaaagguggaugacggcuuccucgauaucuggaccuacaaugccgagcugcugguccuccuggaaaacgagcggacacuugacuaucaugauucuaaugugaaaaaccuguacgagaagguccgcucccagcucaaaaacaaugcuaaggaaauugggaacggauguuuugaguucuaucacaagugcgacaauaccuguauggaaagcgugaaaaacggcacauacgauuauccuaaguacucugaggaagccaaacugaauagagaggagaucgacgggguuaaacuugaauccacgcggaucuaucaaauucuggccaucuacagcaccguggcuuccucucucguccuggugguuagccugggcgccauuuccuuuuggaugugcucuaacggaagccuccagugccgcaucuguauuuga

SEQ ID NO: 187300 - RNA, 1701 nt, Artificial Sequence
  derived and/or modified sequence opt5 from hemagglutinin__InfluenzaA__ADD74588
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugauggccaacagagccucuaccagaacgccgacgcuuacguguucguggggacauccagauauagcaagaaauuuaagccugagauugccauccggccgaaaguccgcgaucaggagggaagaaugaauuacuauuggacccugguugaacccggcgacaagauuacguucgaggcuacagggaaccugguggugccucgguacgccuuugcgauggaacgcaacgccggaucuggcaucauuaucuccgauacccccguccaugacugcaauacaaccugucaaaccccuaaaggcgcuaucaacacaagccuccccuuccagaauauucacccgaucacgauugggaagugcccuaaguaugugaaaucuaccaagcugagacuugccacaggacugcggaacguucccagcauccagucccgcggccucuuuggggcuauugccggauucaucgagggcggguggaccggaaugguggacggcugguacggcuaucaucaccagaaugaacaagggucuggauacgccgcugaucugaaaagcacacagaacgcgaucgacgagauuaccaauaaggucaacuccgugaucgagaaaaugaauacgcaguuuacagccguuggcaaggaguucaaccaccuugagaagagaauugaaaaucugaacaaaaagguggaugacggguuccucgauaucuggaccuacaaugcugagcugcugguccuccuggaaaacgagcggacccuugacuaucaugauagcaaugugaaaaaccuguacgagaagguccgcucucagcucaaaaacaaugccaaggaaauuggaaacggcuguuuugaguucuaucacaagugcgacaauacauguauggaauccgugaaaaacgggaccuacgauuauccuaaguacagcaaagaggccaagcugaauagagaagagaucgacggcguuaaacuugagucuacacggaucuaucaaauucuggcuaucuacuccacgguggccagcucccucguccuggugguuucucugggagcgauuagcuuuuggaugugcuccaacggcucucuccagugccgcaucuguauuuga

SEQ ID NO: 187301 - RNA, 1701 nt, Artificial Sequence; identical to SEQ ID NO: 187245
  derived and/or modified sequence opt5 from hemagglutinin__InfluenzaA__ADD74598

SEQ ID NO: 187302 - RNA, 1701 nt, Artificial Sequence; identical to SEQ ID NO: 187245
  derived and/or modified sequence opt5 from hemagglutinin__InfluenzaA__ADD74608

SEQ ID NO: 187303 - RNA, 1701 nt, Artificial Sequence; identical to SEQ ID NO: 186857
  derived and/or modified sequence opt5 from hemagglutinin__InfluenzaA__ADD74618

SEQ ID NO: 187304 - RNA, 1701 nt, Artificial Sequence
  derived and/or modified sequence opt5 from hemagglutinin__InfluenzaA__ADD74628
augaaggccauccuggugguccuccuguacaccuucgcuacagccaacgcggacacgcuuugcauuggcuaucacgcuaauaacagcaccgauacaguugacaccauccuggagaaaaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccaagagcuauaucaaugacaaggggaaagaaauucuuguucuguggggaauccaccaccccuccaccucugccgaucaacagagccucuaccagaacgcugacgccuacguguucgucggcacauccagauauagcaagaaauuuaagccugagauugcuauccggccgaaagugcgcgaucaggaggggagaaugaauuacuauuggacccugguggaacccggagacaagauuacguucgaggccacaggcaaccuggucguuccucgguacgcguuugccauggaaaagaacgcugggucuggaaucaucauuuccgauacccccgugcaugacugcaauacaaccugucaaaccccuaagggcgccaucaacacaagccuccccuuccagaauauucacccgaucacgauuggcaagugcccuaaauaugugaagucuaccaaacugcgccuugcuacagggcugagaaacguccccagcauccagucccggggacucuuuggcgccaucgccggguucauugagggaggcuggaccgggaugguggacggaugguacggcuaucaucaccagaaugaacaaggcucuggguacgcugcggaucugaaaagcacacagaacgccaucgacgagauuaccaauaaaguuaacuccgugaucgagaagaugaauacgcaguuuacagcugucggaaaggaguucaaccaccuugagaaacgcauugaaaaucugaacaagaaaguggaugacggcuuccucgauaucuggaccuacaaugccgagcugcugguucuccuggaaaacgagagaacccuugacuaucaugauagcaaugugaagaaccuguacgagaaaguccggucucagcucaagaacaaugccaaggaaaucgggaacggauguuuugaguucuaucacaaaugcgacaauacauguauggaauccgugaagaacggcaccuacgauuauccuaaauacagcgaggaagcuaagcugaaucgcgaggagauugacggggucaaacuugaaucuacaagaaucuaucaaauucuggccaucuacuccacgguggcgagcucccucguucugguggucucucugggcgcuauuagcuuuuggaugugcuccaacggaucucuccagugccggaucuguauuuga

SEQ ID NO: 187305 - RNA, 1701 nt, Artificial Sequence; identical to SEQ ID NO: 186794
  derived and/or modified sequence opt5 from hemagglutinin__InfluenzaA__ADD74648

SEQ ID NO: 187306 - RNA, 1701 nt, Artificial Sequence
  derived and/or modified sequence opt5 from hemagglutinin__InfluenzaA__ADD74658
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacuccuacguguucgugggcacaagcagauauucuaagaaauuuaagccugagauugccauccggccgaaaguccgcgaucaggaggggagaaugaauuacuauuggacccugguugaacccggagacaagauuacguucgaggcuacaggcaaccugguggugccucgguacgccuuugcgauggaacgcaacgccggguccggaaucauuaucagcgauacccccguccaugacugcaauacaaccugucaaaccccugagggcgcuaucaacacaucucuccccuuccagaauauucacccgaucacgauuggcaaaugcccuaaguauguuaagagcaccaaacugagacuugccacagggcugcggaacgugcccuccauccagucucgcggacucuuuggcgcuauugccggguucaucgaaggaggcuggaccgggaugguggacggaugguacggcuaucaucaccagaaugagcaaggcagcggguacgccgcugaucugaaguccacacagaacgcgaucgacgagauuaccaauaaagucaacagcgugaucgaaaagaugaauacgcaguuuacagccguuggaaaagaguucaaccaccuugaaaagagaauugagaaucugaacaagaaaguggaugacggcuuccucgauaucuggaccuacaaugcugaacugcugguccuccuggagaacgagcggacccuugacuaucaugauucuaaugugaagaaccuguacgaaaaaguccgcucccagcucaagaacaaugccaaagagauugggaacggauguuuugaguucuaucacaagugcgacaauacauguauggagagcgugaagaacggcaccuacgauuauccuaaauacucugaagaggccaagcugaauagagaggaaaucgacgggguuaaacuugaguccacacggaucuaucaaauucuggcuaucuacagcacgguggccuccucucucguccuggugguuagccugggcgcgauuuccuuuuggaugugcucuaacggaagccuccagugccgcaucuguauuuga

SEQ ID NO: 187307 - RNA, 1701 nt, Artificial Sequence; identical to SEQ ID NO: 187245
  derived and/or modified sequence opt5 from hemagglutinin__InfluenzaA__ADD74668

SEQ ID NO: 187308 - RNA, 1701 nt, Artificial Sequence; identical to SEQ ID NO: 187285
  derived and/or modified sequence opt5 from hemagglutinin__InfluenzaA__ADD74678

SEQ ID NO: 187309 - RNA, 1701 nt, Artificial Sequence; identical to SEQ ID NO: 187245
  derived and/or modified sequence opt5 from hemagglutinin__InfluenzaA__ADD74688

SEQ ID NO: 187310 - RNA, 1701 nt, Artificial Sequence
  derived and/or modified sequence opt5 from hemagglutinin__InfluenzaA__ADD74698
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaccugguggugccucgguacgcguuugccauggaacgcaaugcugggucuggaaucauuaucuccgacacccccguccaugauugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggacggaugguacggcuaucaucaccagaacgaacaaggcucuggguacgcugcggaccugaaaagcacacagaaugccaucgauaagauuaccaacaaagucaauuccgugaucgagaagaugaacacgcaguuuacagcuguuggaaaggaguucaaucaccuugagaaaagaauugagaaccugaauaagaaaguggacgauggcuuccucgacaucuggaccuacaacgccgaacugcugguccuccuggagaaugaacggacccuugauuaucaugacagcaacgugaagaaccuguacgagaaaguccgcaaucagcucaagaacaaugccaaggagauugggaacggauguuuugaguucuaucacaaaugcgauaauacauguauggaaucugugaagaacggcaccuacgacuauccuaaauacuccgaagaggcuaagcugaauagagaagagaucgaugggguuaaacuugagagcacacggaucuaucaaauucuggccaucuacucuacgguggcguccagccucguccuggugguuucccugggcgcuauuucuuuuuggaugugcagcaacggaucccuccagugccgcaucuguauuuga

SEQ ID NO: 187311 - RNA, 1701 nt, Artificial Sequence; identical to SEQ ID NO: 187245
  derived and/or modified sequence opt5 from hemagglutinin__InfluenzaA__ADD74708

SEQ ID NO: 187312 - RNA, 1701 nt, Artificial Sequence
  derived and/or modified sequence opt5 from hemagglutinin__InfluenzaA__ADD74728
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccugaucacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaucugguggugccucgguacgcguuugccauggaacgcaacgcugggucuggaaucauuaucuccgacacccccguccaugacugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggauggaugguacggcuaucaucaccagaacgaacaaggcucuggguacgcugcggaccugaaaagcacacagaaugccaucgauaagauuaccaacaaagucaauuccgugaucgagaagaugaacacgcaguuuacagcuguuggaaaggaguucaaucaccuugagaaaagaauugagaaccugaauaagaaaguggacgauggcuuccucgacaucuggaccuacaacgccgaacugcugguccuccuggagaaugaacggacccuugauuaucaugacagcaacgugaagaaucuguacgagaaaguccgcucucagcucaagaacaacgccaaggagauugggaauggauguuuugaguucuaucacaaaugcgauaacacauguauggaauccgugaagaauggcaccuacgacuauccuaaauacagcgaagaggcuaagcugaacagagaagagaucgaugggguuaaacuugagucuacacggaucuaucaaauucuggccaucuacuccacgguggcgagcuccgucgugcucguugugucucugggcgcuauuagcuuuuggaugugcuccaauggaucucugcagugccgcaucuguauuuga

SEQ ID NO: 187313 - RNA, 1701 nt, Artificial Sequence
  derived and/or modified sequence opt5 from hemagglutinin__InfluenzaA__ADD74738
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagcccgguccuggucuuacaucguggagaccagcuccucugacaacggcacgugcuauccgggggauuuuauugacuacgaagaacugcgcgagcagcuuagcuccgucagcucuuucgaaagauuugagaucuuccccaagaccuccagcuggccuaaucacgauucuaacaagggagugacagccgcuuguccccaugccggcgcgaaauccuuuuauaagaaucugaucuggcucguuaaaaagggcaacagcuacccuaaacugucuaaguccuauauuaaugacaaggggaaagaagugcuuguccuguggggaauccaccaccccagcaccuccgccgaucaacagucucucuaccagaacgcugacgccuacguguucgugggcacaagcggguauuccaagaaauuuaagccugagauugcuauccggccgaaaguccgcgaucaggagggaagaaugaauuacuauuggacccugguugaacccggcgacaagauuacguucgaggccacagggaaccugguggugccucgguacgcguuugccauggaacgcaacgcuggaagcggcaucauuaucucugauacccccguccaugacugcaauacaaccugucaaaccccuaaaggcgccaucaacacaucccuccccuuccagaauauucacccgaucacgauugggaagugcccuaaguaugugaaaagcaccaagcugagacuugcuacaggacugcggaacguucccucuauccagagccgcggccucuuuggggccauugccggauucaucgagggcggguggaccggaaugguggacggcugguacggcuaucaucaccagaaugaacaaggguccggauacgcugcggaucugaaaucuacacagaacgccaucgacaagauuaccaauaaagucaacagcgugaucgagaagaugaauacgcaguuuacagcuguuggcaaggaguucaaccaccuugagaaaagaauugagaaucugaacaagaaaguggaugacggguuccucgauaucuggaccuacaaugccgaacugcugguccuccuggagaacgaacggacccuugacuaucaugauuccaaugugaagaaccuguacgagaaaguccgcagccagcucaagaacaaugccaaggagauuggaaacggcuguuuugaguucuaucacaaaugcgacaauacauguauggaaucugugaagaacgggaccuacgauuauccuaaauacuccgaagaggcuaagcugaauagagaagagaucgacggcguuaaacuugagagcacacggaucuaucaaauucuggccaucuacucuacgguggcguccagccucguccuggugguuucccugggagcuauuucuuuuuggaugugcagcaacggcucccuccagugccgcaucuguauuuga

SEQ ID NO: 187314 - RNA, 1701 nt, Artificial Sequence; identical to SEQ ID NO: 186857
  derived and/or modified sequence opt5 from hemagglutinin__InfluenzaA__ADD74748

SEQ ID NO: 187315 - RNA, 1701 nt, Artificial Sequence; identical to SEQ ID NO: 186857
  derived and/or modified sequence opt5 from hemagglutinin__InfluenzaA__ADD74758

SEQ ID NO: 187316 - RNA, 1701 nt, Artificial Sequence
  derived and/or modified sequence opt5 from hemagglutinin__InfluenzaA__ADD74768
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugucuuacuauuggacccugguugaacccggagacaagauuacguucgaggccacaggcaaucugguggugccucgguacgcguuugccauggaacgcaacgcuggguccggaaucauuaucagcgauacccccguccaugacugcaacacaaccugucaaaccccuaaaggcgccaucaauacaucucuccccuuccagaacauucacccgaucacgauuggcaagugcccuaaguaugugaaaagcaccaagcugagacuugcuacagggcugcggaauguucccuccauccagucucgcggacucuuuggcgccauugccggguucaucgagggaggcuggaccgggaugguggacggaugguacggcuaucaucaccagaacgaacaaggcagcggguacgcugcggaucugaaauccacacagaaugccaucgacaagauuaccaacaaagucaauagcgugaucgagaagaugaacacgcaguuuacagcuguuggaaaggaguucaaucaccuugagaaaagaauugagaaccugaauaagaaaguggaugacggcuuccucgauaucuggaccuacaacgccgaacugcugguccuccuggagaaugaacggacccuugacuaucaugauucuaacgugaagaaucuguacgagaaaguccgcucccagcucaagaacaacgccaaggagauugggaauggauguuuugaguucuaucacaaaugcgacaacacauguauggaaagcgugaagaauggcaccuacgauuauccuaaauacucugaagaggcuaagcugaacagagaagagaucgacgggguuaaacuugaguccacacggaucuaucaaauucuggccaucuacagcacgguggcguccucucucguccuggugguuagccugggcgcuauuuccuuuuggaugugcucuaauggaagccuccagugccgcaucuguauuuga

SEQ ID NO: 187317 - RNA, 1701 nt, Artificial Sequence; identical to SEQ ID NO: 186857
  derived and/or modified sequence opt5 from hemagglutinin__InfluenzaA__ADD74778

SEQ ID NO: 187318 - RNA, 1701 nt, Artificial Sequence; identical to SEQ ID NO: 187245
  derived and/or modified sequence opt5 from hemagglutinin__InfluenzaA__ADD74788

SEQ ID NO: 187319 - RNA, 1701 nt, Artificial Sequence; identical to SEQ ID NO: 187245
  derived and/or modified sequence opt5 from hemagglutinin__InfluenzaA__ADD74798

SEQ ID NO: 187320 - RNA, 1701 nt, Artificial Sequence
  derived and/or modified sequence opt5 from hemagglutinin__InfluenzaA__ADD74808
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggauccagcagauauucuaagaaauuuaagccugagaucgcuauucggccgaaaguccgcgaucaggaggggagaaugaauuacuauuggacacucguugaacccggagacaagaucaccuucgaggccacgggcaaccugguggugccucgguacgcguuugccauggaacgcaacgcuggguccggaauuaucaucagcgauacacccguccaugacugcaauaccacaugucaaaccccuaaaggcgccauuaacaccucucugcccuuccagaauauccacccgauuacaaucggcaagugcccuaaguaugugaaaagcacgaagcucagacuggcuaccgggcuucggaacguucccuccauucagucucgcggacuguuuggcgccaucgccggguucaucgagggaggcuggacagggaugguggacggaugguacggcuaucaucaccagaaugaacaaggcagcggguacgcugcggaucucaaauccacccagaacgccauugacgagaucacaaauaaggucaacagcgugauugagaaaaugaauacccaguuuacggcuguuggaaaggaguucaaccaccuggagaagagaaucgaaaaucuuaacaaaaagguggaugacggcuuccuggauauuuggacauacaaugccgagcuccugguccugcucgaaaacgagcggacccuggacuaucaugauucuaaugugaaaaaccuuuacgagaagguccgcucccagcugaaaaacaaugccaaggaaguggggaacggauguuuugaguucuaucacaagugcgacaauaccuguauggaaagcguuaaaaacggcacauacgauuauccuaaguacucugaggaagcuaaacucaauagagaggagaucgacggggugaagcuggaauccacccggaucuaucaaauucuugccaucuacagcacagcggcuuccucucugguccucgugguuagccugggcgccauuuccuuuuggaugugcucuaacggaagccugcagugccgcaucuguauuuga

SEQ ID NO: 187321 - RNA, 1701 nt, Artificial Sequence
  derived and/or modified sequence opt5 from hemagglutinin__InfluenzaA__ADD74818
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggaacauccagauauagcaagaaauuuaagccugagaucgcuauucggccgaaaguccgcgaucaggaggggagaaugaauuaccauuggacccucguugaacccggagacaagaucacguucgaggccacaggcaaccugguggugccucgguaugcguuugccauggaacgcaacgcugggucuggaauuaucaucuccgauacccccguccacgacugcaauacaaccugucaaaccccuaaaggcgccauuaacacaagccugcccuuccagaauauccauccgauuacgaucggcaagugcccuaaguacgugaaaucuaccaagcucagacuggcuacagggcuucggaacguucccagcauucagucccgcggacuguuuggcgccaucgccggguucaucgagggaggcuggaccgggaugguggacggaugguauggcuaccaccaccagaaugaacaaggcucuggguaugcugcggaucucaaaagcacacagaacgccauugacgagaucaccaauaaggucaacuccgugauugagaaaaugaauacgcaguuuacagcuguuggaaaggaguucaaccaucuggagaagagaaucgaaaaucuuaacaaaaagguggaugacggcuuccuggauauuuggaccuacaaugccgagcuccugguccugcucgaaaacgagcggacccuggacuaccacgauagcaaugugaaaaaccuuuaugagaagguccgcucucagcugaaaaacaaugccaaggaaaucgggaacggauguuuugaguucuaccauaagugcgacaauacauguauggaauccgugaaaaacggcaccuaugauuacccuaaguauagcgaggaagcuaaacucaauagagaggagaucgacgggguuaagcuggaaucuacacggauuuaccaaauccuugccauuuauuccacgguggcgagcucccugguccucgugguuucucugggcgcuaucagcuuuuggaugugcuccaacggaucucugcagugccgcauuuguaucuga

SEQ ID NO: 187322 - RNA, 1701 nt, Artificial Sequence
  derived and/or modified sequence opt5 from hemagglutinin__InfluenzaA__ADD74838
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaauccuuuuauaagaaccugaucuggcucguuaaaaagggcaauucuuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaccugguggugccucgguacgcguuugccauggaacgcaaugcugggucuggaaucauuaucuccgacacccccguccaugauugcaacacaaccugucaaaccccuaaaggcgccaucaauacaagccuccccuuccagaacgugcacccgauuacgaucggcaagugcccuaaguauguuaaaucuaccaagcugagacuugcuacagggcugcggaaugugcccagcauucagucccgcggacucuuuggcgccaucgccggguucauugagggaggcuggaccgggauggucgacggaugguacggcuaucaucaccagaacgaacaaggcucuggguacgcugcggaccugaaaagcacacagaaugccaucgauaagaucaccaacaaagugaauagcguuauugagaagaugaacacgcaguuuacagcugugggaaaggaguucaaucaccuugagaaaagaaucgagaaccugaauaagaaagucgacgauggcuuccucgacauuuggaccuacaacgccgaacugcuggugcuccuggagaaugaacggacccuugauuaucaugacagcaacgucaagaaccuguacgagaaagugcgcucucagcucaagaauaacgccaaggagaucgggaauggauguuuugaguucuaucacaaaugcgauaacacauguauggaauccguuaagaauggcaccuacgacuauccuaaauacagcgaagaggcuaagcugaacagagaagagauugauggggugaaacuugagucuacacggaucuaucaaauccuggccauuuacuccacggucgcgagcucccucgugcugguugugucucugggcgcuaucagcuuuuggaugugcuccaauggaucucuccagugccgcauuuguaucuga

SEQ ID NO: 187323 - RNA, 1701 nt, Artificial Sequence
  derived and/or modified sequence opt5 from hemagglutinin__InfluenzaA__ADD74848
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacaagauuaccaauaaagucaacuccgugaucgagaagaugaauacgcaguuuacagcuguuggaaaggaguucaaccaccuugagaaaagaauugagaaucugaacaagaaaguggaugacggcuuccucgauaucuggaccuacaaugccgaacugcugguccuccuggagaacgaacggacccuugacuaucaugauagcaaugugaagaaccuguacgagaaaguccgcucucagcucaagaacaaugccaaggagauugggaacggauguuuugaguucuaucacaaaugcgacaauacauguauggaauccgugaagaacggcaccuacgauuauccuaaauacagcgaagaggcuaagcugaauagagaagagaucgacgggguuaaacuugagucuacacggaucuaucaaauucuggccaucuacuccacgguggcgagcucccucguccugauugugucucugggcgcuaucagcuuuuggaugugcuccaacggaucucuccagugccgcauuuguaucuga

SEQ ID NO: 187324 - RNA, 1701 nt, Artificial Sequence
  derived and/or modified sequence opt5 from hemagglutinin__InfluenzaA__ADD74858
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcaccaagagcuuuuauaaaaaccugaucuggcucguuaaaaagggcaauucuuacccuaaacuguccaagagcuauauuaacgauaaggggaaagaagugcuuguccuguggggaauccaccaccccuccacaucugcggaccaacagagccucuaccagaaugccgaugcuuacguguucgugggcaccuccagauauagcaagaaauuuaagccugagauugccauccggccgaaaguccgcgaccaggaggggagaaugaacuacuauuggacgcugguugaacccggagauaagauuacauucgaggcuaccggcaaccugguggugccucgguacgccuuugcgauggaacgcaaugccgggucuggaaucauuaucuccgacacacccguccaugauugcaacaccaccugucaaacaccuaaaggcgcuaucaauacgagccuccccuuccagaacauucacccgaucaccauuggcaagugcccuaaguaugugaaaucuacaaagcugagacuugccaccgggcugcggaauguucccagcauccagucccgcggacucuuuggcgcuauugccggguucaucgagggaggcuggacagggaugguggacggaugguacggcuaucaucaccagaacgaacaaggcucuggguacgccgcugaccugaaaagcacccagaaugcgaucgauaagauuacgaacaaagucaauuccgugaucgagaagaugaacacacaguuuaccgccguuggaaaggaguucaaucaccuugagaaaagaauugagaaccugaauaagaaaguggacgauggcuuccucgacaucuggaccuacaacgcugaacugcugguccuccuggagaaugaacggacacuugauuaucaugacagcaacgugaagaaccuguacgagaaaguccgcucucagcucaagaauaacgccaaggagauugggaauggauguuuugaguucuaucacaaaugcgauaacaccuguauggaauccgugaagaauggcacauacgacuauccuaaauacagcgaagaggccaagcugaacagagaagagaucgaugggguuaaacuugagucuacgcggaucuaucaaauucuggcuaucuacuccaccguggccagcucccucguccuggugguuucucugggcgcgauuagcuuuuggaugugcuccaauggaucucuccagugccgcaucuguauuuga

SEQ ID NO: 187325 - RNA, 1701 nt, Artificial Sequence; identical to SEQ ID NO: 187245
  derived and/or modified sequence opt5 from hemagglutinin__InfluenzaA__ADD74868

SEQ ID NO: 187326 - RNA, 1701 nt, Artificial Sequence; identical to SEQ ID NO: 187245
  derived and/or modified sequence opt5 from hemagglutinin__InfluenzaA__ADD74878

SEQ ID NO: 187327 - RNA, 1701 nt, Artificial Sequence
  derived and/or modified sequence opt5 from hemagglutinin__InfluenzaA__ADD74888
augaaggccauccuggugguccuccuguacaccuucgcuacagccaacgcggacacgcuuugcauuggcuaucacgcuaauaacagcaccgauacaguugacaccgugcuggagaagaaugugacagucacccauuccguggaucuccuggaagacaagcacaacgggaaacuuuguaagcugagaggaguugcuccccuccaucugggcaaaugcaauaucgccggguggauucugggaaacccugagugugaaucucucagcacagccuccucuuggagcuacaucguggagaccuccucuagcgauaauggcacgugcuauccgggggacuuuauugauuacgaagaacugcgggagcagcuuuccagcgucucuuccuucgaacgcuuugagaucuuccccaagaccaacagcuggccuaaucacgacucuaacaagggagugacagccgcuuguccccaugccggcgcgaaauccuuuuauaagaaucugaucuggcucguuaaaaagggcaacagcuacccuaaacugucuaaguccuauauuaaugauaaggggaaagaagugcuuguccuguggggaauccaccaccccagcaccuccgccgaccaacagucucucuaccagaacgcugaugccuacguguucgugggcacaagcagauauuccaagaaauuuaagccugagauugcuauccggccgaaaguccgcgaccaggaggggagaaugaauuacuauuggacccugguugaacccggagauaagauuacguucgaggccacaggcaaccugguggugccucgguacgcguuugccauggaacgcaacgcugggagcggaaucauuaucucugacacccccguccaugacugcaauacaaccugucaaaccccuaaaggcgccaucaacacaucccuccccuuccagaauauucacccgaucacgauuggcaagugcccuaaguaugugaaaagcaccaagcugagacuugcuacagggcugcggaacguucccucuauccagagccgcggacucuuuggcgccauugccggguucaucgagggaggcuggaccgggaugguggauggaugguacggcuaucaucaccagaaugaacaaggcuccggguacgcugcggaccugaaaucuacacagaacgccaucgaugagauuaccaauaaggucaacagcgugaucgagaaaaugaauacgcaguuuacagcuguuggaaaggaguucaaccaccuugagaagagaauugaaaaucugaacaaaaagguggacgauggcuuccucgacaucuggaccuacaaugccgagcugcugguccuccuggaaaacgagcggacccuugauuaucaugacuccaaugugaaaaaccuguacgagaagguccgcagccagcucaaaaacaaugccaaggaaauugggaacggauguuuugaguucuaucacaagugcgauaauacauguauggaaucugugaaaaacggcaccuacgacuauccuaaguacuccgaggaagcuaaacugaauagagaggagaucgaugggguuaaacuugaaagcacacggaucuaucaaauucuggccaucuacucuacgguggcguccagccucguccuggugguuucccugggcgcuauuucuuuuuggaugugcagcaacggaucccuccagugccgcaucuguauuuga

SEQ ID NO: 187328 - RNA, 1701 nt, Artificial Sequence
  derived and/or modified sequence opt5 from hemagglutinin__InfluenzaA__ADD74898
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauuaauuacgaagaacugcgggagcagcuuuccagcgucucuuccuucgaacgcuuugagaucuuccccaagacaagcucuuggccuaaccacgacuccaauaagggagugaccgcugccuguccccaugcuggcgccaagagcuuuuauaaaaaccugaucuggcucguuaaaaagggcaauucuuacccuaaacuguccaagagcuauauuaacgauaaggggaaagaagugcuuguccuguggggaauccaccaccccuccacaucugcggaccaacagagccucuaccagaaugccgaugcuuacguguucgugggcaccuccagauauagcaagaaauuuaagccugagauugccauccggccgaaaguccgcgaccaggaggggagaaugaacuacuauuggacgcugguugaacccggagauaagauuacauucgaggcuaccggcaaccugguggugccucgguacgccuuugcgauggaacgcaaugccgggucuggaaucauuaucuccgacacacccguccaugauugcaacaccaccugucaaacaccuaaaggcgcuaucaauacgagccuccccuuccagaacauucacccgaucaccauuggcaagugcccuaaguaugugaaaucuacaaagcugagacuugccaccgggcugcggaauguucccagcauccagucccgcggacucuuuggcgcuauugccggguucaucgagggaggcuggacagggaugguggacggaugguacggcuaucaucaccagaacgaacaaggcucuggguacgccgcugaccugaaaagcacccagaaugcgaucgauaagauuacgaacaaagucaauuccgugaucgagaagaugaacacacaguuuaccgccguuggaaaggaguucaaucaccuugagaaaagaauugagaaccugaauaagaaaguggacgauggcuuccucgacaucuggaccuacaacgcugaacugcugguccuccuggagaaugaacggacacuugauuaucaugacagcaacgugaagaaccuguacgagaaaguccgcucucagcucaagaauaacgccaaggagauugggaauggauguuuugaguucuaucacaaaugcgauaacaccuguauggaauccgugaagaauggcacauacgacuauccuaaauacagcgaagaggccaagcugaacagagaagagaucgaugggguuaaacuugagucuacgcggaucuaucaaauucuggcuaucuacuccaccguggccagcucccucguccuggugguuucucugggcgcgauuagcuuuuggaugugcuccaauggaucucuccagugccgcaucuguauuuga

SEQ ID NO: 187329 - RNA, 1701 nt, Artificial Sequence
  derived and/or modified sequence opt5 from hemagglutinin__InfluenzaA__ADD74908
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuuaccauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacgagauuacgaauaaggucaacuccgugaucgagaaaaugaauacacaguuuaccgccguuggaaaggaguucaaccaccuugagaagagaauugaaaaucugaacaaaaagguggaugacggcuuccucgauaucuggaccuacaaugcugagcugcugguccuccuggaaaacgagcggacacuugacuaucaugauagcaaugugaaaaaccuguacgagaagguccgcucucagcucaaaaacaaugccaaggaaauugggaacggauguuuugaguucuaucacaagugcgacaauaccuguauggaauccgugaaaaacggcacauacgauuauccuaaguacagcgaggaagccaaacugaauagagaggagaucgacgggguuaaacuugaaucuacgcggaucuaucaaauucuggcuaucuacuccaccguggccagcucccucguccuggugguuucucugggcgcgauuagcuuuuggaugugcuccaacggaucucuccagugccgcaucuguauuuga

SEQ ID NO: 187330 - RNA, 1701 nt, Artificial Sequence; identical to SEQ ID NO: 187323
  derived and/or modified sequence opt5 from hemagglutinin__InfluenzaA__ADD74918

SEQ ID NO: 187331 - RNA, 1701 nt, Artificial Sequence; identical to SEQ ID NO: 187245
  derived and/or modified sequence opt5 from hemagglutinin__InfluenzaA__ADD74928

SEQ ID NO: 187332 - RNA, 1701 nt, Artificial Sequence; identical to SEQ ID NO: 187323
  derived and/or modified sequence opt5 from hemagglutinin__InfluenzaA__ADD74938

SEQ ID NO: 187333 - RNA, 1701 nt, Artificial Sequence
  derived and/or modified sequence opt5 from hemagglutinin__InfluenzaA__ADD74958
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaaaauaagcacaacgggaaacuuuguaagcugagaggaguugcuccccuccaucugggcaaaugcaauaucgccggguggauucugggaaacccugagugugaaucucucagcacagccuccucuuggagcuacaucguggagaccuccucuagcgauaauggcacgugcuauccgggggacuuuauuaacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaacuacuauuggacccugguugaacccggagacaagauuacguucgaggccacaggcaaucugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggauggaugguacggcuaucaucaccagaaugaacaaggcucuggguacgcugcggaccugaaaagcacacagaacgccaucgacaagauuaccaauaaagucaacuccgugaucgagaagaugaauacgcaguuuacagcuguuggaaaggaguucaaccaccuugagaaaagaauugagaaucugaacaagaaaguggaugacggcuuccucgauaucuggaccuacaaugccgaacugcugguccuccuggagaacgaacggacccuugacuaucaugauagcaacgugaagaaucuguacgagaaaguccgcucucagcucaagaacaaugccaaggagauugggaacggauguuuugaguucuaucacaaaugcgacaauacauguauggaauccgugaagaacggcaccuacgauuauccuaaauacagcgaagaggcuaagcugaauagagaagagaucgacgggguuaaacuugagucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 187334 - RNA, 1701 nt, Artificial Sequence; identical to SEQ ID NO: 186857
  derived and/or modified sequence opt5 from hemagglutinin__InfluenzaA__ADD74968

SEQ ID NO: 187335 - RNA, 1701 nt, Artificial Sequence
  derived and/or modified sequence opt5 from hemagglutinin__InfluenzaA__ADD74998
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaaagaggcucuggguacgcugcggaucugaaaagcacacaaaacgccaucgacaagauuaccaauaaagucaacuccgugaucgagaagaugaauacgcaguuuacagcuguuggaaaggaguucaaccaccuugaaaaacggauugagaaucugaacaagaaaguggaugacggcuuccucgauaucuggaccuacaaugccgaacugcugguccuccuggagaacgaacgcacccuugacuaucaugauagcaaugugaagaaccuguacgagaaagucagaucucagcucaagaacaaugccaaggagauugggaacggauguuuugaguucuaucacaaaugcgacaauacauguauggaguccgugaagaacggcaccuacgauuauccuaaauacagcgaagaggcuaagcugaaucgggaagagaucgacgggguuaaacuugagucuacacgcaucuaucagauucuggccaucuacuccacgguggcgagcucccucguccuggugguuucucugggcgcuauuagcuuuuggaugugcuccaacggaucucuccaaugcagaaucuguauuuga

SEQ ID NO: 187336 - RNA, 1701 nt, Artificial Sequence; identical to SEQ ID NO: 186857
  derived and/or modified sequence opt5 from hemagglutinin__InfluenzaA__ADD75008

SEQ ID NO: 187337 - RNA, 1701 nt, Artificial Sequence; identical to SEQ ID NO: 186857
  derived and/or modified sequence opt5 from hemagglutinin__InfluenzaA__ADD75018

SEQ ID NO: 187338 - RNA, 1701 nt, Artificial Sequence; identical to SEQ ID NO: 186857
  derived and/or modified sequence opt5 from hemagglutinin__InfluenzaA__ADD75028

SEQ ID NO: 187339 - RNA, 1701 nt, Artificial Sequence; identical to SEQ ID NO: 186794
  derived and/or modified sequence opt5 from hemagglutinin__InfluenzaA__ADD75058

SEQ ID NO: 187340 - RNA, 1701 nt, Artificial Sequence; identical to SEQ ID NO: 187113
  derived and/or modified sequence opt5 from hemagglutinin__InfluenzaA__ADD75088

SEQ ID NO: 187341 - RNA, 1701 nt, Artificial Sequence; identical to SEQ ID NO: 185693
  derived and/or modified sequence opt5 from hemagglutinin__InfluenzaA__ADD75098

SEQ ID NO: 187342 - RNA, 1701 nt, Artificial Sequence
  derived and/or modified sequence opt5 from hemagglutinin__InfluenzaA__ADD75108
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacauccccagcauucagucccgcggacucuuuggcgccaucgccggguucaucgagggaggcuggaccgggaugguugacggaugguacggcuaucaucaccagaaugaacaaggcucuggguacgcugcggaucugaaaagcacacagaacgccauugacaagaucaccaauaaagugaacuccgucauugagaagaugaauacgcaguuuacagcugugggaaaggaguucaaccaccuugagaaaagaaucgagaaucugaacaagaaaguugaugacggcuuccucgauauuuggaccuacaaugccgaacugcuggugcuccuggagaacgaacggacccuugacuaucaugauagcaaugucaagaaccuguacgagaaagugcgcucucagcucaagaacaaugccaaggagaucgggaacggauguuuugaguucuaucacaaaugcgacaauacauguauggaauccgucaagaacggcaccuacgauuauccuaaauacagcgaagaggcuaagcugaauagagaagagaucgacggggugaaacuugagucuacacggauuuaucaaauccuggccauuuacuccacgguugcgagcucccucgugcuggucgugucucugggcgcuaucagcuuuuggaugugcuccaacggaucucuccagugccgcauuuguaucuga

SEQ ID NO: 187343 - RNA, 1701 nt, Artificial Sequence; identical to SEQ ID NO: 185693
  derived and/or modified sequence opt5 from hemagglutinin__InfluenzaA__ADD75118

SEQ ID NO: 187344 - RNA, 1701 nt, Artificial Sequence; identical to SEQ ID NO: 186140
  derived and/or modified sequence opt5 from hemagglutinin__InfluenzaA__ADD75128

SEQ ID NO: 187345 - RNA, 1701 nt, Artificial Sequence; identical to SEQ ID NO: 185693
  derived and/or modified sequence opt5 from hemagglutinin__InfluenzaA__ADD75138

SEQ ID NO: 187346 - RNA, 1701 nt, Artificial Sequence; identical to SEQ ID NO: 186857
  derived and/or modified sequence opt5 from hemagglutinin__InfluenzaA__ADD75148

SEQ ID NO: 187347 - RNA, 1701 nt, Artificial Sequence; identical to SEQ ID NO: 185693
  derived and/or modified sequence opt5 from hemagglutinin__InfluenzaA__ADD75158

SEQ ID NO: 187348 - RNA, 1701 nt, Artificial Sequence
  derived and/or modified sequence opt5 from hemagglutinin__InfluenzaA__ADD84494
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaucagcucuuggccuaaucacgaucccaacaagggagugaccgccgcuuguccucaugccggcgcgaaauccuuuuauaagaaucugauuuggcucguuaaaaagggcaacagcuaccccaaacugucuaaguccuauaucaaugacaaggggaaagaagugcuuguccuguggggcauucaccacccuagcacauccgccgaucaacagucucucuaccagaacgcugacgccuacguguucgugggaaccagcagauauuccaagaaauuuaagccggagaucgcuauucggcccaaaguccgcgaucaggaggggagaaugaauuacuauuggacacugguugaaccuggagacaagaucaccuucgaggccacgggcaaccugguggugccccgguacgcguuugccauggaacgcaacgcugggagcggaauuaucaucucugauacaccuguccauggcugcaauaccacaugucaaacccccaaaggcgccauuaacaccucccucccguuccagaauauccacccuauuacaaucgggaagugccccaaguaugugaaaagcacgaagcugagacuugcuaccggacugcggaacguuccuucuauucagagccgcggccucuuuggggccaucgccggauucaucgagggcggguggacaggaaugguggacggcugguacggcuaucaucaccagaaugaacaaggguccggauacgcugcggaccugaaaucuacccagaacgccauugaugagaucacaaauaaggucaacagcgugauugagaaaaugaauacccaguuuacggcuguuggcaaggaguucaaccaccuugagaagagaaucgaaaaucugaacaaaaagguggacgauggguuccucgacauuuggacauacaaugccgagcugcugguccuccuggaaaacgagcggacccuugauuaucaugacuccaaugugaaaaaccuguacgagaagguccgcagccagcucaaaaacaaugccaaggaaaucggaaacggcuguuuugaguucuaucacaagugcgauaauaccuguauggaaucugugaaaaacgggacauacgacuaucccaaguacuccgaggaagcuaaacugaauagagaggagaucgauggcguuaaacuugaaagcacccggauuuaucaaauccuggccauuuacucuacaguggcguccagccucguccuggugguuucccugggagcuaucucuuuuuggaugugcagcaacggcucccuccagugccgcauuuguaucuga

SEQ ID NO: 187349 - RNA, 1701 nt, Artificial Sequence
  derived and/or modified sequence opt5 from hemagglutinin__InfluenzaA__ADD84495
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaucagcucuuggccuaaucacgaucccaacaagggagugaccgccgcuuguccucaugccggcgcgaaauccuuuuauaagaaucugauuuggcucguuaaaaagggcaacagcuaccccaaacugucuaaguccuauaucaaugacaaggggaaagaagugcuuguccuguggggcauucaccacccuagcacauccgccgaucaacagucucucuaccagaacgcugacgccuacguguucgugggaaccagcagauauuccaagaaauuuaagccggagaucgcuauucggcccaaaguccgcgaucaggaggggagaaugaauuacuauuggacacugguugaaccuggagacaagaucaccuucgaggccacgggcaaccugguggugccccgguacgcguuugccauggaacgcaacgcugggagcggaauuaucaucucugauacaccuguccaugacugcaauaccacaugucaaacccccaaaggcgccauuaacaccucccucccguuccagaauauccacccuauuacaaucggcaagugccccaaguaugugaaaagcacgaagcugagacuugcuaccgggcugcggaacguuccuucuauucagagccgcggacucuuuggcgccaucgccggguucaucgagggaggcuggacagggaugguggacggaugguacggcuaucaucaccagaaugaacaaggcuccggguacgcugcggaucugaaaucuacccagaacgccauugacgagaucacaaauaaggucaacagcgugauugagaaaaugaauacccaguuuacggcuguuggaaaggaguucaaccaccuugagaagagaaucgaaaaucugaacaaaaagguggaugacggcuuccucgauauuuggacauacaaugccgagcugcugguccuccuggaaaacgagcggacccuugacuaucaugauuccaaugugaaaaaccuguacgagaagguccgcagccagcucaaaaacaaugccaaggaaaucgggaacggauguuuugaguucuaucacaagugcgacaauaccuguauggaaucugugaaaaacggcacauacgauuaucccaaguacuccgaggaagcuaaacugaauagagaggagaucgacgggguuaaacuugaaagcacccggauuuaucaaauccuggccauuuacucuacaguggcguccagccucguccuggugguuucccugggcgcuaucucuuuuuggaugugcagcaacggaucccuccagugccgcauuuguaucuga

SEQ ID NO: 187350 - RNA, 1701 nt, Artificial Sequence
  derived and/or modified sequence opt5 from hemagglutinin__InfluenzaA__ADD84496
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaucagcucuuggccuaaucacgaucccaacaagggagugaccgccgcuuguccucaugccggcgcgaaauccuuuuauaagaaucugauuuggcucguuaaaaagggcaacagcuaccccaaacugucuaaguccuauaucaaugacaaggggaaagaagugcuuguccuguggggcauucaccacccuagcacauccgccgaucaacagucucucuaccagaacgcugacgccuacguguucgugggaagcuccagauauagcaagaaauuuaagccggagaucgcuauucggcccaaaguccgcgaucaggaggggagaaugaauuacuauuggacccugguugaaccuggagacaagaucacauucgaggccaccggcaaccugguggugccccgguacgcguuugccauggaacgcaacgcugggucuggaauuaucaucuccgauacgccuguccaugacugcaauacaaccugucaaacacccaaaggcgccauuaacaccagccucccguuccagaauauccacccuauuaccaucggcaagugccccaaguaugugaaaucuacaaagcugagacuugcuacggggcugcggaacguuccuagcauucagucccgcggacucuuuggcgccaucgccggguucaucgagggaggcuggaccgggaugguggacggaugguacggcuaucaucaccagaaugaacaaggcucuggguacgcugcggaucugaaaagcacacagaacgccauugacgagaucaccaauaaggucaacuccgugauugagaaaaugaauacacaguuuaccgcuguuggaaaggaguucaaccaccuugagaagagaaucgaaaaucugaacaaaaagguggaugacggcuuccucgauauuuggacguacaaugccgagcugcugguccuccuggaaaacgagcggacacuugacuaucaugauagcaaugugaaaaaccuguacgagaagguccgcucucagcucaaaaacaaugccaaggaaaucgggaacggauguuuugaguucuaucacaagugcgacaauaccuguauggaauccgugaaaaacggcaccuacgauuaucccaaguacagcgaggaagcuaaacugaauagagaggagaucgacgggguuaaacuugaaucuacacggauuuaucaaauccuggccauuuacuccaccguggcgagcucccucguccuggugguuucucugggcgcuaucagcuuuuggaugugcuccaacggaucucuccagugccgcauuuguaucuga

SEQ ID NO: 187351 - RNA, 1701 nt, Artificial Sequence; identical to SEQ ID NO: 187349
  derived and/or modified sequence opt5 from hemagglutinin__InfluenzaA__ADD84497

SEQ ID NO: 187352 - RNA, 1701 nt, Artificial Sequence
  derived and/or modified sequence opt5 from hemagglutinin__InfluenzaA__ADD84498
augaaggccauccuggugguccuccuguacaccuucgcuacagccaacgcggacacgcuuugcauuggcuaucacgcuaauaacagcaccgauacaguugugaccgugcuggagaagaaugucacagugacccauuccguuaaccuccuggaagacaagcacaaugggaaacuuuguaagcugagaggaguggcuccccuccaucugggcaaaugcaacaucgccggguggauucugggaaauccugagugugaaucucucagcacagccuccucuuggagcuacaucgucgagaccuccucuagcgauaacggcacgugcuauccgggggacuuuauugauuacgaagaacugcgggagcagcuuuccagcgugucuuccuucgaacgcuuugagaucuuccccaagaucagcucuuggccuaaucacgaccccaacaagggaguuaccgccgcuuguccucaugccggcgcgaaauccuuuuauaagaaucugauuuggcucgugaaaaagggcaacagcuaccccaaacugucuaaguccuauaucaaugauaaggggaaagaaguccuugugcuguggggcauucaccacccuagcacauccgccgaccaacagucucucuaccagaacgcugaugccuacguguucgucggaagcuccagauauagcaagaaauuuaagccggagaucgcuauucggcccaaaguucgcgaccaggaggggagaaugaauuacuauuggacccugguggaaccuggagauaagaucacauucgaggccaccggcaaccugguggucccccgguacgcguuugccauggaacgcaacgcugggucuggaauuaucaucuccgacacgccugugcaugauugcaauacaaccugucaaacacccaaaggcgccauuaacaccagccucccguuccagaauauccacccuauuaccaucggcaagugccccaaguauguuaaaucuacaaagcugagacuugcuacggggcugcggaacgugccuagcauucagucccgcggacucuuuggcgccaucgccggguucaucgagggaggcuggaccgggauggucgacggaugguacggcuaucaucaccagaaugaacaaggcucuggguacgcugcggaccugaaaagcacacagaacgccauugaugagaucaccaauaaggugaacuccguuauugagaaaaugaauacacaguuuaccgcugugggaaaggaguucaaccaccuugagaagagaaucgaaaaucugaacaaaaaggucgacgauggcuuccucgacauuuggacguacaaugccgagcugcuggugcuccuggaaaacgagcggacacuugauuaucaugacagcaaugucaaaaaccuguacgagaaggugcgcucucagcucaaaaacaaugccaaggaaaucgggaacggauguuuugaguucuaucacaagugcgauaauaccuguauggaauccguuaaaaacggcaccuacgacuaucccaaguacagcgaggaagcuaaacugaauagagaggagaucgauggggugaaacuugaaucuacacggauuuaucaaauccuggccauuuacuccaccgucgcgagcucccucgugcugguugugucucugggcgcuaucagcuuuuggaugugcuccaacggaucucuccagugccgcauuuguaucuga

SEQ ID NO: 187353 - RNA, 1701 nt, Artificial Sequence; identical to SEQ ID NO: 187349
  derived and/or modified sequence opt5 from hemagglutinin__InfluenzaA__ADD84499

SEQ ID NO: 187354 - RNA, 1701 nt, Artificial Sequence
  derived and/or modified sequence opt5 from hemagglutinin__InfluenzaA__ADD92535
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgauagagaggggcggaugaauuacuauuggacccugguugaacccggagacaagauuacguucgaggccacaggcaaccugguggugccucgcuacgcguuugccauggaaagaaacgcugggucuggaaucauuaucuccgauacccccguccaugacugcaauacaaccugucagaccccuaaaggcgccaucaacacaagccuccccuuccaaaauauucacccgaucacgauuggcaagugcccuaaguaugugaaaucuaccaagcugcggcuugcuacagggcugcgcaacguucccagcauccaguccagaggacucuuuggcgccauugccggguucaucgagggaggcuggaccgggaugguggacggaugguacggcuaucaucaccagaaugaacagggcucuggguacgcugcggaucugaaaagcacacaaaacgccaucgacgagauuaccaaucgggucaacuccgugaucgagaagaugaauacgcaguuuacagcuguuggaaaagaguucaaccaccuugagaagcgcauugaaaaucugaacaagaaaguggauggcggguuccucgacaucuggaccuacaaugccgagcugcugguccuccuggaaaacgagagaacccuugauuaucaugacagcaaugugaagaaccuguacgagaaaguccggucucagcucaagaacaaugccaaagaaauuggaaacggcuguuuugaguucuaucacaagugcgauaauacauguauggaauccgugaagaacgggaccuacgacuauccuaaauacagcgaggaagcuaagcugaaucgcgaggagaucgauggcguuaaacuugaaucuacaagaaucuaucagauucuggccaucuacuccacgguggcgagcucccucguccuggugguuucucugggagcuauuagcuuuuggaugugcuccaacggcucucuccaaugccggaucuguauuuga

SEQ ID NO: 187355 - RNA, 1701 nt, Artificial Sequence; identical to SEQ ID NO: 187281
  derived and/or modified sequence opt5 from hemagglutinin__InfluenzaA__ADD96766

SEQ ID NO: 187356 - RNA, 1701 nt, Artificial Sequence; identical to SEQ ID NO: 185873
  derived and/or modified sequence opt5 from hemagglutinin__InfluenzaA__ADD96776

SEQ ID NO: 187357 - RNA, 1701 nt, Artificial Sequence; identical to SEQ ID NO: 185873
  derived and/or modified sequence opt5 from hemagglutinin__InfluenzaA__ADD96786

SEQ ID NO: 187358 - RNA, 1701 nt, Artificial Sequence; identical to SEQ ID NO: 187178
  derived and/or modified sequence opt5 from hemagglutinin__InfluenzaA__ADD96796

SEQ ID NO: 187359 - RNA, 1701 nt, Artificial Sequence
  derived and/or modified sequence opt5 from hemagglutinin__InfluenzaA__ADD96806
augaaggccauccuggugguccuccuguacacccuugcuacagccaacgcggacacgcugugcauuggcuaucacgcuaauaacagcaccgauacaguugacaccgugcucgagaaaaaugugacagucacccauuccgugaaccugcuugaagauaagcacaaugggaaacuguguaagcucagaggaguugcuccccugcaucugggcaaaugcaacaucgccggguggauucucggaaauccugagugugaaucucugagcacagccuccucuuggagcuacaucguggagaccuccucuagcgacaacggcacgugcuauccgggggauuucauugacuacgaggaacuucgggagcagcuguccagcgucucuuccuuugaacgcuucgagaucuuucccaagaccagcucuuggccuaaucacgauuccaacaagggagugacagccgcuuguccccaugccggcgcgaaaucuuucuauaagaaucucaucuggcugguuaaaaagggcaacagcuacccuaaacuuuccaagagcuauauuaaugacaaggggaaagaagugcugguccucuggggaauccaccaccccuccaccucugccgaucaacagagccuguaccagaacgcugacgccuacguguuugugggcacauccagauauagcaagaaauucaagccugagauugcuauccggccgaaaguccgcgaucaggaggggagaaugaauuacuauuggacccugguugaacccggagacaagauuacguuugaggccacaggcaaccucguggugccucgguacgcguucgccauggaacgcaacgcugggucuggaaucauuaucuccgauacccccguccaugacugcaauacaaccugucaaaccccuaaaggcgccaucaacacaagccugcccuuucagaauauucacccgaucacgauuggcaagugcccuaaguaugugaaaucuaccaaacuuagacuggcuacagggcuccggaacguucccagcauccagucccgcggacuguucggcgccauugccggguuuaucgagggaggcuggaccgggaugguggacggaugguacggcuaucaucaccagaaugaacaaggcucuggguacgcugcggaucuuaagagcacacagaacgccaucgacgagauuaccaauaaggucaacuccgugaucgagaaaaugaauacgcaguucacagcuguuggaaaggaauuuaaccaccuggagaagagaauugaaaaucucaacaaaaagguggaugacggcuuccuggauaucuggaccuacaaugccgagcugcucguccugcuugaaaacgagcggacccuggacuaucaugauagcaaugugaaaaaccucuacgagaagguccgcucucagcugaaaaacaaugccaaggaaauugggaacggauguuucgaguuuuaucacaagugcgacaauacauguauggaauccgugaaaaacggcaccuacgauuauccuaaguacagcgaggaagcuaaacuuaauagagaggagaucgacgggguuaagcuggaaucuacacggaucuaucaaauucucgccaucuacuccacgguggcgagcucccugguccuggugguuucucucggcgcuauuagcuucuggaugugcuccaacggaucucugcagugccgcaucuguauuuga

SEQ ID NO: 187360 - RNA, 1701 nt, Artificial Sequence; identical to SEQ ID NO: 186857
  derived and/or modified sequence opt5 from hemagglutinin__InfluenzaA__ADD96816

SEQ ID NO: 187361 - RNA, 1701 nt, Artificial Sequence
  derived and/or modified sequence opt5 from hemagglutinin__InfluenzaA__ADD96826
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaagucauggaucaggaggggcgcaugaauuacuauuggacccugguugaacccggagacaagauuacguucgaggccacaggcaaccugguggugccuagauacgcguuugccauggaacggaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugcgccuugcuacagggcugagaaacguucccagcauccagucccggggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuugcugccguuggaaaggaguucaaccaccuugagaagcgcauugaaaaucugaacaaaaagguggaugacggcuuccucgauaucuggacauacaaugccgagcugcugguccuccuggaaaacgagagaacccuugacuaucaugauagcaaugugaaaaaccuguacgagaagguccggucucagcucaaaaacaaugcuaaggaaauugggaacggauguuuugaguucuaucacaagugcgacaauaccuguauggaauccgugaaaaacggcacauacgauuauccuaaguacagcgaggaagccaaacugaaucgcgaggagaucgacgggguuaaacuugaaucuaccagaaucuaucaaauucuggcgaucuacuccacaguggcuagcucccucguccuggugguuucucugggcgccauuagcuuuuggaugugcuccaacggaucucuccagugccggaucuguauuuga

SEQ ID NO: 187362 - RNA, 1701 nt, Artificial Sequence; identical to SEQ ID NO: 185693
  derived and/or modified sequence opt5 from hemagglutinin__InfluenzaA__ADD96836

SEQ ID NO: 187363 - RNA, 1701 nt, Artificial Sequence; identical to SEQ ID NO: 185693
  derived and/or modified sequence opt5 from hemagglutinin__InfluenzaA__ADD96846

SEQ ID NO: 187364 - RNA, 1701 nt, Artificial Sequence; identical to SEQ ID NO: 187245
  derived and/or modified sequence opt5 from hemagglutinin__InfluenzaA__ADD96856

SEQ ID NO: 187365 - RNA, 1701 nt, Artificial Sequence; identical to SEQ ID NO: 186046
  derived and/or modified sequence opt5 from hemagglutinin__InfluenzaA__ADD96886

SEQ ID NO: 187366 - RNA, 1701 nt, Artificial Sequence; identical to SEQ ID NO: 187320
  derived and/or modified sequence opt5 from hemagglutinin__InfluenzaA__ADD96896

SEQ ID NO: 187367 - RNA, 1701 nt, Artificial Sequence; identical to SEQ ID NO: 186857
  derived and/or modified sequence opt5 from hemagglutinin__InfluenzaA__ADD96906

SEQ ID NO: 187368 - RNA, 1701 nt, Artificial Sequence; identical to SEQ ID NO: 186857
  derived and/or modified sequence opt5 from hemagglutinin__InfluenzaA__ADD96916

SEQ ID NO: 187369 - RNA, 1701 nt, Artificial Sequence; identical to SEQ ID NO: 186857
  derived and/or modified sequence opt5 from hemagglutinin__InfluenzaA__ADD96926

SEQ ID NO: 187370 - RNA, 1701 nt, Artificial Sequence
  derived and/or modified sequence opt5 from hemagglutinin__InfluenzaA__ADD96936
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugaucaaaaagggcaacagcuacccuaaacucuccaagagcuauauuaaugacaaggggaaagaaguucuggugcuuuggggaauccaccaccccuccaccucugccgaucaacagagccuguaccagaacgcugacgccuacgucuucgugggcacauccagauauagcaagaaauuuaagccugagauugcuauccggccgaaagugcgcgaucaggaggggagaaugaauuacuauuggacccucgucgaacccggagacaagauuacguucgaggccacaggcaaccugguugugccucgguacgcguuugccauggaacgcaacgcugggucuggaaucaucauuuccgauacccccgugcaugacugcaauacaaccugucaaaccccuaaaggcgccaucaacacaagccugcccuuccagaauauucacccgaucacgauuggcaagugcccuaaguaugucaaaucuaccaagcucagacuggcuacagggcuucggaacgugcccagcauccagucccgcggacuguuuggcgccaucgccggguucauugagggaggcuggaccgggaugguugacggaugguacggcuaucaucaccagaaugaacaaggcucuggguacgcugcggaucucaaaagcacacagaacgccaucgacgagauuaccaauaaggugaacuccgucaucgagaaaaugaauacgcaguuuacagcugugggaaaggaguucaaccaccuggagaagagaauugaaaaucuuaacaaaaagguugaugacggcuuccuggauaucuggaccuacaaugccgagcuccuggugcugcucgaaaacgagcggacccuggacuaucaugauagcaaugucaaaaaccuuuacgagaaggugcgcucucagcugaaaaacaaugccaaggaaaucgggaacggauguuuugaguucuaucacaagugcgacaauacauguauggaauccgucaaaaacggcaccuacgauuauccuaaguacagcgaggaagcuaaacucaauagagaggagauugacggggugaagcuggaaucuacacggaucuaucaaauucuugccaucuacuccacgguugcgagcucccuggugcucgucgugucucugggcgcuauuagcuuuuggaugugcuccaacggaucucugcagugccgcaucuguauuuga

SEQ ID NO: 187371 - RNA, 1701 nt, Artificial Sequence
  derived and/or modified sequence opt5 from hemagglutinin__InfluenzaA__ADD96946
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaaaugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgggagcagcuuuccagcgucucuuccuucaagcgcuuugaaaucuuccccaagaccagcucuuggccuaaucacgauuccaacaaaggagugacagccgcuuguccccaugccggcgccaagagcuuuuauaaaaaucugaucuggcucguuaagaaaggcaacucuuacccuaagcuguccaagagcuauauuaaugacaaagggaaggaggugcuuguccuguggggaauccaccaccccuccaccucugccgaucaacagagccucuaccagaacgcugacgccuacguguucgugggcacauccagauauagcaaaaaguuuaaaccugaaauugcuauccggccgaagguccgcgaucaggaggggagaaugaauuacuauuggacccugguugagcccggagacaaaauuacguucgaagccacaggcaaccugguggugccucgguacgcguuugccauggagcgcaacgcugggucuggaaucauuaucuccgauacccccguccaugacugcaauacaaccugucaaaccccuaagggcgccaucaacacaagccuccccuuccagaauauucacccgaucacgauuggcgaaugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacaagauuaccaauaaagucaacuccgugaucgagaagaugaauacgcaguuuacagcuguuggaaaggaguucaaccaccuugagaaaagaauugagaaucugaacaagaaaguggaugacggcuuccucgauaucuggaccuacaaugccgaacugcugguccuccuggagaacgaacggacccuugacuaucaugauagcaaugugaagaaccuguacgagaaaguccgcucucagcucaagaacaaugccaaggagauugggaacggauguuuugaguucuaucacaaaugcgacaauacauguauggaauccgugaagaacggcaccuacgauuauccuaaauacagcgaagaggcuaagcugaauagagaagagaucgacgggguuaaacuugagucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 187372 - RNA, 1701 nt, Artificial Sequence
  derived and/or modified sequence opt5 from hemagglutinin__InfluenzaA__ADD96956
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguuaagcccggagauaaaauuacguucgaggccacaggcaaccugguggugccucgguacgcguuugccauggaacgcaacgcugggucuggaaucauuaucuccgacacccccguccaugauugcaauacaaccugucaaaccccuaagggcgccaucaacacaagccuccccuuccagaauauucacucuaucacgauuggcaagugcccgaaauauguuaagagcaccaaacugagacuugcuacagggcugcggaacgugccuuccauccagucucgcggacucuuuggcgccauugccggguucaucgagggaggcuggaccgggaugguggacggaugguacggcuaucaucaccagaaugaacaaggcagcggguacgcugcggaccugaaguccacacagaacgccaucgaugagauuaccaauaaagucaacagcgugaucgagaagaugaauacgcaguuuacagcuguuggaaaggaguucaaccaccuugagaaaagaauugaaaaucugaacaagaaaguggacgauggcuuccucgacaucuggaccuacaaugccgagcugcugguccuccuggaaaacgagcggacccuugauuaucaugacucuaaugugaagaaccuguacgagaaaguccgcucccagcucaagaacaaugccaaggaaauugggaacggauguuuugaguucuaucacaaaugcgauaauacauguauggaaagcgugaagaacggcaccuacgacuaucccaaauacucugaggaagcuaagcugaauagagaggagaucgaugggguuaaacuugaauccacacggaucuaucaaauucuggccaucuacagcacgguggcguccucucucguccuggugguuagccugggcgcuauuuccuuuuggaugugcucuaacggaagccuccagugccgcaucuguauuuga

SEQ ID NO: 187373 - RNA, 1701 nt, Artificial Sequence; identical to SEQ ID NO: 185693
  derived and/or modified sequence opt5 from hemagglutinin__InfluenzaA__ADD96976

SEQ ID NO: 187374 - RNA, 1701 nt, Artificial Sequence; identical to SEQ ID NO: 185693
  derived and/or modified sequence opt5 from hemagglutinin__InfluenzaA__ADD96986

SEQ ID NO: 187375 - RNA, 1701 nt, Artificial Sequence
  derived and/or modified sequence opt5 from hemagglutinin__InfluenzaA__ADD97035
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagaauggcuacagggcuucggaacguucccagcauccagucccgcggacuguuuggcgccauugccggguucaucgagggaggcuggaccgggaugguggacggaugguacggcuaucaucaccagaaugaacaaggcucuggguacgcugcggaucucaaaagcacacagaacgccaucgacgagauuaccaauaaggucaacuccgugaucgagaaaaugaauacgcaguuuacagcuguuggaaaggaguucaaccaccuggagaagagaauugaaaaucuuaacaaaaagguggaugacggcuuccuggauaucuggaccuacaaugccgagcuccugguccugcucgaaaacgagcggacccuggacuaucaugauagcaaugugaaaaaccuuuacgagaagguccgcucucagcugaaaaacaaugccaaggaaauugggaacggauguuuugaguucuaucacaagugcgacaauacauguauggaauccgugaaaaacggcaccuacgauuauccuaaguacagcgaggaagcuaaacucaauagagaggagaucgacgggguuaagcuggaaucuacacggaucuaucaaauucuugccaucuacuccacgguggcgagcucccugguccucgugguuucucugggcgcuauuagcuuuuggaugugcuccaacggaucucugcagugccgcaucuguauuuga

SEQ ID NO: 187376 - RNA, 1701 nt, Artificial Sequence
  derived and/or modified sequence opt5 from hemagglutinin__InfluenzaA__ADD97045
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuaccgacuacgaagaacugcgggagcagcuuuccagcgucucuuccuucgaacgcuuugagauuuuccccaagacaagcucuuggccuaaucacgauuccaacaagggagugaccgccgcuuguccccaugccggcgcgaaaucuuuuuauaagaaucugaucuggcucguuaaaaagggcaacagcuacccuaaacuguccaagagcuauaucaaugacaaggggaaagaagugcuuguccuguggggcauucaccaccccuccacaucugccgaucaacagagccucuaccagaacgcugacgccuacguguucgugggaaccuccagauauagcaagaaauuuaagccugagaucgcuauucggccgaaaguccgcgaucaggaggggagaaugaauuacuauuggacgcugguugaacccggagacaagaucacauucgaggccaccggcaaccugguggugccucgguacgcguuugccauggaacgcaacgcugggucuggaauuaucauuuccgauacacccguccaugacugcaauaccaccugucaaacaccuaaaggcgccaucaacacgagccuccccuuccagaauauccacccgauuaccaucggcaagugcccuaaguaugugaaaucuacaaagcugagacuugcuaccgggcugcggaacguucccagcauucagucccgcggacucuuuggcgccaucgccggguucauugagggaggcuggacagggaugguggacggaugguacggcuaucaucaccagaaugaacaaggcucuggguacgcugcggaucugaaaagcacccagaacgccaucgacgagaucacgaauaaggucaacuccgugauugagaaaaugaauacacaguuuaccgcuguuggaaaggaguucaaccaccuugagaagagaaucgaaaaucugaacaaaaagguggaugacggcuuccucgauauuuggaccuacaaugccgagcugcugguccuccuggaaaacgagcggacacuugacuaucaugauagcaaugugaaaaaccuguacgagaagguccgcucucagcucaaaaacaaugccaaggaaaucgggaacggauguuuugaguucuaucacaagugcgacaauaccuguauggaauccgugaaaaacggcacauacgauuauccuaaguacagcgaggaagcuaaacugaauagagaggagauugacgggguuaaacuugaaucuacgcggaucuaucaaauccuggccauuuacuccaccguggcgagcucccucguccuggugguuucucugggcgcuaucagcuuuuggaugugcuccaacggaucucuccagugccgcauuuguaucuga

SEQ ID NO: 187377 - RNA, 1701 nt, Artificial Sequence; identical to SEQ ID NO: 187376
  derived and/or modified sequence opt5 from hemagglutinin__InfluenzaA__ADD97055

SEQ ID NO: 187378 - RNA, 1701 nt, Artificial Sequence; identical to SEQ ID NO: 187376
  derived and/or modified sequence opt5 from hemagglutinin__InfluenzaA__ADD97123

SEQ ID NO: 187379 - RNA, 1701 nt, Artificial Sequence
  derived and/or modified sequence opt5 from hemagglutinin__InfluenzaA__ADD97161
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaaaagcuacccuaagcuguccaagagcuauauuaacgacaaagggaagaaagugcuuguccuguggggaauccaccaccccuccaccucugccgaucaacagagccucuaccagaaugcugacgccuacguguucgugggcacauccagauauagcaagaaauuuaagccugaaauugcuauccggccgaaaguccgcgaucaggaggggagaaugaacuacuauuggacccugguugagcccggagacaagauuacguucgaagccacaggcaaucugguggugccucgguacgcguuugccauggagcgcaacgcugggucuggaaucauuaucuccgauacccccguccaugacugcaacacaaccugucaaaccccuaagggcgccaucaauacaagccuccccuuccagaacauucacccgaucacgauuggcaaaugcccuaaguaugugaaaucuaccaagcugagacuugcuacagggcugcggaauguucccagcauccagucccgcggacucuuuggcgccauugccggguucaucgaaggaggcuggaccgggaugguggacggaugguacggcuaucaucaccagaacgagcaaggcucuggguacgcugcggaucugaaaagcacacagaaugccaucgacgaaauuaccaacaaggucaauuccgugaucgagaagaugaacacgcaguuuacagcuguuggaaaagaguucaaucaccuugaaaagagaauugagaaccugaauaaaaagguggaugacggcuuccucgauaucuggaccuacaacgccgaacugcugguccuccuggagaaugaacggacccuugacuaucaugauagcaacgugaaaaaucuguacgagaagguccgcucucagcucaagaacaacgccaaagagauugggaauggauguuuugaguucuaucacaagugcgacaacacauguauggaguccgugaaaaauggcaccuacgauuauccuaaguacagcgaagaggcuaaacugaacagagaagagaucgacgggguuaaacuugagucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 187380 - RNA, 1701 nt, Artificial Sequence
  derived and/or modified sequence opt5 from hemagglutinin__InfluenzaA__ADD97171
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggaucuaucaaauucuggccaucuacuccacgguggcgagcucccucguccuggugguuucucugggcgcugugagcuuuuggaugugcuccaacggaucucuccagugccgcauuuguaucuga

SEQ ID NO: 187381 - RNA, 1701 nt, Artificial Sequence; identical to SEQ ID NO: 185693
  derived and/or modified sequence opt5 from hemagglutinin__InfluenzaA__ADD97181

SEQ ID NO: 187382 - RNA, 1701 nt, Artificial Sequence; identical to SEQ ID NO: 185693
  derived and/or modified sequence opt5 from hemagglutinin__InfluenzaA__ADD97201

SEQ ID NO: 187383 - RNA, 1701 nt, Artificial Sequence; identical to SEQ ID NO: 187376
  derived and/or modified sequence opt5 from hemagglutinin__InfluenzaA__ADD97211

SEQ ID NO: 187384 - RNA, 1701 nt, Artificial Sequence; identical to SEQ ID NO: 185693
  derived and/or modified sequence opt5 from hemagglutinin__InfluenzaA__ADD97231

SEQ ID NO: 187385 - RNA, 1701 nt, Artificial Sequence
  derived and/or modified sequence opt5 from hemagglutinin__InfluenzaA__ADD97241
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuaccgacuacgaagaacugcgggagcagcuuuccagcgucucuuccuucgaacgcuuugagauuuuccccaagacaagcucuuggccuaaucacgauuccaacaagggagugaccgccgcuuguccccaugccggcgcgaaaucuuuuuauaagaaucugaucuggcucguuaaaaagggcaacagcuacccuaaacuguccaagagcuauaucaaugacaaggggaaagaagugcuuguccuguggggcauucaccaccccuccacaucugccgaucaacagagccucuaccagaacgcugacgccuacguguucgugggaaccuccagauauagcaagaaauuuaagccugagaucgcuauucggccgaaaguccgcgaucaggaggggagaaugaauuacuauuggacgcugguugaacccggagacaagaucacauucgaggccaccggcaaccugguggugccucgguacgcguuugccauggaacgcaacgcugggucuggaauuaucauuuccgauacacccguccauaauugcaacaccaccugucaaacaccuaaaggcgccaucaauacgagccuccccuuccagaacauccacccgauuaccaucggcaagugcccuaaguaugugaaaucuacaaagcugagacuugcuaccgggcugcggaauguucccagcauucagucccgcggacucuuuggcgccaucgccggguucauugagggaggcuggacagggaugguggacggaugguacggcuaucaucaccagaacgaacaaggcucuggguacgcugcggaccugaaaagcacccagaaugccaucgaugagaucacgaacaaggucaauuccgugauugagaaaaugaacacacaguuuaccgcuguuggaaaggaguucaaucaccuugagaagagaaucgaaaaccugaauaaaaagguggacgauggcuuccucgacauuuggaccuacaacgccgagcugcugguccuccuggaaaaugagcggacacuugauuaucaugacagcaacgugaaaaaccuguacgagaagguccgcucucagcucaaaaauaacgccaaggaaaucgggaauggauguuuugaguucuaucacaagugcgauaacaccuguauggaauccgugaaaaauggcacauacgacuauccuaaguacagcgaggaagcuaaacugaacagagaggagauugaugggguuaaacuugaaucuacgcggaucuaucaaauccuggccauuuacuccaccguggcgagcucccucguccuggugguuucucugggcgcuaucagcuuuuggaugugcuccaauggaucucuccagugccgcauuuguaucuga

SEQ ID NO: 187386 - RNA, 1701 nt, Artificial Sequence; identical to SEQ ID NO: 187376
  derived and/or modified sequence opt5 from hemagglutinin__InfluenzaA__ADD97251

SEQ ID NO: 187387 - RNA, 1701 nt, Artificial Sequence; identical to SEQ ID NO: 185693
  derived and/or modified sequence opt5 from hemagglutinin__InfluenzaA__ADD97261

SEQ ID NO: 187388 - RNA, 1701 nt, Artificial Sequence
  derived and/or modified sequence opt5 from hemagglutinin__InfluenzaA__ADD97271
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguuacaccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacauccccagcauucagucccgcggacucuuuggcgcuaucgccggguucaucgagggaggcuggacagggaugguugacggaugguacggcuaucaucaccagaaugaacaaggcucuggguacgccgcugaucugaaaagcacccagaacgcgauugacgagaucacgaauaaggugaacuccgucauugagaaaaugaauacacaguuuaccgccgugggaaaggaguucaaccaccuugagaagagaaucgaaaaucugaacaaaaagguugaugacggcuuccucgauauuuggaccuacaaugcugagcugcuggugcuccuggaaaacgagcggacacuugacuaucaugauagcaaugucaaaaaccuguacgagaaggugcgcucucagcucaaaaacaaugccaaggaaaucgggaacggauguuuugaguucuaucacaagugcgacaauaccuguauggaauccgucaaaaacggcacauacgauuauccuaaguacagcgaggaagccaaacugaauagagaggagaucgacggggugaaacuugaaucuacgcggauuuaucaaauccuggcuauuuacuccaccguugccagcucccucgugcuggucgugucucugggcgcgaucagcuuuuggaugugcuccaacggaucucuccagugccgcauuuguaucuga

SEQ ID NO: 187389 - RNA, 1701 nt, Artificial Sequence; identical to SEQ ID NO: 187380
  derived and/or modified sequence opt5 from hemagglutinin__InfluenzaA__ADD97281

SEQ ID NO: 187390 - RNA, 1701 nt, Artificial Sequence; identical to SEQ ID NO: 185693
  derived and/or modified sequence opt5 from hemagglutinin__InfluenzaA__ADD97291

SEQ ID NO: 187391 - RNA, 1701 nt, Artificial Sequence
  derived and/or modified sequence opt5 from hemagglutinin__InfluenzaA__ADD97311
augaaggccauccuggugguccuccuguacaccuucgcuacagccaacgcggacacgcuuugcauuggcuaucacgcuaauaacagcaccgauacaguugacaccauccuggagaaaaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccaagagcuauaucaaugacaaggggaaagaaauucuuguucuguggggaauccaccaccccuccaccauugccgaucaacagucucucuaccagaacgcugacgccuacguguucgucggcacaagcagauauuccaagaaauuuaagccugagaucgcuauucggccgaaagugcgcgaucaggaggggagaaugaaguacuauuggacccugguggaacccggagacaaaaucacguucgaggccacaggcaaucuggucguuccucgguacgcguuugccauggaacgcaacgcugggagcggaaucauuaucucugauacccccgugcauaacugcaauacaaccugucaaaccuccaagggcgccauuaacacaagccucccuuuccagaauauccaccccauuacgaucggcaagugcccgaaauaugugaagucuaccaaacugagacuugcuacagggcugcggaacgucccuagcauccagucccgcggacucuuuggcgccauugccggguucaucgagggaggcuggaccgggaugguggacggaugguacggcuaucaucaccagaaugaacaaggcucuggguacgcugcggaccuuaagagcacacagaacgccauugaugagaucaccaauaaaguuaacuccgugauugagaagaugaauacgcaguuuacagcugucggaaaggaguucaaccaccuggagaaaagaaucgaaaaucugaacaagaaaguggacgauggcuuccucgacaucuggaccuacaaugccgagcugcugguucuccuggaaaacgagcggacccuugauuaucaugacagcaaugugaagaaccuguacgagaaaguccgcucucagcucaagaacaaugccaaggaaauugggaacggauguuuugaguucuaucacaaaugcgauaauacauguauggaauccgugaagaacggcaccuacgacuaucccaaauacagcgaggaagcuaagcugaauagagaggagaucgauggggucaaacuugaaucuacacggauuuaucaaauccuggccauuuacuccacgguggcgagcucccucguucugguggucucucugggcgcuaucagcuuuuggaugugcuccaacggaucucuccagugccgcauuuguaucuga

SEQ ID NO: 187392 - RNA, 1701 nt, Artificial Sequence; identical to SEQ ID NO: 187376
  derived and/or modified sequence opt5 from hemagglutinin__InfluenzaA__ADD97321

SEQ ID NO: 187393 - RNA, 1701 nt, Artificial Sequence; identical to SEQ ID NO: 186857
  derived and/or modified sequence opt5 from hemagglutinin__InfluenzaA__ADD97331

SEQ ID NO: 187394 - RNA, 1701 nt, Artificial Sequence
  derived and/or modified sequence opt5 from hemagglutinin__InfluenzaA__ADD97341
augaaggccauccuggugguccuccuguacaccuucgcuacaguuaacgccgacacgcuuugcauuggcuaucacgcgaauaacagcaccgauacaguggacaccgugcuggagaaaaaugucacagugacccauuccguuaaccuccuggaagauaagcacaaugggaaacuuuguaagcugagaggaguggcuccccuccaucugggcaaaugcaacaucgccggguggauucugggaaauccugagugugaaucucucagcacagccuccucuuggagcuacaucgucgagaccuccucuagcgacaacggcacgugcuauccgggggauuuuauugacuacgaagaacugcgggagcagcuuuccagcgugucuuccuucgaacgcuuugagaucuuccccaagaccagcucuuggccuaaucacgauuccaacaagggaguuacagcugccuguccccaugcuggcgccaagagcuuuuauaagaaucugaucuggcucgugaaaaagggcaacucuuacccuaaacuguccaagagcuauauuaaugacaaggggaaagaaguccuugugcuguggggaauccaccaccccuccaccucuacagaucaacagagccucuaccagaacgcggacgccuacguguucgucggcaccuccagauauagcaagaaauuuaagccugagauugcuauccggccgaaaguucgcgaucaggaggggagaaugaauuacuauuggacgcugguggaacccggagacaagauuacauucgaggccaccggcaaccugguggucccucgguacgcuuuugccauggaacgcaacgcggggucuggaaucauuaucuccgauacacccgugcaugacugcaauaccaccugucaaacaccuaaaggcgccaucaacacgagccuccccuuccagaauauucacccgaucaccauuggcaagugcccuaaguauguuaaaucuacaaagcugagacuugcuaccgggcugcggaacauccccagcauucagucccgcggacucuuuggcgccaucgcuggguucaucgagggaggcuggacagggaugguggacggaugguacggcuaucaucaccagaaugaacaaggcucuggguacgccgccgaucugaaaagcacccagaacgcuauugacgagaucacgaauaaggucaacuccgugauugagaaaaugaauacacaguuuaccgcgguuggaaaggaguucaaccaccuugagaagagaaucgaaaaucugaacaaaaagguggaugacggcuuccucgauauuuggaccuacaaugccgagcugcugguccuccuggaaaacgagcggacacuugacuaucaugauagcaaugugaaaaaccuguacgagaagguccgcucucagcucaaaaacaaugcuaaggaaaucgggaacggauguuuugaguucuaucacaagugcgacaauaccuguauggaauccgugaaaaacggcacauacgauuauccuaaguacagcgaggaagccaaacugaauagagaggagaucgacgggguuaaacuugaaucuacgcggauuuaucaaauccuggccauuuacuccaccguggcuagcucccucguccuggugguuucucugggcgccaucagcuuuuggaugugcuccaacggaucucuccagugccgcauuuguaucuga

SEQ ID NO: 187395 - RNA, 1701 nt, Artificial Sequence; identical to SEQ ID NO: 186857
  derived and/or modified sequence opt5 from hemagglutinin__InfluenzaA__ADD97351

SEQ ID NO: 187396 - RNA, 1701 nt, Artificial Sequence; identical to SEQ ID NO: 186857
  derived and/or modified sequence opt5 from hemagglutinin__InfluenzaA__ADD97361

SEQ ID NO: 187397 - RNA, 1701 nt, Artificial Sequence
  derived and/or modified sequence opt5 from hemagglutinin__InfluenzaA__ADD97371
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaccugaaaagcacacagaacgccaucgaugagauuaccaauaaggucaacuccgugaucgaaaagaugaauacgcaguuuacagcuguuggaaaggaguucaaccaccuugaaaagagaauugagaaucugaacaaaaagguggacgauggcuuccucgacaucuggaccuacaaugccgaacugcugguccuccuggagaacgagcggacccuugauuaucaugacagcaaugugaaaaaccuguacgaaaagguccgcucucagcucaaaaacaaugccaaggagauugggaacggauguuuugaguucuaucacaagugcgauaauacauguauggaguccgugaaaaacggcaccuacgacuauccuaaguacagcgaagaggcuaaacugaauagagaggaaaucgaugggguuaaacuugagucuacacggaucuaucaaauucuggccaucuacuccacgguggcgagcucccucguccuggugguuucucugggcgcuauuagcuuuuggaugugcuccaacggaucucuccagugccgcguguguaucuga

SEQ ID NO: 187398 - RNA, 1701 nt, Artificial Sequence; identical to SEQ ID NO: 186857
  derived and/or modified sequence opt5 from hemagglutinin__InfluenzaA__ADD97381

SEQ ID NO: 187399 - RNA, 1701 nt, Artificial Sequence; identical to SEQ ID NO: 185693
  derived and/or modified sequence opt5 from hemagglutinin__InfluenzaA__ADD97391

SEQ ID NO: 187400 - RNA, 1701 nt, Artificial Sequence; identical to SEQ ID NO: 186857
  derived and/or modified sequence opt5 from hemagglutinin__InfluenzaA__ADD97411

SEQ ID NO: 187401 - RNA, 1701 nt, Artificial Sequence; identical to SEQ ID NO: 186857
  derived and/or modified sequence opt5 from hemagglutinin__InfluenzaA__ADD97421

SEQ ID NO: 187402 - RNA, 1701 nt, Artificial Sequence; identical to SEQ ID NO: 185693
  derived and/or modified sequence opt5 from hemagglutinin__InfluenzaA__ADD97431

SEQ ID NO: 187403 - RNA, 1701 nt, Artificial Sequence
  derived and/or modified sequence opt5 from hemagglutinin__InfluenzaA__ADD97441
augaaggccauccuggugguccuccuguacaccuucgcuacagccaacgcggacacgcuuugcauuggcuaucacgcuaauaacagcaccgauacaguugacaccauccuggagaagaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccaagagcuauaucaaugacaaggggaaagaaauucuuguucuguggggaauccaccaccccuccaccucugccgaucaacagagccucuaccagaacgcugacgccuacguguucgucggcacauccagauauagcaagaaauuuaagccugagauugcuauccggccgaaagugcgcgaucaggaggggagaaugaauuacuauuggacccugguggaacccggagacaagauuacguucgaggccacaggcaaccuggucguuccucgguacgcguuugccauggaacgcaacgcugggucuggaaucaucauuuccgauacccccgugcaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguccccagcauccagucccgcggacucuuuggcgccaucgccggguucauugagggaggcuggaccgggaugguggacggaugguacggcuaucaucaccagaaugaacaaggcucuggguacgcugcggaucugaaaagcacacagaacgccaucgacgagauuaccaauaagguuaacuccgugaucgagaaaaugaauacgcaguuuacagcugucggaaaggaguucaaccaccuugagaagagaauugaaaaucugaacaaaaagguggaugacggcuuccucgauaucuggaccuacaaugccgagcugcugguucuccuggaaaacgagcggacccuugacuaucaugauagcaaugugaaaaaccuguacgagaagguccgcucucagcucaaaaacaaugccaaggaaaucgggaacggauguuuugaguucuaucacaagugcgacaauacauguauggaauccgugaaaaacggcaccuacgauuauccuaaguacagcgaggaagcuaaacugaauagagaggagauugacggggucaaacuugaaucuacacggaucuaucaaauucuggccaucuacuccacgguggcgagcucccucguucugguggucucucugggcgcuauuagcuuuuggaugugcuccaacggaucucuccagugccgcaucuguauuuga

SEQ ID NO: 187404 - RNA, 1701 nt, Artificial Sequence; identical to SEQ ID NO: 187397
  derived and/or modified sequence opt5 from hemagglutinin__InfluenzaA__ADD97451

SEQ ID NO: 187405 - RNA, 1701 nt, Artificial Sequence; identical to SEQ ID NO: 187397
  derived and/or modified sequence opt5 from hemagglutinin__InfluenzaA__ADD97461

SEQ ID NO: 187406 - RNA, 1701 nt, Artificial Sequence; identical to SEQ ID NO: 187245
  derived and/or modified sequence opt5 from hemagglutinin__InfluenzaA__ADD97471

SEQ ID NO: 187407 - RNA, 1701 nt, Artificial Sequence; identical to SEQ ID NO: 187245
  derived and/or modified sequence opt5 from hemagglutinin__InfluenzaA__ADD97481

SEQ ID NO: 187408 - RNA, 1701 nt, Artificial Sequence
  derived and/or modified sequence opt5 from hemagglutinin__InfluenzaA__ADD97491
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggagaggcuccccuccaucugggcaaaugcaacaucgccggguggauucugggaaauccugaaugugagucucucagcacagccuccucuuggagcuacaucguugaaaccuccucuagcgacaacggcacgugcuauccgggggauuuuauuaauuacgaggagcugcgggaacagcuuuccagcgugucuuccuucgagcgcuuugaaaucuuccccaagaccagcucuuggccuaaccacgacuccaauaagggagucacagccgcuuguccccaugccggcgcgaaauccuuuuauaagaaccugaucuggcucgugaaaaagggcaauucuuacccuaaacuguccaagagcuauauuaacgauaaggggaaagagguucuugugcuguggggaauccaccaccccuccaccucugccgaccaacagagccucuaccagaaugcugaugccuacgucuucgugggcacauccagauauagcaagaaauuuaagccugagauugcuauccggccgaaagugcgcgaccaggaagggagaaugaacuacuauuggacccuggucgagcccggagauaagauuacguucgaagccacaggcaaccugguugugccucgguacgcguuugccauggagcgcaaugcugggucuggaaucauuaucuccgacacccccgugcaugauugcaacacaaccugucaaaccccuaaaggcgccaucaauacaagccuccccuuccagaacauucacccgaucacgauuggcaagugcccuaaguaugucaaaucuaccaagcugagacuugcuacagggcugcggaaugugcccagcauccagucccgcggacucuuuggcgccauugccggguucaucgaaggaggcuggaccgggaugguugacggaugguacggcuaucaucaccagaacgagcaaggcucuggguacgcugcggaccugaaaagcacacagaaugccaucgauaagauuaccaacaaagugaauagcgucaucgagaagaugaacacgcaguuuacagcugugggaaaggaauuuaaucaccuugagaaaagaauugaaaaccugaauaagaaaguugacgauggcuuccucgacaucuggaccuacaacgccgagcugcuggugcuccuggaaaaugagcggacccuugauuaucaugacagcaacgucaagaaccuguacgagaaagugcgcucucagcucaagaauaacgccaaggaaauugggaauggauguuucgaguucuaucacaaaugcgauaacacauguauggaauccgucaagaauggcaccuacgacuauccuaaauacagcgaggaagcuaagcugaacagagaggagaucgauggggugaaacuugaaucuacacggaucuaucaaauucuggccaucuacuccacgguugcgagcucccucgugcuggucgugucucugggcgcuauuagcuuuuggaugugcuccaauggaucucuccagugccgcaucuguauuuga

SEQ ID NO: 187409 - RNA, 1701 nt, Artificial Sequence; identical to SEQ ID NO: 187408
  derived and/or modified sequence opt5 from hemagglutinin__InfluenzaA__ADD97501

SEQ ID NO: 187410 - RNA, 1701 nt, Artificial Sequence; identical to SEQ ID NO: 186046
  derived and/or modified sequence opt5 from hemagglutinin__InfluenzaA__ADD97511

SEQ ID NO: 187411 - RNA, 1701 nt, Artificial Sequence
  derived and/or modified sequence opt5 from hemagglutinin__InfluenzaA__ADD97531
augaaggccauccuggugguccuccuguacaccuucgcuacagccaacgcggacacgcuuugcauuggcuaucacgcuaauaacagcaccgauacaguugacaccauccuggagaaaaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccaagagcuauaucaaugacaaggggaaagaaauucuuguucuguggggaauccaccaccccuccaccauugccgaucaacagucucucuaccagaacgcugacgccuacguguucgucggcacaagcagauauuccaagaaauuuaagccugagaucgcuauucggccgaaagugcgcgaucaggaggggagaaugaaguacuauuggacccugguggaacccggagacaaaaucacguucgaggccacaggcaaucuggucguuccucgguacgcguuugccauggaacgcaacgcugggagcggaaucauuaucucugauacccccgugcauaacugcaauacaaccugucaaaccccuaagggcgccauuaacacaucccuccccuuccagaauauccacccgauuacgaucggcaagugcccuaaauaugucaagagcaccaaacugagacuugcuacagggcugcggaacgugcccucuauccagagccgcggacucuuuggcgccauugccggguucaucgagggaggcuggaccgggaugguggacggaugguacggcuaucaucaccagaaugaacaaggcuccggguacgcugcggaccugaagucuacacagaacgccauugaugagaucaccaauaaaguuaacagcgugauugagaagaugaauacgcaguuuacagcugucggaaaggaguucaaccaccuugagaaaagaaucgaaaaucugaacaagaaaguggacgauggcuuccucgacaucuggaccuacaaugccgagcugcugguucuccuggaaaacgagcggacccuugauuaucaugacuccaaugugaagaaccuguacgagaaaguccgcagccagcucaagaacaaugccaaggaaauugggaacggauguuuugaguucuaucacaaaugcgauaauacauguauggaaucugugaagaacggcaccuacgacuauccuaaauacuccgaggaagcuaagcugaauagagaggagaucgauggggucaaacuugaaagcacacggauuuaucaaauccuggccauuuacucuacgguggcguccagccucguucugguggucucccugggcgcuaucucuuuuuggaugugcagcaacggaucccuccagugccgcauuuguaucuga

SEQ ID NO: 187412 - RNA, 1701 nt, Artificial Sequence
  derived and/or modified sequence opt5 from hemagglutinin__InfluenzaA__ADD97541
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccauaccggcgccaagagcuuuuauaagaaucugaucuggcucguuaaaaagggcaacucuuacccuaaacuguccaagagcuauauuaaugacaaggggaaagaagugcuuguccuguggggaauccaccaccccuccacaucuaccgaucaacagagccucuaccagaacgcggacgcccauguguucgugggcacguccagauacagcaagaaauuuaagccugagauugcuauccggccgaaaguccgcgaucaggaggggagaaugaauuauuacuggacacugguugaacccggagacaagauuaccuucgaggccacaggcaaccugguggugccucgguaugcuuuugccauggaacgcaacgcggggucuggaaucauuaucuccgauacccccguccacgacugcaauaccacaugucaaacgccuaaaggcgccaucaacaccagccuccccuuccagaauauucauccgaucacaauuggcaagugcccuaaguacgugaaaucuaccaagcugagacuugcuacagggcugcggaacauccccagcauucagucccgcggacucuuuggcgccaucgcuggguucaucgagggaggcuggaccgggaugguugacggaugguauggcuaccaccaccagaaugaacaaggcucuggguaugccgccgaucugaaaagcacgcagaacgcuauugacgagaucacaaauaaggugaacuccgucauugagaaaaugaauacccaguuuaccgcggugggaaaggaguucaaccaucuugagaagagaaucgaaaaucugaacaaaaagguugaugacggcuuccucgauauuuggacauacaaugccgagcugcuggugcuccuggaaaacgagcggacccuugacuaccacgauagcaaugucaaaaaccuguaugagaaggugcgcucucagcucaaaaacaaugcuaaggaaaucgggaacggauguuuugaguucuaccauaagugcgacaauacauguauggaauccgucaaaaacggcacguaugauuacccuaaguauagcgaggaagccaaacugaauagagaggagaucgacggggugaaacuugaaucuacccggauuuaccaaauccuggccauuuauuccacaguugcuagcucccucgugcuggucgugucucugggcgccaucagcuuuuggaugugcuccaacggaucucuccagugccgcauuuguaucuga

SEQ ID NO: 187413 - RNA, 1701 nt, Artificial Sequence; identical to SEQ ID NO: 187245
  derived and/or modified sequence opt5 from hemagglutinin__InfluenzaA__ADD97551

SEQ ID NO: 187414 - RNA, 1701 nt, Artificial Sequence; identical to SEQ ID NO: 186857
  derived and/or modified sequence opt5 from hemagglutinin__InfluenzaA__ADD97561

SEQ ID NO: 187415 - RNA, 1701 nt, Artificial Sequence
  derived and/or modified sequence opt5 from hemagglutinin__InfluenzaA__ADD97571
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucucuguucgaacgcuuugagaucuuccccaagaccuccagcuggccuaaccacgacucuaauaagggagugacagccgcuuguccccaugccggcgcgaaauccuuuuauaagaaccucaucuggcugguuaaaaagggcaauagcuacccuaaacuuucuaaguccuauauuaacgauaaggggaaagaagugcugguccucuggggaauccaccaccccagcaccuccgccgaccaacagucucuguaccagaaugcugaugccuacguguucgugggcacaagcagauauuccaagaaauuuaagccugagauugcuauccggccgaaaguccgcgaccaggaggggagaaugaacuacuauuggacccugguugaacccggagauaagauuacguucgaggccacaggcaaccucguggugccucgguacgcguuugccauggaacgcaaugcugggagcggaaucauuaucucugacacccccguccaugauugcaacacaaccugucaaaccccuaaaggcgccaucaauacaucccugcccuuccagaacauucacccgaucacgauuggcaagugcccuaaguaugugaaaagcaccaaacuuagacuggcuacagggcuccggaauguucccucuauccagagccgcggacuguuuggcgccauugccggguucaucgagggaggcuggaccgggaugguggacggaugguacggcuaucaucaccagaacgaacaaggcuccggguacgcugcggaccuuaaaucuacacagaaugccaucgauaagauuaccaacaaagucaauagcgugaucgagaagaugaacacgcaguuuacagcuguuggaaaggaguucaaucaccuggaaaagagaauugagaaccucaauaagaaaguggacgauggcuuccuggacaucuggaccuacaacgccgaacugcucguccugcuugagaaugaacggacccuggauuaucaugacuccaacgugaagaaccucuacgagaaaguccgcagccagcugaagaauaacgccaaggagauugggaauggauguuuugaguucuaucacaaaugcgauaacacauguauggagucugugaagaauggcaccuacgacuauccuaaauacuccgaagaggcuaaacuuaacagagaagagaucgaugggguuaagcuggagagcacacggaucuaucaaauucucgccaucuacucuacgguggcguccagccugguccuggugguuucccucggcgcuauuucuuuuuggaugugcagcaauggaucccugcagugccgcaucuguauuuga

SEQ ID NO: 187416 - RNA, 1701 nt, Artificial Sequence; identical to SEQ ID NO: 185693
  derived and/or modified sequence opt5 from hemagglutinin__InfluenzaA__ADD97581

SEQ ID NO: 187417 - RNA, 1701 nt, Artificial Sequence; identical to SEQ ID NO: 185693
  derived and/or modified sequence opt5 from hemagglutinin__InfluenzaA__ADD97591

SEQ ID NO: 187418 - RNA, 1701 nt, Artificial Sequence; identical to SEQ ID NO: 185693
  derived and/or modified sequence opt5 from hemagglutinin__InfluenzaA__ADD97688

SEQ ID NO: 187419 - RNA, 1701 nt, Artificial Sequence; identical to SEQ ID NO: 187245
  derived and/or modified sequence opt5 from hemagglutinin__InfluenzaA__ADD97698

SEQ ID NO: 187420 - RNA, 1701 nt, Artificial Sequence; identical to SEQ ID NO: 187245
  derived and/or modified sequence opt5 from hemagglutinin__InfluenzaA__ADD97888

SEQ ID NO: 187421 - RNA, 1701 nt, Artificial Sequence
  derived and/or modified sequence opt5 from hemagglutinin__InfluenzaA__ADD97898
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucuacagaucaacagagccucuaccagaacgccgacgcuuacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacauccccagcauucagucccgcggacucuuuggcgcuaucgccggguucaucgagggaggcuggacagggaugguugacggaugguacggcuaucaucaccagaaugaacaaggcucuggguacgccgcugaucugaaaagcacccagaacgcgauugacgagaucacgaauaaggugaacuccgucauugagaaaaugaauacacaguuuaccgccgugggaaaggaguucaaccaccuugagaagagaaucgaaaaucugaacaaaaagguugaugacggcuuccucgauauuuggaccuacaaugcugagcugcuggugcuccuggaaaacgagcggacacuugacuaucaugauagcaaugucaaaaaccuguacgagaaggugcgcucucagcucaaaaacaaugccaaggaaaucgggaacggauguuuugaguucuaucacaagugcgacaauaccuguauggaauccgucaaaaacggcacauacgauuauccuaaguacagcgaggaagccaaacugaauagagaggagaucgacggggugaaacuugaaucuacgcggauuuaucaaauccuggcuauuuacuccaccguugccagcucccucgugcuggucgugucucugggcgcgaucagcuuuuggaugugcuccaacggaucucuccagugccgcauuuguaucuga

SEQ ID NO: 187422 - RNA, 1701 nt, Artificial Sequence; identical to SEQ ID NO: 186046
  derived and/or modified sequence opt5 from hemagglutinin__InfluenzaA__ADD97908

SEQ ID NO: 187423 - RNA, 1701 nt, Artificial Sequence; identical to SEQ ID NO: 186857
  derived and/or modified sequence opt5 from hemagglutinin__InfluenzaA__ADD97918

SEQ ID NO: 187424 - RNA, 1701 nt, Artificial Sequence
  derived and/or modified sequence opt5 from hemagglutinin__InfluenzaA__ADD97928
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcggcaacgggacgugcuauccgggagacuuuauugauuacgaagaacugcgggagcagcuuuccagcgucucuuccuucgaacgcuuugagaucuuccccaagaccagcucuuggccuaaucacgacuccaacaagggcgugacagccgcuuguccccaugccggcgcgaaaucuuuuuauaagaaucugaucuggcucguuaaaaaggggaacagcuacccuaaacuguccaagagcuauauuaaugauaagggaaaagaagugcuuguccuguggggcauccaccaccccuccaccucugccgaccaacagagccucuaccagaacgcugaugccuacguguucguggggacauccagauauagcaagaaauuuaagccugagauugcuauccggccgaaaguccgcgaccaggagggaagaaugaauuacuauuggacccugguugaacccggcgauaagauuacguucgaggccacagggaaccugguggugccucgguacgcguuugccauggaacgcaacgcuggaucuggcaucauuaucuccgacacccccguccaugauugcaauacaaccugucaaaccccuaaaggcgccaucaacacaagccuccccuuccagaauauucacccgaucacgauugggaagugcccuaaguaugugaaaucuaccaagcugagacuugcuacaggacugcggaacguucccagcauccagucccgcggccucuuuggggccauugccggauucaucgagggcggguggaccggaaugguggacggcugguacggcuaucaucaccagaaugaacaagggucuggauacgcugcggaccugaaaagcacacagaacgccaucgauggcauuaccaauaaggucaacuccgugaucgagaaaaugaauacgcaguuuacagcuguugggaaggaguucaaccaccuugaaaagagaauugagaaucugaacaaaaagguggacgauggauuccucgacaucuggaccuacaaugccgaacugcugguccuccuggagaacgaacggacccuugauuaucaugacagcaaugugaaaaaccuguacgagaagguccgcucucagcucaaaaacaaugccaaggagauuggcaacggguguuuugaguuccaccauaagugcgauaauacauguauggaguccgugaaaaacggcaccuaugacuacccuaaguauagcgaagaggcuaaacugaauagagaagagaucgauggaguuaaacuugagucuacacggaucuaccaaauucuggccaucuauuccacgguggcgagcucccucguccuggugguuucucugggcgcuauuagcuuuuggaugugcuccaacgggucucuccagugccgcaucuguauuuga

SEQ ID NO: 187425 - RNA, 1701 nt, Artificial Sequence
  derived and/or modified sequence opt5 from hemagglutinin__InfluenzaA__ADD97938
augaaggccauccuggugguccuccuguacaccuucgcuacagccaacgcggacacgcuuugcauuggcuaucacgcuaauaacagcaccgauacaguugacaccauccuggagaaaaaugugacagugacccauuccgucaaccuccuggaagauaagcacaaugggaaacuuuguaagcugagaggaguggcgccccuccaucugggcaaaugcaacauugccggguggauccugggaaauccugagugugaaucucucagcacagcuuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaugaccagcucuuggccuaaucacgauuccaacaagggagucacagccgcuuguccccaugccggcgccaagagcuuuuauaaaaaucugauuuggcucgugaagaaaggcaacucuuacccuaagcuguccaaaagcuauaucaaugacaaggggaaggaaauucuuguucuguggggaauccaccaccccuccaccucugccgaucaacagagccucuaccagaacgcugacgccuacguguucgucggcacauccagauauagcaaaaaguuuaaaccugagauugcuauccggccgaaggugcgcgaucaggaggggagaaugaauuacuauuggacccugguggaacccggagacaaaauuacguucgaggccacaggcaaccuggucguuccucgguacgcguuugccauggaacgcaacgcugggucuggaaucaucauuuccgauacccccgugcaugacugcaauacaaccugucaaaccccuaagggcgccaucaacacaagccuccccuuccagaauauucacccgaucacgauuggcaaaugcccuaaguaugugaagucuaccaaacugagacuugcuacagggcugcggaacguccccagcauccagucccgcggacucuuuggcgccaucgccggguucauugagggaggcuggaccgggaugguggacggaugguacggcuaucaucaccagaaugaacaaggcucuggguacgcugcggaucuuaagagcacacagaacgccaucgacgagauuaccaauaaaguuaacuccgugaucgagaagaugaauacgcaguuuacagcugucggaaaagaguucaaccaccuggagaagagaauugaaaaucugaacaagaaaguggaugacggcuuccucgauaucuggaccuacaaugccgagcugcugguucuccuggaaaacgagcggacccuugacuaucaugauagcaaugugaagaaccuguacgagaaaguccgcucucagcucaagaacaaugccaaagaaaucgggaacggauguuuugaguucuaucacaagugcgacaauacauguauggaauccgugaagaacggcaccuacgauuauccuaaauacagcgaggaagcuaagcugaauagagaggagauugacggggucaaacuugaaucuacacggaucuaucaaauucuggccaucuacuccacgguggcgagcucccucguucugguggucucucugggcgcuauuagcuuuuggaugugcuccaacggaucucuccagugccgcaucuguauuuga

SEQ ID NO: 187426 - RNA, 1701 nt, Artificial Sequence
  derived and/or modified sequence opt5 from hemagglutinin__InfluenzaA__ADD97948
augaaggccauccugcucgugcugcuuuacaccuucgcuacagccaacgcggacacgcugugcauuggcuaucacgcuaauaacagcaccgauacagucgacaccguucucgagaaaaaugugacagugacccauuccgucaaccugcuugaagauaagcacaaugggaaacuguguaagcucagaggaguggcuccccugcaucugggcaaaugcaacaucgccggguggauucucggaaauccugagugugaaucucugagcacagccuccucuuggagcuacaucguugagaccuccucuagcgacaacggcacgugcuauccgggggauuuuauugacuacgaagaacuucgggagcagcuguccagcgugucuuccuucgaacgcuuugagauguuccccaagaccagcucuuggccuaaucacgauuccaacaagggagucacagccgcuuguccccaugccggcgcgaaaucuuuuuauaagaaucucaucuggcuggugaaaaagggcaacagcuacccuaaacuuuccaagagcuauaucaaugacaaggggaaagaaguucuggugcucuggggcauucaccaccccuccaccucugccgaucaacagagccuguaccagaacgcugacgccuacgucuucgugggaacauccagauauagcaagaaauuuaagccugagaucgcuauucggccgaaagugcgcgaucaggaggggagaaugaauuacuauuggacccuggucgaacccggagacaagaucacguucgaggccacaggcaaccucguugugccucgguacgcguuugccauggaacgcaacgcugggucuggaauuaucauuuccgauacccccgugcaugacugcaauacaaccugucaaaccccuaaaggcgccaucaacacaagccugcccuuccagaauauccacccgauuacgaucggcaagugcccuaaguaugucaaaucuaccaaacuuagacuggcuacagggcuccggaacgugcccagcauucagucccgcggacuguuuggcgccaucgccggguucauugagggaggcuggaccgggaugguugacggaugguacggcuaucaucaccagaaugaacaaggcucuggguacgcugcggaucuuaagagcacacagaacgccaucgacgagaucaccaauaaggugaacuccgucauugagaaaaugaauacgcaguuuacagcugugggaaaggaguucaaccaccuggagaagagaaucgaaaaucucaacaaaaagguugaugacggcuuccuggauauuuggaccuacaaugccgagcugcucgugcugcuugaaaacgagcggacccuggacuaucaugauagcaaugucaaaaaccucuacgagaaggugcgcucucagcugaaaaacaaugccaaggaaaucgggaacggauguuuugaguucuaucacaagugcgacaauacauguauggaauccgucaaaaacggcaccuacgauuauccuaaguacagcgaggaagcuaaacuuaauagagaggagauugacggggugaagcuggaaucuacacggaucuaucaaauccucgccauuuacuccacgguugcgagcucccuggugcuggucgugucucucggcgcuaucagcuuuuggaugugcuccaacggaucucugcagugccgcauuuguaucuga

SEQ ID NO: 187427 - RNA, 1701 nt, Artificial Sequence
  derived and/or modified sequence opt5 from hemagglutinin__InfluenzaA__ADD97958
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuucagccugagauugcuauccggccgaagguccgcgaucaagaggggagaaugaauuacuauuggacccugcuggaacccggagacaaaauuacguucgaggccacaggcaaccucguugugccucgguacgcguuugccauggaacgcaacgcugggucuggaaucauuaucuccgauacccccgugcaugacugcaauacaaccugucagaccccuaagggcgccaucaacacaagccugcccuuccagaauauucacccgaucacgauuggcaaaugcccuaaguaugucaagucuaccaaacuuagacuggcuacagggcuccggaacgugcccagcauccagucccgcggacuguuuggcgccauugccggguucaucgagggaggcuggaccgggaugguugacggaugguacggcuaucaucaccaaaaugaacagggcucuggguacgcugcggaucuuaagagcacacagaacgccaucgacgagauuaccaauaaagugaacuccgucaucgagaagaugaauacgcaguuuacagcugugggaaaagaguucaaccaccuggagaagagaauugaaaaucucaacaagaaaguugaugacggcuuccuggauaucuggaccuacaaugccgagcugcucgugcugcuugaaaacgagcggacccuggacuaucaugauagcaaugucaagaaccucuacgagaaagugcgcucucaacugaagaacaaugccaaagaaauugggaacggauguuuugaguucuaucacaagugcgacaauacauguauggaauccgucaagaacggcaccuacgauuauccuaaauacagcgaggaagcuaaacuuaauagagaggagaucgacggggugaagcuggaaucuacacggaucuaucagauucucgccaucuacuccacgguugcgagcucccuggugcuggucgugucucucggcgcuauuagcuuuuggaugugcuccaacggaucucugcagugccgcaucuguauuuga

SEQ ID NO: 187428 - RNA, 1701 nt, Artificial Sequence; identical to SEQ ID NO: 185693
  derived and/or modified sequence opt5 from hemagglutinin__InfluenzaA__ADD97968

SEQ ID NO: 187429 - RNA, 1701 nt, Artificial Sequence; identical to SEQ ID NO: 187421
  derived and/or modified sequence opt5 from hemagglutinin__InfluenzaA__ADD97978

SEQ ID NO: 187430 - RNA, 1701 nt, Artificial Sequence; identical to SEQ ID NO: 187375
  derived and/or modified sequence opt5 from hemagglutinin__InfluenzaA__ADD97988

SEQ ID NO: 187431 - RNA, 1701 nt, Artificial Sequence
  derived and/or modified sequence opt5 from hemagglutinin__InfluenzaA__ADD97998
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaaggccagcucuuggccuaaucacgauuccaacaagggagugaccgcugccuguccccaugcgggcgccaagagcuuuuauaagaaucugaucuggcucguuaaaaagggcaacucuuacccuaaacuguccaagagcuauauuaaugacaaggggaaagaagugcuuguccuguggggaauccaccaccccuccacaucugcugaucaacagagccucuaccagaacgccgacgcuuacguguucgugggcaccuccagauauagcaagaaauuuaagccugagauugccauccggccgaaaguccgcgaucaggaggggagaaugaauuacuauuggacacugguugaacccggagacaagauuaccuucgaggcgacgggcaaccugguggugccucgguacgccuuugaaauggagcgcaacgcugggucuggaaucauuaucuccgauacacccguccaugacugcaauaccacaugucaaaccccuaaaggcgccaucaacaccagccuccccuuccagaauauucacccgaucacaauuggcaagugcccuaaguaugugaaaucuacgaagcugagacuugcuaccgggcugcggaacguucccagcauccagucccgcggacucuuuggcgccauugccggguucaucgaaggaggcuggacagggaugguggacggaugguacggcuaucaucaccagaaugagcaaggcucuggguacgcugcggaucugaaaagcacccagaacgccaucgacgagauuacaaauaaggucaacuccgugaucgagaaaaugaauacccaguuuacggcuguuggaaaggaguucaaccaccuugaaaagagaauugagaaucugaacaaaaagguggaugacggcuuccucgauaucuggacauacaaugccgaacugcugguccuccuggagaacgagcggacccuugacuaucaugauagcaaugugaaaaaccuguacgaaaagguccgcucucagcucaaaaacaaugccaaggagauugggaacggauguuuugaguucuaucacaagugcgacaauaccuguauggaauccgugaaaaacggcacauacgauuauccuaaguacagcgaagaggcuaaacugaauagagaggaaaucgacgggguuaaacuugagucuacccggaucuaucaaauucuggccaucuacuccacaguggcgagcucccucguccuggugguuucucugggcgcuauuagcuuuuggaugugcuccaacggaucucuccagugccgcaucuguauuuga

SEQ ID NO: 187432 - RNA, 1701 nt, Artificial Sequence; identical to SEQ ID NO: 187245
  derived and/or modified sequence opt5 from hemagglutinin__InfluenzaA__ADD98008

SEQ ID NO: 187433 - RNA, 1701 nt, Artificial Sequence
  derived and/or modified sequence opt5 from hemagglutinin__InfluenzaA__ADD98018
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaaauccuugugcuguggggcauucaccaccccuccaccucugccgaucaacagagccucuaccagaacgcugacgccuacgucuucgugggaacauccagauauagcaagaaauuuaagccugagaucgcuacccggccgaaagugcgcgagcaggaagggagaaugaauuacuauuggacgcuggucgagcccggagauaagauuacauucgaagccaccggcaaccugguugugccucgguacgcguuugccauggagcgcaacgcugggucuggaaucauuaucuccgacacacccgugcaugauugcaauaccaccugucaaacaccuaaaggcgccaucaacacgagccuccccuuccagaauauucacucuaucaccauuggcaagugcccgaaguaugucaaaagcacaaagcugagacuugcuaccgggcugcggaacgugccuuccauccagucucgcggacucuuuggcgccauugccggguucaucgaaggaggcuggacagggaugguugacggaugguacggcuaucaucaccagaaugagcaaggcagcggguacgcugcggaccugaaauccacccagaacgccaucgaugagauuacgaauaaggugaacagcgucaucgaaaagaugaauacacaguuuaccgcugugggaaaggaguucaaccaccuugaaaagagaauugagaaucugaacaaaaagguugacgauggcuuccucgacaucuggaccuacaaugccgaacugcuggugcuccuggagaacgagcggacacuugauuaucaugacucuaaugucaaaaaccuguacgaaaaggugcgcucccagcucaaaaacaaugccaaggagauugggaacggauguuuugaguucuaucacaagugcgauaauaccuguauggagagcgucaaaaacggcacauacgacuaucccaaguacucugaagaggcuaaacugaauagagaggaaaucgauggggugaaacuugaguccacgcggaucuaucaaauucuggccaucuacagcaccguugcguccucucucgugcuggucgugagccugggcgcuauuuccuuuuggaugugcucuaacggaagccuccagugccgcaucuguauuuga

SEQ ID NO: 187434 - RNA, 1701 nt, Artificial Sequence; identical to SEQ ID NO: 187397
  derived and/or modified sequence opt5 from hemagglutinin__InfluenzaA__ADD98028

SEQ ID NO: 187435 - RNA, 1701 nt, Artificial Sequence
  derived and/or modified sequence opt5 from hemagglutinin__InfluenzaA__ADD98038
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucuaucagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaaggccagcucuuggccuaaucacgauuccaacaagggagugaccgcugccuguccccaugcgggcgccaagagcuuuuauaaaaaucuuauuuggcugguuaaaaagggcaacucuuacccuaaacucuccaagagcuauaucaaugacaaggggaaagaagugcugguccuuuggggcauucaccaccccuccacaucugcugaucaacagagccuguaccagaacgccgacgcuuacguguucgugggaaccuccagauauagcaagaaauuuaagccugagaucgccauucggccgaaaguccgcgaucaggaggggagaaugaauuacuauuggacacucguugaacccggagacaagaucaccuucgaggcgacgggcaaccugguggugccucgguacgccuuugaaauggagcgcaacgcugggucuggaauuaucaucuccgauacacccguccaugacugcaauaccacaugucaaaccccuaaaggcgccauuaacaccagccugcccuuccagaauauccacccgauuacaaucggcaagugcccuaaguaugugaaaucuacgaagcucagacuggcuaccgggcuucggaacguucccagcauucagucccgcggacuguuuggcgccaucgccggguucaucgaaggaggcuggacagggaugguggacggaugguacggcuaucaucaccagaaugagcaaggcucuggguacgcugcggaucucaaaagcacccagaacgccauugacgagaucacaaauaaggucaacuccgugauugagaaaaugaauacccaguuuacggcuguuggaaaggaguucaaccaccuggaaaagagaaucgagaaucuuaacaaaaagguggaugacggcuuccuggauauuuggacauacaaugccgaacuccugguccugcucgagaacgagcggacccuggacuaucaugauagcaaugugaaaaaccuuuacgaaaagguccgcucucagcugaaaaacaaugccaaggagaucgggaacggauguuuugaguucuaucacaagugcgacaauaccuguauggaauccgugaaaaacggcacauacgauuauccuaaguacagcgaagaggcuaaacucaauagagaggaaaucgacgggguuaagcuggagucuacccggauuuaucaaauccuugccauuuacuccacaguggcgagcucccugguccucgugguuucucugggcgcuaucagcuuuuggaugugcuccaacggaucucugcagugccgcauuuguaucuga

SEQ ID NO: 187436 - RNA, 1701 nt, Artificial Sequence; identical to SEQ ID NO: 187421
  derived and/or modified sequence opt5 from hemagglutinin__InfluenzaA__ADD98048

SEQ ID NO: 187437 - RNA, 1701 nt, Artificial Sequence; identical to SEQ ID NO: 185693
  derived and/or modified sequence opt5 from hemagglutinin__InfluenzaA__ADD98058

SEQ ID NO: 187438 - RNA, 1701 nt, Artificial Sequence; identical to SEQ ID NO: 185693
  derived and/or modified sequence opt5 from hemagglutinin__InfluenzaA__ADD98068

SEQ ID NO: 187439 - RNA, 1701 nt, Artificial Sequence; identical to SEQ ID NO: 185935
  derived and/or modified sequence opt5 from hemagglutinin__InfluenzaA__ADD98078

SEQ ID NO: 187440 - RNA, 1701 nt, Artificial Sequence
  derived and/or modified sequence opt5 from hemagglutinin__InfluenzaA__ADD98098
augaaggccauccuggugguccuccuguacaccuucgcuacagccaacgcggacacgcuuugcauuggcuaucacgcuaauaacagcaccgauacaguugacaccauccuggagaagaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccaagagcuauaucaaugacaaggggaaagaaguucuugugcuguggggcauucaccaccccuccaccucuagcgaucaacagucccucuaccagaacgccgacgcuuacgucuucgugggaacaagcagauauucuaagaaauuuaagccugagaucgccauucggccgaaagugcgcgaucaggaggggagaaugaauuacuauuggacccuggucgaacccggagacaagaucacguucgaggcuacaggcaaccugguugugccucgguacgccuuugcgguggaacgcaacgccggguccggaauuaucaucagcgauacccccguccaugacugcaauacaaccugucaaaccccuaaaggcgcuauuaacacaucucuccccuuccagaauauccacccgauuacgaucggcaagugcccuaaguaugugaaaagcaccaagcugagacuugccacagggcugcggaacguucccuccauucagucucgcggacucuuuggcgcuaucgccggguucaucgagggaggcuggaccgggaugguggacggaugguacggcuaucaucaccagaaugaacaaggcagcggguacgccgcugaucugaaauccacacagaacgcgauugacgagaucaccaauaaggucaacagcgugauugagaaaaugaauacgcaguuuacagccguuggaaaggaguucaaccaccuugagaagagaaucgaaaaucugaacaaaaagguggaugacggcuuccucgauauuuggaccuacaaugcugagcugcugguccuccuggaaaacgagcggacccuugacuaucaugauucuaaugugaaaaaccuguacgagaagguccgcucccagcucaaaaacaaugccaaggaaaucgggaacggauguuuugaguucuaucacaagugcgacaauacauguauggaaagcgugaaaaacggcaccuacgauuauccuaaguacucugaggaagccaaacugaauagagaggagaucgacgggguuaaacuugaauccacacggauuuaucaaauccuggcuauuuacagcacgguggccuccucucucguccuggugguuagccugggcgcgaucuccuuuuggaugugcucuaacggaagccuccagugccgcauuuguaucuga

SEQ ID NO: 187441 - RNA, 1701 nt, Artificial Sequence; identical to SEQ ID NO: 187408
  derived and/or modified sequence opt5 from hemagglutinin__InfluenzaA__ADD98118

SEQ ID NO: 187442 - RNA, 1701 nt, Artificial Sequence; identical to SEQ ID NO: 187408
  derived and/or modified sequence opt5 from hemagglutinin__InfluenzaA__ADD98128

SEQ ID NO: 187443 - RNA, 1701 nt, Artificial Sequence
  derived and/or modified sequence opt5 from hemagglutinin__InfluenzaA__ADD98138
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucuacagaccaacagagccucuaccagaaugccgaugcuuacguguucgugggcaccuccagauauagcaagaaauuuaagccugagauugccauccggccgaaaguccgcgaccaggaggggagaaugaacuacuauuggacgcugguugaacccggagauaagauuacauucgaggcuaccggcaaccugguggugccucgguacgccuuugcgauggaacgcaauacagggucuggaaucauuaucuccgacacccccguccaugauugcaacaccacaugucaaacgccuaauggcgccaucaacaccagccuccccuuccagaauauucacccgaucacaauuggcaaaugcccuaaguaugugaagucuaccaaacugagacuugcuacagggcugcggaacguucccagcauccagucccgcggacucuuuggcgccauugcuggguucaucgagggaggcuggaccgggaugguggacggaugguacggcuaucaucaccagaaugaacaaggcucuggguacgccgccgaccuuaagagcacgcagaacgcuaucgauaaaauuacaaauaaggucaacuccgugaucgagaaaaugaauacccaguuuaccgcgguuggaaaggaguucaaccaccuugaaaagagaauugagaaucugaacaaaaagguggacgauggcuuccucgacaucuggacauacaaugccgaacugcugguccuccuggagaacgaacggacccuugauuaucaugacagcaacgugaaaaaucuguacgagaagguccgcucucagcucaaaaacaaugcuaaggagauugggaacggauguuuugaguucuaucacaagugcgauaauacauguauggaguccgugaaaaacggcacguacgacuauccuaaguacagcgaagaggccaaacugaauagagaagagaucgaugggguuaagcuggagucuacccggaucuaucaaauucuggccaucuacuccacaguggcuagcucccucguccuggugguuucucugggcgccauuagcuuuuggaugugcuccaacggaucucuccagugccgcaucuguauuuga

SEQ ID NO: 187444 - RNA, 1701 nt, Artificial Sequence
  derived and/or modified sequence opt5 from hemagglutinin__InfluenzaA__ADD98148
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucuucauuuccgauacccccguccaugacugcaauacaaccugucaaaccccuaaaggcgccaucaacacaagccuccccuuucagaauauccacccgauuacgaucggcaagugcccuaaguaugugaaaucuaccaagcugagacuugcuacagggcugcggaacguucccagcauucagucccgcggacucuucggcgccaucgccggguuuauugagggaggcuggaccgggaugguggacggaugguacggcuaucaucaccagaaugaacaaggcucuggguacgcugcggaucugaaaagcacacagaacgccaucgacaagaucaccaauaaagucaacuccgugauugagaagaugaauacgcaguucacagcuguuggaaaggaguucaaccaccuugagaaaagaaucgagaaucugaacaagaaaguggaugacggcuuucucgauauuuggaccuacaaugccgaacugcugguccuccuggagaacgaacggacccuugacuaucaugauagcaaugugaagaaccuguacgagaaaguccgcucucagcucaagaacaaugccaaggagaucgggaacggauguuucgaauuuuaucacaaaugcgacaauacauguauggaguccgugaagaacggcaccuacgauuauccuaaauacagcgaagaggcuaagcugaauagagaagagauugacgggguuaaacuugagucuacacggaucuaucaaauccuggccauuuacuccacgguggcgagcucccucguccuggugguuucucugggcgcuaucagcuucuggaugugcuccaacggaucucuccagugccgcauuuguaucuga

SEQ ID NO: 187445 - RNA, 1701 nt, Artificial Sequence
  derived and/or modified sequence opt5 from hemagglutinin__InfluenzaA__ADD98158
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuugugagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagagccucuaccagaacgcugacgccuacguguucgugggcacauccagauauagcaaaaaguuuaaaccugagauugcuauccggccgaagguccgcgaucaggaagggagaaugaauuacuauuggacccugguugagcccggagacaaaauuacguucgaagccacaggcaaccuggugaucccucgguacgcguuugccauggagcgcaacgcugggucuggaauuaucaucuccgauacccccgugcaugacugcaauacaaccugucaaaccccuaagggcgccauuaacacaagccuccccuuccagaauauccacccgauuacgaucggcaaaugcccuaaguaugucaagucuaccaaacugagacuugcuacagggcugcggaacgugcccagcauucagucccgcggacucuuuggcgccaucgccggguucaucgaaggaggcuggaccgggaugguugacggaugguacggcuaucaucaccagaaugagcaaggcucuggguacgcugcggaucuuaagagcacacagaacgccauugacaaaaucaccaauaaggugaacuccgucauugagaaaaugaauacgcaguuuacagcugugggaaaggaguucaaccaccuugaaaagagaaucgaaaaucugaacaaaaagguugaugacggcuuccucgauauuuggaccuacaaugccgagcugcuggugcuccuggaaaacgagcggacccuugacuaucaugauagcaaugucaaaaaccuguacgagaaggugcgcucucagcucaaaaacaaugccaaggaaaucgggaacggauguuuugaguucuaucacaagugcgacaauacauguauggaauccgucaaaaacggcaccuacgauuauccuaaguacagcgaggaagcuaaacugaauagagaggagaucgacggggugaagcuggaaucuacacggauuuaucaaauccuggccauuuacuccacgguugcgagcucccucgugcuggucgugucucugggcgcuaucagcuuuuggaugugcuccaacggaucucuccagugccgcauuuguaucuga

SEQ ID NO: 187446 - RNA, 1701 nt, Artificial Sequence
  derived and/or modified sequence opt5 from hemagglutinin__InfluenzaA__ADD98168
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccaucaacauucucgaagauaagcacaaugggaaacuguguaaacuuagaggaguggcuccccugcaucucggcaagugcaacaucgccggguggauucugggaaauccugagugugaaucucugagcacagccuccucuuggagcuacaucguugagaccuccucuagcgacaacggcacgugcuauccgggggauuuuaucgacuacgaagaacuccgggagcagcuguccagcgugucuuccuucgaacgcuuugagauuuuccccaagaccagcucuuggccuaaucacgauuccaacaagggagucacagccgcuuguccccaugccggcgcgaaaucuuuuuauaagaaucuuaucuggcuggugaaaaagggcaacagcuacccuaaacucuccaagagcuauauuaaugacaaggggaaagaaguucuggugcuuuggggaauccaccaccccuccaccucugccgaucaacagagccuguaccagaacgcugacgccuacgucuucgugggcacauccagauauagcaagaaauuuaagccugagauugcuauccggccgaaagugcgcgaucaggaggggagaaugaauuacuauuggacccucgucgaacccggagacaagauuacguucgaggccacaggcaaccugguugugccuaaauacgcguuugccauggaacggaacgcugggucuggaaucaucauuuccgauacccccgugcaugacugcaauacaaccugucaaaccccuaagggcgccaucaacacaagccugcccuuccagaauauucacccgaucacgauuggcaagugcccuaaauaugucaagucuaccaaacuccgccuggcuacagggcuuagaaacgugcccagcauccagucccggggacuguuuggcgccaucgccggguucauugagggaggcuggaccgggaugguugacggaugguacggcuaucaucaccagaaugaacaaggcucuggguacgcugcggaucucaagagcacacagaacgccaucgacgagauuaccaauaaagugaacuccgucaucgagaagaugaauacgcaguuuacagcugugggaaaggaguucaaccaccuggagaaacgcauugaaaaucuuaacaagaaaguugaugacggcuuccuggauaucuggaccuacaaugccgagcuccuggugcugcucgaaaacgagagaacccuggacuaucaugauagcaaugucaagaaccuuuacgagaaagugcggucucagcugaagaacaaugccaaggaaaucgggaacggauguuuugaguucuaucacaaaugcgacaauacauguauggaauccgucaagaacggcaccuacgauuauccuaaauacagcgaggaagcuaagcucaaucgcgaggagauugacggggugaaacuggaaucuacaagaaucuaucaaauucuugccaucuacuccacgguugcgagcucccuggugcucgucgugucucugggcgcuauuagcuuuuggaugugcuccaacggaucucugcagugccggaucuguauuuga

SEQ ID NO: 187447 - RNA, 1701 nt, Artificial Sequence; identical to SEQ ID NO: 186865
  derived and/or modified sequence opt5 from hemagglutinin__InfluenzaA__ADD98188

SEQ ID NO: 187448 - RNA, 1701 nt, Artificial Sequence
  derived and/or modified sequence opt5 from hemagglutinin__InfluenzaA__ADD98198
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagaugagacuggcuacagggcuucggaacguucccagcauccagucccgcggacuguuuggcgccauugccggguucaucgagggaggcuggaccgggaugguggacggaugguacggcuaucaucaccagaaugaacaaggcucuggguacgcugcggaucucaaaagcacacagaacgccaucgacgagauuaccaauaaggucaacuccgugaucgagaaaaugaauacgcaguuuacagcuguuggaaaggaguucaaccaccuggagaagagaauugaaaaucuuaacaaaaagguggaugacggcuuccuggauaucuggaccuacaaugccgagcuccugguccugcucgaaaacgagcggacccuggacuaucaugauagcaaugugaaaaaccuuuacgagaagguccgcucucagcugaaaaacaaugccaaggaaauugggaacggauguuuugaguucuaucacaagugcgacaauacauguauggaauccgugaaaaacggcaccuacgauuauccuaaguacagcgaggaagcuaaacucaauagagaggagaucgacgggguuaagcuggaaucuacacggaucuaucaaauucuugccaucuacuccacgguggcgagcucccugguccucgugguuucucugggcgcuauuagcuuuuggaugugcuccaacggaucucugcagugccgcaucuguauuuga

SEQ ID NO: 187449 - RNA, 1701 nt, Artificial Sequence; identical to SEQ ID NO: 185693
  derived and/or modified sequence opt5 from hemagglutinin__InfluenzaA__ADD98208

SEQ ID NO: 187450 - RNA, 1701 nt, Artificial Sequence; identical to SEQ ID NO: 185873
  derived and/or modified sequence opt5 from hemagglutinin__InfluenzaA__ADE20321

SEQ ID NO: 187451 - RNA, 1701 nt, Artificial Sequence; identical to SEQ ID NO: 185873
  derived and/or modified sequence opt5 from hemagglutinin__InfluenzaA__ADE20331

SEQ ID NO: 187452 - RNA, 1701 nt, Artificial Sequence; identical to SEQ ID NO: 185873
  derived and/or modified sequence opt5 from hemagglutinin__InfluenzaA__ADE20341

SEQ ID NO: 187453 - RNA, 1701 nt, Artificial Sequence; identical to SEQ ID NO: 187281
  derived and/or modified sequence opt5 from hemagglutinin__InfluenzaA__ADE20351

SEQ ID NO: 187454 - RNA, 1701 nt, Artificial Sequence; identical to SEQ ID NO: 185873
  derived and/or modified sequence opt5 from hemagglutinin__InfluenzaA__ADE20375

SEQ ID NO: 187455 - RNA, 1701 nt, Artificial Sequence; identical to SEQ ID NO: 187281
  derived and/or modified sequence opt5 from hemagglutinin__InfluenzaA__ADE20388

SEQ ID NO: 187456 - RNA, 1701 nt, Artificial Sequence; identical to SEQ ID NO: 185873
  derived and/or modified sequence opt5 from hemagglutinin__InfluenzaA__ADE20628

SEQ ID NO: 187457 - RNA, 1701 nt, Artificial Sequence; identical to SEQ ID NO: 187281
  derived and/or modified sequence opt5 from hemagglutinin__InfluenzaA__ADE20638

SEQ ID NO: 187458 - RNA, 1701 nt, Artificial Sequence; identical to SEQ ID NO: 185873
  derived and/or modified sequence opt5 from hemagglutinin__InfluenzaA__ADE20648

SEQ ID NO: 187459 - RNA, 1701 nt, Artificial Sequence; identical to SEQ ID NO: 185873
  derived and/or modified sequence opt5 from hemagglutinin__InfluenzaA__ADE20658

SEQ ID NO: 187460 - RNA, 1701 nt, Artificial Sequence; identical to SEQ ID NO: 187281
  derived and/or modified sequence opt5 from hemagglutinin__InfluenzaA__ADE20668

SEQ ID NO: 187461 - RNA, 1701 nt, Artificial Sequence; identical to SEQ ID NO: 187281
  derived and/or modified sequence opt5 from hemagglutinin__InfluenzaA__ADE20678

SEQ ID NO: 187462 - RNA, 1701 nt, Artificial Sequence; identical to SEQ ID NO: 185873
  derived and/or modified sequence opt5 from hemagglutinin__InfluenzaA__ADE20688

SEQ ID NO: 187463 - RNA, 1701 nt, Artificial Sequence; identical to SEQ ID NO: 185873
  derived and/or modified sequence opt5 from hemagglutinin__InfluenzaA__ADE20708

SEQ ID NO: 187464 - RNA, 1701 nt, Artificial Sequence; identical to SEQ ID NO: 185873
  derived and/or modified sequence opt5 from hemagglutinin__InfluenzaA__ADE20718

SEQ ID NO: 187465 - RNA, 1701 nt, Artificial Sequence
  derived and/or modified sequence opt5 from hemagglutinin__InfluenzaA__ADE20728
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuaagggaguugcgccccugcaucucggcaagugcaacauugccggguggauccugggaaauccugagugugaaucucugagcacagcuuccucuuggagcuacauuguggagaccuccucuagcgacaacggcacgugcuauccgggggauuuuaucgacuacgaagaacucagagagcagcuguccagcgucucuuccuucgaacgguuugagaucuuccccaagaccagcucuuggccuaaucacgauuccaacaaaggagugacagccgcuuguccccaugccggcgccaagagcuuuuauaaaaaucuuauuuggcugguuaagaaaggcaacucuuacccuaagcucuccaagagcuauaucaaugacaaagggaaggaagugcugguccuuuggggcauucaccaccccuccaccucugccgaucaacagagccuguaccagaacgcugacgccuacguguucgugggauccagcaaauauucuaagaaauuuaagccugagaucgcuauucgcccgaaagucagagaucaggaggggcggaugaauuacuauuggacacucguugaacccggagacaagaucaccuucgaggccacgggcaaccugguggugccucgcuacgcguuugccauggaaagaaacgcuggguccggaauuaucaucagcgauacacccguccaugacugcaauaccacaugucaaaccccuaagggcgccauuaacaccucucugcccuuccagaauauccacccgauuacaaucggcaaaugcccuaaguaugugaaaagcacgaagcuccggcuggcuaccgggcuucgcaacguucccuccauucagucuagaggacuguuuggcgccaucgccggguucaucgagggaggcuggacagggaugguggacggaugguacggcuaucaucaccagaaugaacaaggcagcggguacgcugcggaucucaaauccacccagaacgccauugacgagaucacaaauaaggucaacagcgugauugagaagaugaauacccaguuuacggcuguuggaaaagaguucaaccaccuggagaagcggaucgaaaaucuuaacaaaaagguggaugacggcuuccuggauauuuggacauacaaugccgagcuccugguccugcucgaaaacgagcgcacccuggacuaucaugauucuaaugugaaaaaccuuuacgagaaggucagaucccagcugaagaacaaugccaaagaaaucgggaacggauguuuugaguucuaucacaagugcgacaauaccuguauggaaagcgugaaaaacggcacauacgauuauccuaaguacucugaggaagcuaaacucaaucgggaggagaucgacgggguuaagcuggaauccacccgcauuuaucaaauccuugccauuuacagcacaguggcguccucucugguccucgugguuagccugggcgcuaucuccuuuuggaugugcucuaacggaagccugcagugcagaauuuguaucuga

SEQ ID NO: 187466 - RNA, 1701 nt, Artificial Sequence; identical to SEQ ID NO: 185873
  derived and/or modified sequence opt5 from hemagglutinin__InfluenzaA__ADE20738

SEQ ID NO: 187467 - RNA, 1701 nt, Artificial Sequence; identical to SEQ ID NO: 185873
  derived and/or modified sequence opt5 from hemagglutinin__InfluenzaA__ADE20748

SEQ ID NO: 187468 - RNA, 1701 nt, Artificial Sequence; identical to SEQ ID NO: 187465
  derived and/or modified sequence opt5 from hemagglutinin__InfluenzaA__ADE20758

SEQ ID NO: 187469 - RNA, 1701 nt, Artificial Sequence; identical to SEQ ID NO: 185873
  derived and/or modified sequence opt5 from hemagglutinin__InfluenzaA__ADE20768

SEQ ID NO: 187470 - RNA, 1701 nt, Artificial Sequence
  derived and/or modified sequence opt5 from hemagglutinin__InfluenzaA__ADE20778
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuaagggaguugcgccccugcaucucggcaagugcaacauugccggguggauccugggaaauccugagugugaaucucugagcacagcuuccucuuggagcuacauuguggagaccuccucuagcgacaacggcacgugcuauccgggggauuuuaucgacuacgaagaacucagagagcagcuguccagcgucucuuccuucgaacgguuugagaucuuccccaagaccagcucuuggccuaaucacgauuccaacaaaggagugacagccgcuuguccccaugccggcgccaagagcuuuuauaaaaaucuuauuuggcugguuaagaaaggcaacucuuacccuaagcucuccaagagcuauaucaaugacaaagggaagaaagugcugguccuuuggggcauucaccaccccuccaccucugccgaucaacagagccuguaccagaacgcugacgccuacguguucgugggauccagcaaguauucuaaaaaguuuaaaccugaaaucgcuauucgcccgaaggucagagaucaggaggggcggaugaauuacuauuggacacucguugagcccggagacaagaucaccuucgaagccacgggcaaccugguggugccucgcuacgcguuugccauggagagaaacgcuggguccggaauuaucaucagcgauacacccguccaugacugcaauaccacaugucaaaccccuaaaggcgccauuaacaccucucugcccuuccagaauauccacccgauuacaaucggcaagugcccuaaauauguuaagagcacgaaacuccggcuggcuaccgggcuucgcaacgugcccuccauucagucuagaggacuguuuggcgccaucgccggguucaucgaaggaggcuggacagggaugguggacggaugguacggcuaucaucaccagaaugagcaaggcagcggguacgcugcggaucucaaguccacccagaacgccauugacgaaaucacaaauaaggucaacagcgugauugagaaaaugaauacccaguuuacggcuguuggaaaggaguucaaccaccuggaaaaacggaucgagaaucuuaacaagaaaguggaugacggcuuccuggauauuuggacauacaaugccgaacuccugguccugcucgagaacgaacgcacccuggacuaucaugauucuaaugugaagaaccuuuacgagaaggucagaucccagcugaaaaacaaugccaaggagaucgggaacggauguuuugaguucuaucacaaaugcgacaauaccuguauggagagcgugaagaacggcacauacgauuauccuaaauacucugaagaggcuaagcucaaucgggaagagaucgacgggguuaagcuggaguccacccgcauuuaucaaauccuugccauuuacagcacaguggcguccucucugguccucgugguuagccugggcgcuaucuccuuuuggaugugcucuaacggaagccugcagugcagaauuuguaucuga

SEQ ID NO: 187471 - RNA, 1701 nt, Artificial Sequence; identical to SEQ ID NO: 186857
  derived and/or modified sequence opt5 from hemagglutinin__InfluenzaA__ADE20788

SEQ ID NO: 187472 - RNA, 1701 nt, Artificial Sequence
  derived and/or modified sequence opt5 from hemagglutinin__InfluenzaA__ADE20808
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggaaaaagaggugcuuguccugugggggauccaccaccccuccaccucugccgaucaacagagccucuaccagaacgcugacgccuacguguucgugggaacauccagauauagcaagaaauuuaagccugagauugcuauccggccgaaaguccgcgaucaggaaggcagaaugaauuacuauuggacccugguugagcccggggacaagauuacguucgaagccacaggaaaccugguggugccucgguacgcguuugccauggagcgcaacgcuggcucugggaucauuaucuccgauacccccguccaugacugcaauacaaccugucaaaccccuaaaggagccaucaacacaagccuccccuuccagaauauucacccgaucacgauuggcaagugcccuaaguaugugaaaucuaccaagcugagacuugcuacaggccugcggaacguucccagcauccagucccgcgggcucuuuggagccauugccggcuucaucgaagggggauggaccggcaugguggacgggugguacggauaucaucaccagaaugagcaaggcucuggcuacgcugcggaucugaaaagcacacagaacgccaucgacaagauuaccaauaaagucaacuccgugaucgagaagaugaauacgcaguuuacagcuguugggaaggaguucaaccaccuugagaaaagaauugaaaaucugaacaagaaaguggaugacggauuccucgauaucuggaccuacaaugccgagcugcugguccuccuggaaaacgagcggacccuugacuaucaugauagcaaugugaagaaccuguacgagaaaguccgcucucagcucaagaacaaugccaaggaaauuggcaacggguguuuugaguucuaucacaaaugcgacaauacauguauggaauccgugaagaacggaaccuacgauuauccuaaauacagcgaggaagcuaagcugaauagagaggagaucgacggcguuaaacuugaaucuacacggaucuaucaaauucuggccaucuacuccacgguggcgagcucccucguccuggugguuucucugggggcuauuagcuuuuggaugugcuccaacggcucucuccagugccgcaucuguauuuga

SEQ ID NO: 187473 - RNA, 1701 nt, Artificial Sequence; identical to SEQ ID NO: 186857
  derived and/or modified sequence opt5 from hemagglutinin__InfluenzaA__ADE20818

SEQ ID NO: 187474 - RNA, 1701 nt, Artificial Sequence; identical to SEQ ID NO: 187415
  derived and/or modified sequence opt5 from hemagglutinin__InfluenzaA__ADE20828

SEQ ID NO: 187475 - RNA, 1701 nt, Artificial Sequence
  derived and/or modified sequence opt5 from hemagglutinin__InfluenzaA__ADE20848
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaauccuuuuauaagaaccugaucuggcucguuaaaaagggcaauucuuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaccugguggugccucgguacgcguuugccauggaacgcaaugcugggucuggaaucauuaucuccgacacccccguccaugauugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugaucgacggaugguacggcuaucaucaccagaacgaacaaggcucuggguacgcugcggaccugaaaagcacacagaaugccauugauaagaucaccaacaaagugaauagcgucauugagaagaugaacacgcaguuuacagcugugggaaaggaguucaaucaccuugagaaaagaaucgagaaccugaauaagaaaguugacgauggcuuccucgacauuuggaccuacaacgccgaacugcuggugcuccuggagaaugaacggacccuugauuaucaugacagcaacgucaagaaccuguacgagaaagugcgcucucagcucaagaauaacgccaaggagaucgggaauggauguuuugaguucuaucacaaaugcgauaacacauguauggaauccgucaagaauggcaccuacgacuauccuaaauacagcgaagaggcuaagcugaacagagaagagaucgauggggugaaacuugagucuacacggauuuaucaaauccuggccauuuacuccacgguugcgagcucccucgugcuggucgugucucugggcgcuaucagcuuuuggaugugcuccaauggaucucuccagugccgcauuuguaucuga

SEQ ID NO: 187476 - RNA, 1701 nt, Artificial Sequence; identical to SEQ ID NO: 186857
  derived and/or modified sequence opt5 from hemagglutinin__InfluenzaA__ADE20858

SEQ ID NO: 187477 - RNA, 1701 nt, Artificial Sequence
  derived and/or modified sequence opt5 from hemagglutinin__InfluenzaA__ADE20868
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagggaagcacaauggaaaacuuuguaagcugagaggcguugcuccccuccaucuggggaaaugcaacaucgccggauggauucugggcaauccugagugugaaucucucacaaccgccagcuccuggucuuacaucguggagacgagcuccucugauaacgggaccugcuauccgggagacuuuauugauuacgaagaacugcgggagcagcuuagcuccgucagcucuuucgaacgcuuugagauguuccccaagacauccagcuggccuaaucacgacucuaacaagggcgugaccgccgcuuguccccaugccggcgcgaaauccuuuuauaagaaucugaucuggcucguuaaaaaggggaacagcuacccuaaacugucuaaguccuauaucaaugauaagggaaaagaagugcuuguccuguggggcauucaccaccccagcacauccgccgaccaacagucucucuaccagaacgcugaugccuacguguucguggggaccagcagauauuccaagaaauuuaagccugagaucgcuauucggccgaaaguccgcgaccaggagggaagaaugaauuacuauuggacgcugguugaacccggcgauaagaucacauucgaggccaccgggaaccugguggugccucgguacgcguuugccauggaacgcaacgcuggaagcggcauuaucauuucugacacacccguccaugauugcaauaccaccugucaaacaccuaaaggcgccaucaacacgucccuccccuuccagaauauccacccgauuaccaucgggaagugcccuaaguaugugaaaagcacaaagcugagacuugcuaccggacugcggaacguucccucuauucagagccgcggccucuuuggggccaucgccggauucauugagggcggguggacaggaaugguggacggcugguacggcuaucaucaccagaaugaacaaggguccggauacgcugcggaccugaaaucuacccagaacgccaucgaugagaucacgaauaaggucaacagcgugauugagaaaaugaauacacaguuuaccgcuguuggcaaggaguucaaccaccuugagaagagaaucgaaaaucugaacaaaaagguggacgauggguuccucgacauuuggaccuacaaugccgagcugcugguccuccuggaaaacgagcggacacuugauuaucaugacuccaaugugaaaaaccuguacgagaagguccgcagccagcucaaaaacaaugccaaggaaaucggaaacggcuguuuugaguucuaucacaagugcgauaauaccuguauggaaucugugaaaaacgggacauacgacuauccuaaguacuccgaggaagcuaaacugaauagagaggagauugauggcguuaaacuugaaagcacgcggaucuaucaaauccuggccauuuacucuaccguggcguccagccucguccuggugguuucccugggagcuaucucuuuuuggaugugcagcaacggcucccuccagugccgcauuuguaucuga

SEQ ID NO: 187478 - RNA, 1701 nt, Artificial Sequence; identical to SEQ ID NO: 187411
  derived and/or modified sequence opt5 from hemagglutinin__InfluenzaA__ADE20878

SEQ ID NO: 187479 - RNA, 1701 nt, Artificial Sequence; identical to SEQ ID NO: 186795
  derived and/or modified sequence opt5 from hemagglutinin__InfluenzaA__ADE20888

SEQ ID NO: 187480 - RNA, 1701 nt, Artificial Sequence
  derived and/or modified sequence opt5 from hemagglutinin__InfluenzaA__ADE20898
augaaggccauccuggugguccuccuguacaccuucgcuacagccaacgcggacacgcuuugcauuggcuaucacgcuaauaacagcaccgauacaguugacaccauccuggagaagaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccaagagcuauaucaaugacaaggggaaagaaauucuuguucuguggggaauccaccaccccuccaccucugccgaucaacagagccucuaccagaacgcugacgccuacguguucgucggcacauccagauauagcaagaaauuuaagccugagauugcuauccggccgaaagugcgcgaucaggaggggagaaugaauuacuauuggacccugguggaacccggagacaagauuacguucgaggccacaggcaaccuggucguuccucgguacgcguuugccauggaacgcaacgcugggucuggaaucaucauuuccgauacccccgugcaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguccccagcauccagucccgcggacucuuuggcgccaucgccggguucauugagggaggcuggaccgggaugguggacggaugguacggcuaucaucaccagaaugaacaaggcucuggguacgcugcggaucugaaaagcacacagaacgccaucgacgagauuaccaauaagguuaacuccgugaucgagaaaaugaauacgcaguuuacagcugucggaaaggaguucaaccaccuugagaagagaauugaaaaucugaacaaaaagguggaugacggcuuccucgauaucuggaccuacaaugccgagcugcugguucuccuggaaaacgagcggacccuugacuaucaugauagcaaugugaaaaaccuguacgagaagguccgcucucagcucaaaaacaaugccaaggaaaucgggaacggauguuuugaguucuaucacaagugcgacaauacauguauggaaggcgugaaaaacgggaccuacgauuauccuaaguacuccgaggaagcuaaacugaauagagaggagauugacggcgucaaacuugaaagcacacggaucuaucaaauucuggccaucuacucuacgguggcguccagccucguucugguggucucccugggagcuauuucuuuuuggaugugcagcaacggcucccuccagugccgcaucuguauuuga

SEQ ID NO: 187481 - RNA, 1701 nt, Artificial Sequence; identical to SEQ ID NO: 187444
  derived and/or modified sequence opt5 from hemagglutinin__InfluenzaA__ADE20908

SEQ ID NO: 187482 - RNA, 1701 nt, Artificial Sequence
  derived and/or modified sequence opt5 from hemagglutinin__InfluenzaA__ADE20918
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggaacauccagauauagcaagaaauuuaagccugagaucgcuauucggccgaaaguccgcgaucaggaggggagaaugaauuacuauuggauccucguugaacccggagacaagauuaccuucgaggccacgggcaaccugguggugccucgguacgcguuugccauggaacgcaacgcugggucuggaaucaucauuuccgauacacccguccaugacugcaauaccacaugucaaaccccuaaaggcgccaucaacaccagccugcccuuccagaauauucacccgaucacaauuggcaagugcccuaaguaugugaaaucuacgaagcucagacuggcuaccgggcuucggaacguucccagcauccagucccgcggacuguuuggcgccaucgccggguucauugagggaggcuggacagggaugguggacggaugguacggcuaucaucaccagaaugaacaaggcucuggguacgcugcggaucucaaaagcacccagaacgccaucgacgagauuacaaauaaggucaacuccgugaucgagaaaaugaauacccaguuuacggcuguuggaaaggaguucaaccaccuggagaagagaauugaaaaucuuaacaaaaagguggaugacggcuuccuggauaucuggacauacaaugccgagcuccugguccugcucgaaaacgagcggacccuggacuaucaugauagcaaugugaaaaaccuuuacgagaagguccgcucucagcugaaaaacaaugccaaggaaaucgggaacggauguuuugaguucuaucacaagugcgacaauaccuguauggaauccgugaaaaacggcacauacgauuauccuaaguacagcgaggaagcuaaacucaauagagaggagauugacgggguuaagcuggaaucuacccggaucuaucaaauucuugccaucuacuccacaguggcgagcucccugguccucgugguuucucugggcgcuauuagcuuuuggaugugcuccaacggaucucugcagugccgcaucuguauuuga

SEQ ID NO: 187483 - RNA, 1701 nt, Artificial Sequence; identical to SEQ ID NO: 186046
  derived and/or modified sequence opt5 from hemagglutinin__InfluenzaA__ADE20928

SEQ ID NO: 187484 - RNA, 1701 nt, Artificial Sequence
  derived and/or modified sequence opt5 from hemagglutinin__InfluenzaA__ADE20948
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugauuccuacguguucgugggcacaagcagauauucuaagaaauuuaagccugagauugccauccggccgaaaguccgcgaccaggaggggagaaugaacuacuauuggacccugguugaacccggagauaagauuacguucgaggcuacaggcaaccugguggugccucgguacgccuuugcgauggaacgcaaugccggguccggaaucauuaucagcgacacccccguccaugauugcaacacaaccugucaaaccccuaaaggcgcuaucaauacaucucuccccuuccagaacauucacccgaucacgauuggcaagugcccuaaguaugugaaaagcaccaagcugagacuugccacagggcugcggaauguucccuccauccagucucgcggacucuuuggcgcuauugccggguucaucgagggaggcuggaccgggaugguggacggaugguacggcuaucaucaccagaacgaacaaggcagcggguacgccgcugaccugaaauccacacagaaugcgaucgauaagauuaccaacaaagucaauagcgugaucgagaagaugaacacgcaguuuacagccguuggaaaggaguucaaucaccuugagaaaagaauugagaaccugaauaagaaaguggacgauggcuuccucgacaucuggaccuacaacgcugaacugcugguccuccuggagaaugaacggacccuugauuaucaugacucuaacgugaagaaccuguacgagaaaguccgcucccagcucaagaauaacgccaaggagauugggaauggauguuuugaguucuaucacaaaugcgauaacacauguauggaaagcgugaagaauggcaccuacgacuauccuaaauacucugaagaggccaagcugaacagagaagagaucgaugggguuaaacuugaguccacacggaucuaucaaauucuggcuaucuacagcacgguggccuccucucucguccuggugguuagccugggcgcgauuuccuuuuggaugugcucuaauggaagccuccagugccgcaucuguauuuga

SEQ ID NO: 187485 - RNA, 1701 nt, Artificial Sequence
  derived and/or modified sequence opt5 from hemagglutinin__InfluenzaA__ADE20968
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggagaggcuccccuccaucugggcaaaugcaacaucgccggguggauucugggaaauccugaaugugagucucucagcacagccuccucuuggagcuacaucguugaaaccuccucuagcgacaacggcacgugcuauccgggggauuuuauuaauuacgaggagcugcgggaacagcuuuccagcgugucuuccuucgagcgcuuugaaaucuuccccaagaccagcucuuggccuaaccacgacuccaauaagggagucacagccgcuuguccccauagcggcgccaaaucuuuuuauaagaaccugaucuggcucgugaaaaagggcaauuccuacccuaaacugagcaaguccuauauuaacgauaaggggaaagagguucuugugcuguggggaauccaccaccccucuaccagcgcggaccaacagucccucuaccagaaugccgaugcuuacgucuucgugggcacaagcagauauucuaagaaauuuaagccugagauugccauccggccgaaagugcgcgaccaggaagggagaaugaacuacuauuggacccuggucgagcccggagauaagauuacguucgaagcuacaggcaaccugguugugccucgguacgccuuugcgauggagcgcaaugccggguccggaaucauuaucagcgacacccccgugcaugauugcaacacaaccugucaaaccccuaaaggcgcuaucaauacaucucuccccuuccagaacauucacccgaucacgauuggcaagugcccuaaguaugucaaaagcaccaagcugagacuugccacagggcugcggaaugugcccuccauccagucucgcggacucuuuggcgcuauugccggguucaucgaaggaggcuggaccgggaugguugacggaugguacggcuaucaucaccagaacgagcaaggcagcggguacgccgcugaccugaaauccacacagaaugcgaucgauaagauuaccaacaaagugaauagcgucaucgagaagaugaacacgcaguuuacagccgugggaaaggaauuuaaucaccuugagaaaagaauugaaaaccugaauaagaaaguugacgauggcuuccucgacaucuggaccuacaacgcugagcugcuggugcuccuggaaaaugagcggacccuugauuaucaugacucuaacgucaagaaccuguacgagaaagugcgcucccagcucaagaauaacgccaaggaaauugggaauggauguuucgaguucuaucacaaaugcgauaacacauguauggaaagcgucaagaauggcaccuacgacuauccuaaauacucugaggaagccaagcugaacagagaggagaucgauggggugaaacuugaauccacacggaucuaucaaauucuggcuaucuacagcacgguugccuccucucucgugcuggucgugagccugggcgcgauuuccuuuuggaugugcucuaauggaagccuccagugccgcaucuguauuuga

SEQ ID NO: 187486 - RNA, 1701 nt, Artificial Sequence; identical to SEQ ID NO: 186857
  derived and/or modified sequence opt5 from hemagglutinin__InfluenzaA__ADE20978

SEQ ID NO: 187487 - RNA, 1701 nt, Artificial Sequence
  derived and/or modified sequence opt5 from hemagglutinin__InfluenzaA__ADE20988
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucuacagaucaacagagccucuaccagaacgccgacgcuuacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacauccccagcauucagucccgcggacucuuuggcgcuaucgccggguucaucgagggaggcuggacagggaugguugacggaugguacggcuaucaucaccagaaugaacaaggcucuggguacgccgcugaucugaaaagcacccagaacgcgauugacgagaucacgaauaaggugaacuccgucauugagaaaaugaauacacaguuuaccgccgugggaaaggaguucaaccaccuugagaagagaaucgaaaaucugaacaaaaagguugaugacggcuuccucgauauuuggaccuacaaugcugagcugcuggugcuccuggaaaacgagcggacacuugacuaucaugauagcaaugucaaaaaccuguacgagaaggugcgcucucagcucaaaaacaaugccaaggaaaucgggaacggauguuuugaguucuaucacaagugcgacaauaccuguauggaauccgucaaaaacggcacauacgauuauccuaaguacagcgaggaagccaaacugaagagagaggagaucgacggggugaaacuugaaucuacgcggauuuaucaaauccuggcuauuuacuccaccguugccagcucccucgugcuggucgugucucugggcgcgaucagcuuuuggaugugcuccaauggaucucuccagugccgcauuuguaucuga

SEQ ID NO: 187488 - RNA, 1701 nt, Artificial Sequence; identical to SEQ ID NO: 186857
  derived and/or modified sequence opt5 from hemagglutinin__InfluenzaA__ADE20998

SEQ ID NO: 187489 - RNA, 1701 nt, Artificial Sequence; identical to SEQ ID NO: 187021
  derived and/or modified sequence opt5 from hemagglutinin__InfluenzaA__ADE21008

SEQ ID NO: 187490 - RNA, 1701 nt, Artificial Sequence
  derived and/or modified sequence opt5 from hemagglutinin__InfluenzaA__ADE21018
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacaaccgccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaccccuccacaucuaccgaucaacagagccucuaccagaacgcggacgccuacguguucgugggcacguccagauauagcaagaaauuuaagccugagauugcuauccggccgaaaguccgcgaucaggaggggagaaugaauuacuauuggacacugguugaacccggagacaagauuaccuucgaggccacaggcaaccugguggugccucgguacgcuuuugccauggaacgcaacgcggggucuggaaucauuaucuccgauacccccguccaugacugcaauaccacaugucaaacgccuaaaggcgccaucaacaccagccuccccuuccagaauauucacccgaucacaauuggcaagugcccuaaguaugugaaaucuaccaagcugagacuugcuacagggcugcggaacauccccagcauucagucccgcggacucuuuggcgccaucgcuggguucaucgagggaggcuggaccgggaugguugacggaugguacggcuaucaucaccagaaugaacaaggcucuggguacgccgccgaucugaaaagcacgcagaacgcuauugacgagaucacaaauaaggugaacuccgucauugagaaaaugaauacccaguuuaccgcggugggaaaggaguucaaccaccuugagaagagaaucgaaaaucugaacaaaaagguugaugacggcuuccucgauauuuggacauacaaugccgagcugcuggugcuccuggaaaacgagcggacccuugacuaucaugauagcaaugucaaaaaccuguacgagaaggugcgcucucagcucaaaaacaaugcuaaggaaaucgggaacggauguuuugaguucuaucacaagugcgacaauacauguauggaauccgucaaaaacggcacguacgauuauccuaaguacagcgaggaagccaaacugaauagagaggagaucgacggggugaaacuugaaucuacccggauuuaucaaauccuggccauuuacuccacaguugcuagcucccucgugcuggucgugucucugggcgccaucagcuuuuggaugugcuccaacggaucucuccagugccgcauuuguaucuga

SEQ ID NO: 187491 - RNA, 1701 nt, Artificial Sequence; identical to SEQ ID NO: 187431
  derived and/or modified sequence opt5 from hemagglutinin__InfluenzaA__ADE21028

SEQ ID NO: 187492 - RNA, 1701 nt, Artificial Sequence; identical to SEQ ID NO: 187421
  derived and/or modified sequence opt5 from hemagglutinin__InfluenzaA__ADE21038

SEQ ID NO: 187493 - RNA, 1701 nt, Artificial Sequence; identical to SEQ ID NO: 187444
  derived and/or modified sequence opt5 from hemagglutinin__InfluenzaA__ADE21048

SEQ ID NO: 187494 - RNA, 1701 nt, Artificial Sequence
  derived and/or modified sequence opt5 from hemagglutinin__InfluenzaA__ADE21058
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaauuaauuacuauuggacccugguugaacccggagacaagaucacguucgaggccacaggcaaccugguggugccucgguacgcguuugccauggaacgcaacgcugggucuggaauuaucaucuccgauacccccgcccaugacugcaauacaaccugucaaaccccuaaaggcgcuauuaacacaagccuccccuuccagaauauccacccgauuacgaucggcaagugcccuaaguaugucaaaucuaccaagcugagacuugccacagggcugcggaacgugcccagcauucagucccgcggacucuuuggcgccaucgcuggguucaucgagggaggcuggaccgggaugguugacggaugguacggcuaucaucaccagaaugaacaaggcucuggguacgcggccgaucugaaaagcacacagaacgcuauugacaagaucaccaauaaagugaacuccgucauugagaagaugaauacgcaguuuacagccgugggaaaggaguucaaccaccuugagaaaagaaucgagaaucugaacaagaaaguugaugacggcuuccucgauauuuggaccuacaaugccgaacugcuggugcuccuggagaacgaacggacccuugacuaucaugauagcaaugucaagaaccuguacgagaaagugcgcucucagcucaagaacaaugcuaaggagaucgggaacggauguuuugaguucuaucacaaaugcgacaauacauguauggaauccgucaagaacggcaccuacgauuauccuaaauacagcgaagaggccaagcugaauagagaagagaucgacggggugaaacuugagucuacacggauuuaucaaauccuggcgauuuacuccacgguugcuagcucccucgugcuggucgugucucugggcgccaucagcuuuuggaugugcuccaacggaucucuccagugccgcauuuguaucuga

SEQ ID NO: 187495 - RNA, 1701 nt, Artificial Sequence
  derived and/or modified sequence opt5 from hemagglutinin__InfluenzaA__ADE21068
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccagaauauucacucuaucacgauuggcaagugcccgaaguaugugaaaagcaccaagcugagacuugcuacagggcugcggaacguuccuuccauccagucucgcggacucuuuggcgccauugccggguucaucgaaggaggcuggaccgggaugguggacggaugguacggcuaucaucaccagaaugagcaaggcagcggguacgcugcggaccugaaauccacacagaacgccaucgaugagauuaccaauaaggucaacagcgugaucgaaaagaugaauacgcaguuuacagcuguuggaaaggaguucaaccaccuugaaaagagaauugagaaucugaacaaaaagguggacgauggcuuccucgacaucuggaccuacaaugccgaacugcugguccuccuggagaacgagcggacccuugauuaucaugacucuaaugugaaaaaccuguacgaaaagguccgcucccagcucaaaaacaaugccaaggagacagggaacggauguuuugaguucuaucacaagugcgauaauaccuguauggagagcgugaaaaacggcacauacgacuaucccaaguacucugaagaggcuaaacugaauagagaggaaauugaugggguuaaacuugaguccacgcggaucuaucaaauccuggccauuuacagcaccguggcguccucucucguccuggugguuagccugggcgcuaucuccuuuuggaugugcucuaacggaagccuccagugccgcauuuguaucuga

SEQ ID NO: 187496 - RNA, 1698 nt, Artificial Sequence
  derived and/or modified sequence opt5 from hemagglutinin__InfluenzaA__ADE28761
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcaaucagaaaacccuguaccauacagagaacgccuacgugagcgucguuuccucucacuauagcagaaaguucacccccgaaauugcuaagcggccuaaagugcgcgaccaggaggggagaaucaauuacuauuggacgcuucuggagcccggagauacaauuaucuuugaagccaacggcaaucucauugcgccucgguacgccuucgcucugucccgcggguuuggaagcggcaucauuaacucuaaugcccccauggacaagugugaugcuaaaugccagaccccgcaaggcgccaucaacuccagccuuccuuuccagaaugugcaucccgucacaaucggggaguguccuaaguaugugagaucugcgaaacugcggaugguuaccggacuccgcaacauucccagcauccaguccagaggccuguuuggggccauugcuggauucaucgaaggcggguggaccggaaugguggacggcugguacggcuaucaccaccagaaugagcaagggucuggauacgccgcugaucaaaagagcacacagaacgccauuaauggcaucacgaacaaagucaauuccgugaucgaaaagaugaacacccaguuuacagccguugggaaggaguucaacaaacuggagcggcgcauggaaaaucucaacaagaaaguggacgauggauucauugacaucuggaccuacaaugcugagcugcuuguccugcucgaaaacgagagaacacuggauuuucaugaaagcaaugugaagaaccuuuaugagaaagucaagucucagcugaagaauaacgcgaaagagauuggcaaugggugcuucgaauuuuaccacaaguguaacgacgagugcauggaauccgugaaaaauggcaccuaugacuaccccaaguauagcgaggagucuaaacucaaccgggaaaagaucgauggaguuaagcuggaguccauggaaguguaccagauucuggccaucuauagcacggucgcuuccucucucgugcugcuuguuagccugggcgccaucuccuucuggaugugcucuaaugggagccuccagugucgcauuugcaucuga

SEQ ID NO: 187497 - RNA, 1701 nt, Artificial Sequence; identical to SEQ ID NO: 185873
  derived and/or modified sequence opt5 from hemagglutinin__InfluenzaA__ADE28780

SEQ ID NO: 187498 - RNA, 1701 nt, Artificial Sequence; identical to SEQ ID NO: 187281
  derived and/or modified sequence opt5 from hemagglutinin__InfluenzaA__ADE28790

SEQ ID NO: 187499 - RNA, 1701 nt, Artificial Sequence; identical to SEQ ID NO: 187465
  derived and/or modified sequence opt5 from hemagglutinin__InfluenzaA__ADE28800

SEQ ID NO: 187500 - RNA, 1701 nt, Artificial Sequence; identical to SEQ ID NO: 186857
  derived and/or modified sequence opt5 from hemagglutinin__InfluenzaA__ADE28810

SEQ ID NO: 187501 - RNA, 1701 nt, Artificial Sequence
  derived and/or modified sequence opt5 from hemagglutinin__InfluenzaA__ADE28820
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaucuccugagugugaaagccucuccacagccucuagcugguccuacaucguggagaccucuagcuccgacaauggcacgugcuauccgggggauuuuauugacuacgaagaacugcgggagcagcuuagcucugucuccagcuucgaacgcuuugagaucuuccccaagaccucuuccuggccuaaccacgauagcaauaagggagugacagccgcuuguccccaugccggcgcgaaaucuuuuuauaagaaccugaucuggcucguuaaaaagggcaauuccuacccuaaacugagcaaguccuauauuaacgacaaggggaaagaagugcuuguccuguggggaauccaccaccccucuaccagcgccgaucaacagucccucuaccagaaugcugacgccuacguguucgugggcacaagcagauauucuaagaaauuuaagccugagauugcuauccggccgaaaguccgcgaucaggaggggagaaugaacuacuauuggacccugguugaacccggagacaagauuacguucgaggccacaggcaaucugguggugccucgguacgcguuugccauggaacgcaacgcuggguccggaaucauuaucagcgauacccccguccaugacugcaacacaaccugucaaaccccuaaaggcgccaucaauacaucucuccccuuccagaacauucacccgaucacgauuggcaagugcccuaaguaugugaaaagcaccaagcugagacuugcuacagggcugcggaauguucccuccauccagucucgcggacucuuuggcgccauugccggguucaucgagggaggcuggaccgggaugguggacggaugguacggcuaucaucaccagaacgaacaaggcagcggguacgcugcggaucugaaauccacacagaaugccaucgacaagauuaccaacaaagucaauagcgugaucgagaagaugaacacgcaguuuacagcuguuggaaaggaguucaaucaccuugagaaaagaauugagaaccugaauaagaaaguggaugacggcuuccucgauaucuggaccuacaacgccgaacugcugguccuccuggagaaugaacggacccuugacuaucaugauucuaacgugaagaaucuguacgagaaaguccgcucccagcucaagaacaacgccaaggagauugggaauggauguuuugaguucuaucacaaaugcgacaacacauguauggaaagcgugaagaauggcaccuacgauuauccuaaauacucugaagaggcuaagcugaacagagaagagaucgacgggguuaaacuugaguccacacggaucuaucaaauucuggccaucuacagcacgguggcguccucucucguccuggugguuagccugggcgcuauuuccuuuuggaugugcucuaauggaagccuccagugccgcaucuguauuuga

SEQ ID NO: 187502 - RNA, 1701 nt, Artificial Sequence; identical to SEQ ID NO: 185873
  derived and/or modified sequence opt5 from hemagglutinin__InfluenzaA__ADE28830

SEQ ID NO: 187503 - RNA, 1701 nt, Artificial Sequence; identical to SEQ ID NO: 185873
  derived and/or modified sequence opt5 from hemagglutinin__InfluenzaA__ADE28840

SEQ ID NO: 187504 - RNA, 1701 nt, Artificial Sequence; identical to SEQ ID NO: 185873
  derived and/or modified sequence opt5 from hemagglutinin__InfluenzaA__ADE28850

SEQ ID NO: 187505 - RNA, 1701 nt, Artificial Sequence; identical to SEQ ID NO: 185873
  derived and/or modified sequence opt5 from hemagglutinin__InfluenzaA__ADE28881

SEQ ID NO: 187506 - RNA, 1701 nt, Artificial Sequence; identical to SEQ ID NO: 185873
  derived and/or modified sequence opt5 from hemagglutinin__InfluenzaA__ADE28891

SEQ ID NO: 187507 - RNA, 1701 nt, Artificial Sequence; identical to SEQ ID NO: 187376
  derived and/or modified sequence opt5 from hemagglutinin__InfluenzaA__ADE28911

SEQ ID NO: 187508 - RNA, 1701 nt, Artificial Sequence; identical to SEQ ID NO: 186857
  derived and/or modified sequence opt5 from hemagglutinin__InfluenzaA__ADE28921

SEQ ID NO: 187509 - RNA, 1701 nt, Artificial Sequence; identical to SEQ ID NO: 186857
  derived and/or modified sequence opt5 from hemagglutinin__InfluenzaA__ADE28931

SEQ ID NO: 187510 - RNA, 1701 nt, Artificial Sequence; identical to SEQ ID NO: 186046
  derived and/or modified sequence opt5 from hemagglutinin__InfluenzaA__ADE28951

SEQ ID NO: 187511 - RNA, 1701 nt, Artificial Sequence
  derived and/or modified sequence opt5 from hemagglutinin__InfluenzaA__ADE28961
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacguggccggguggauccugggaaauccugagugugaaucucucagcacagccuccucuuggagcuacauugucgagaccuccucuagcgacaacggcacgugcuauccgggggauuuuaucgacuacgaagaacugcgggagcagcuuuccagcgugucuuccuucgaacgcuuugagauuuuccccaagaccagcucuuggccuaaucacgauuccaacaagggaguuacagccgcuuguccccaugccggcgcgaaaucuuuuuauaagaaucugaucuggcucgugaaaaagggcaacagcuacccuaaacuguccaagagcuauaucaaugacaaggggaaagaaguccuugugcuguggggcauucaccaccccuccaccucugccgaucaacagagccucuaccagaacgcugacgccuacguguucgucggaacauccagauauagcaagaaauuuaagccugagaucgcuauucggccgaaaguucgcgaucaggaggggagaaugaauuacuauuggacccugguggaacccggagacaagaucacguucgaggccacaggcaaccugguggucccucgguacgcguuugccauggaacgcaacgcugggucuggaauuaucauuuccgauacccccgugcaugacugcaauacaaccugucaaaccccuaaaggcgccaucaacacaagccuccccuuccagaauauccacccgauuacgaucggcaagugcccuaaguauguuaaaucuaccaagcugagacuugcuacagggcugcggaacgugcccagcauucagucccgcggacucuuuggcgccaucgccggguucauugagggaggcuggaccgggauggucgacggaugguacggcuaucaucaccagaaugaacaaggcucuggguacgcugcggaucugaaaagcacacagaacgccaucgacgagaucaccaauaaggugaacuccguuauugagaaaaugaauacgcaguuuacagcugugggaaaggaguucaaccaccuugagaagagaaucgaaaaucugaacaaaaaggucgaugacggcuuccucgauauuuggaccuacaaugccgagcugcuggugcuccuggaaaacgagcggacccuugacuaucaugauagcaaugucaaaaaccuguacgagaaggugcgcucucagcucaaaaacaaugccaaggaaaucgggaacggauguuuugaguucuaucacaagugcgacaauacauguauggaauccguuaaaaacggcaccuacgauuauccuaaguacagcgaggaagcuaaacugaauagagaggagauugacggggugaaacuugaaucuacacggaucuaucaaauccuggccauuuacuccacggucgcgagcucccucgugcugguugugucucugggcgcuaucagcuuuuggaugugcuccaacggaucucuccagugccgcauuuguaucuga

SEQ ID NO: 187512 - RNA, 1701 nt, Artificial Sequence; identical to SEQ ID NO: 187397
  derived and/or modified sequence opt5 from hemagglutinin__InfluenzaA__ADE28971

SEQ ID NO: 187513 - RNA, 1701 nt, Artificial Sequence
  derived and/or modified sequence opt5 from hemagglutinin__InfluenzaA__ADE28981
augaaggccauccuggugguccuccuguacaccuucgcuacagccaacgcggacacgcuuugcauuggcuaucacgcuaauaacagcaccgagacaguugauaccgugcuggagaaaaaugugacagucacccauuccgugaaccuccuggaagacaagcacaaugggaaacuuuguaagcugagaggaguugcuccccuccaucugggcaaaugcaacaucgccggguggauucugggaaauccugaaugugagucucucagcacagccuccucuuggagcuacaucguggaaaccuccucuagcgauaacggcacgugcuauccgggggacuuuauugauuacgaggagcugcgggaacagcuuuccagcgucucuuccuucgagcgcuuugaaaucuuccccaagaccagcucuuggccuaaucacgacuccaacaagggagugacagccgcuuguccccaugccggcgcgaaaucuuuuuauaagaaucugaucuggcucguuaaaaagggcaacagcuacccuaaacuguccaagagcuauauuaaugauaaggggaaagaggugcuuguccuguggggaauccaccaccccuccaccucugccgaccaacagagccucuaccagaacgcugaugccuacguguucgugggcacauccagauauagcaagaaauuuaagccugagauugcuauccggccgaaaguccgcgaccaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaccugaaaagcacacagaacgccaucgauaagauuaccaauaaagucaacuccgugaucgagaagaugaauacgcaguuuacagcuguuggaaaggaauuuaaccaccuugagaaaagaauugaaaaucugaacaagaaaguggacgauggcuuccucgacaucuggaccuacaaugccgagcugcugguccuccuggaaaacgagcggacccuugauuaucaugacagcaaugugaagaaccuguacgagaaaguccgcucucagcucaagaacaaugccaaggaaauugggaacggauguuucgaguucuaucacaaaugcgauaauacauguauggaauccgugaagaacggcaccuacgacuauccuaaauacagcgaggaagcuaagcugaauagagaggagaucgaugggguuaaacuugaaucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 187514 - RNA, 1701 nt, Artificial Sequence; identical to SEQ ID NO: 186857
  derived and/or modified sequence opt5 from hemagglutinin__InfluenzaA__ADE28991

SEQ ID NO: 187515 - RNA, 1701 nt, Artificial Sequence
  derived and/or modified sequence opt5 from hemagglutinin__InfluenzaA__ADE29001
augaaggccauccuggugguccuccuguacaccuucgcuacagccaacgcggacacgcuuugcauuggcuaucacgcuaauaacagcaccgauacaguugacaccgugcuggagagaaaugugacagucacccauuccgugaaccuccuggaagauaagcacaaugggaaacuuuguaagcugaagggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 187516 - RNA, 1701 nt, Artificial Sequence; identical to SEQ ID NO: 185935
  derived and/or modified sequence opt5 from hemagglutinin__InfluenzaA__ADE29011

SEQ ID NO: 187517 - RNA, 1701 nt, Artificial Sequence
  derived and/or modified sequence opt5 from hemagglutinin__InfluenzaA__ADE29021
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccggcucugacaacgggacgugcuauccgggagauuuuauugacuacgaagaacugcgggagcagcuuagcuccgucagcucuuucgaacgcuuugagaucuuccccaagaccuccagcuggccuaaucacgauucuaacaagggcgugacagccgcuuguccccaugccggcgcgaaauccuuuuauaagaaucugaucuggcucguuaaaaaggggaacagcuacccuaaacugucuaaguccuauauuaaugacaagggaaaagaagugcuuguccuguggggcauccaccaccccagcaccuccacagaucaacagucucucuaccagaacgccgacgcuuacgugagcguggggaccuccagauauagcaagaaauucaagccugagauugccauccggccgaaaguccgcgaucaggagggaagaaugaauuacuauuggacgcugguugaacccggcgacaagauuacauuugaggcuaccgggaaccugguggugccucgguacgccuucgcgauggaacgcaacgccggaucuggcaucauuaucuccgauacacccguccaugacugcaauaccaccugucaaacaccuaaaggcgcuaucaacacgagccuccccuuucagaauauucacccgaucaccauugggaagugcccuaaguaugugaaaucuacaaagcugagacuugccaccggacugcggaacguucccagcauccagucccgcggccucuucggggcuauugccggauuuaucgagggcggguggacaggaaugguggacggcugguacggcuaucaucaccagaaugaacaagggucuggauacgccgcugaucugaaaagcacccagaacgcgaucgacaagauuacgaauaaagucaacuccgugaucgagaagaugaauacacaguucaccgccguuggcaaggaguuuaaccaccuugagaaaagaauugagaaucugaacaagaaaguggaugacggguuccucgauaucuggaccuacaaugcugaacugcugguccuccuggagaacgaacggacacuugacuaucaugauagcaaugugaagaaccuguacgagaaaguccgcucucagcucaagaacaaugccaaggagauuggaaacggcuguuucgaauuuuaucacaaaugcgacaauaccuguauggaguccgugaagaacgggacauacgauuauccuaaauacagcgaagaggccaagcugaauagagaagagaucgacggcguuaaacuugagucuacgcggaucuaucaaauucuggcuaucuacuccaccguggccagcucccucguccuggugguuucucugggagcgauuagcuucuggaugugcuccaacggcucucuccagugccgcaucuguauuuga

SEQ ID NO: 187518 - RNA, 1701 nt, Artificial Sequence; identical to SEQ ID NO: 187342
  derived and/or modified sequence opt5 from hemagglutinin__InfluenzaA__ADE29031

SEQ ID NO: 187519 - RNA, 1701 nt, Artificial Sequence
  derived and/or modified sequence opt5 from hemagglutinin__InfluenzaA__ADE29041
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaaaagaacgcugggucuggaaucauuaucuccgauacccccguccaugacugcaauacaaccugucaaaccccuaagggcgccaucaacacaagccuccccuuccagaauauucacccgaucacgauuggcaagugcccuaaauaugugaagucuaccaaacugcgccuugcuacagggcugagaaacguucccagcauccagucccggggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaagucaacuccgugaucgagaagaugaauacgcaguuuacagcuguuggaaaggaguucaaccaccuugagaaacgcauugaaaaucugaacaagaaaguggaugacggcuuccucgauaucuggaccuacaaugccgagcugcugguccuccuggaaaacgagagaacccuugacuaucaugauagcaaugugaagaaccuguacgagaaaguccggucucagcucaagaacaaugccaaggaaauugggaacggauguuuugaguucuaucacaaaugcgacaauacauguauggaauccgugaagaacggcaccuacgauuauccuaaauacagcgaggaagcuaagcugaaucgcgaggagaucgacgggguuaaacuugaaucuacaagaaucuaucaaauucuggccaucuacuccacgguggcgagcucccucguccuggugguuucucugggcgcuauuagcuuuuggaugugcuccaacggaucucuccagugccggaucuguauuuga

SEQ ID NO: 187520 - RNA, 1701 nt, Artificial Sequence; identical to SEQ ID NO: 187342
  derived and/or modified sequence opt5 from hemagglutinin__InfluenzaA__ADE29051

SEQ ID NO: 187521 - RNA, 1701 nt, Artificial Sequence
  derived and/or modified sequence opt5 from hemagglutinin__InfluenzaA__ADE29085
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccccguccucugacaacggcacgugcuaucccggggauuuuauugacuacgaagaacugcgggagcagcuuagcuccgucagcucuuucgaacgcuuugagaucuucccuaagaccuccagcuggcccaaucacgauucuaacaagggagugacagccgcuuguccucaugccgaagcgaaauccuuuuauaagaaucugaucuggcucguuaaaaagggcaacagcuaccccaaacugucuaaguccuauauuaaugacaagggcaaagaggugcuuguccugugggggauccaccacccuagcaccuccgccgaucaacagucucucuaccagaacgcugacgccuacguguucgugggaagcuccagauauagcaagacauuuaaaccggagauugcuauccggcccaagguccgcgauagagaaggccggaugaauuacuauuggacccugguugagccuggggacaaaauuacguucgaagccacaggaaaccugguggugccccgcuacgcguuugccauggagagaaacgcuggcucugggaucauuaucuccgauaccccuguccaugacugcaauacaaccugucagacccccaagggagccaucaacacaagccucccguuccaaaauauucacccuaucacgauuggcaaaugccccaaguaugugaagucuaccaaacugcggcuugcuacaggccugcgcaacaucccuagcauucaguccagagggcucuuuggagccaucgccggcuucaucgaagggggauggaccggcaugguugacgggugguacggauaucaucaccagaaugagcagggcucuggcuacgcugcggaucuuaagagcacacaaaacgccauugacgagaucaccaauaaagugaacuccgucauugaaaagaugaauacgcaguuuacagcuguggggaaagaguucaaccaccuggaaaagcggaucgagaaucugaacaagaaaguugaugacggauuccucgauauuuggaccuacaaugccgaacugcuggugcuccuggagaacgagcgcacccuugacuaucaugauagcaaugucaagaaccuguacgaaaaagugagaucucagcucaagaacaaugccaaagagaucggcaacggguguuuugaguucuaucacaagugcgacaauacauguauggaguccgucaagaacggaaccuacgauuaucccaaauacagcgaagaggcuaagcugaaucgggaggaaaucgacggcgugaaacuugagucuacacgcauuuaucagauccuggccauuuacuccacgguugcgagcucccucgugcuggucgugucucugggggcuaucagcuuuuggaugugcuccaacggcucucuccaaugcagaauuuguaucuga

SEQ ID NO: 187522 - RNA, 1701 nt, Artificial Sequence
  derived and/or modified sequence opt5 from hemagglutinin__InfluenzaA__ADE29095
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccccguccucugacaacggcacgugcuaucccggggauuuuauugacuacgaagaacugcgggagcagcuuagcuccgucagcucuuucgaacgcuuugagaucuucccuaagaccuccagcuggcccaaucacgauucuaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcagcuccagauauagcaagacauuuaaaccggagauugcuauccggcccaagguccgcgauagagaggggcggaugaauuacuauuggacccugguugaaccuggagacaaaauuacguucgaggccacaggcaaccugguggugccccgcuacgcguuugccauggaaagaaacgcugggucuggaaucauuaucuccgauaccccuguccaugacugcaauacaaccugucagacccccaagggcgccaucaacacaagccucccguuccaaaauauucacccuaucacgauuggcaaaugccccaaguaugugaagucuaccaaacugcggcuugcuacagggcugcgcaacaucccuagcauucaguccagaggacucuuuggcgccaucgccggguucaucgagggaggcuggaccgggaugguugacggaugguacggcuaucaucaccagaaugaacagggcucuggguacgcugcggaucuuaagagcacacaaaacgccauugacgagaucaccaauaaagugaacuccgucauugagaagaugaauacgcaguuuacagcugugggaaaagaguucaaccaccuggagaagcggaucgaaaaucugaacaagaaaguugaugacggcuuccucgauauuuggaccuacaaugccgagcugcuggugcuccuggaaaacgagcgcacccuugacuaucaugauagcaaugucaagaaccuguacgagaaagugagaucucagcucaagaacaaugccaaagaaaucgggaacggauguuuugaguucuaucacaagugcgacaauacauguauggaauccgucaagaacggcaccuacgauuaucccaaauacagcgaggaagcuaagcugaaucgggaggagaucgacggggugaaacuugaaucuacacgcauuuaucagauccuggccauuuacuccacgguugcgagcucccucgugcuggucgugucucugggcgcuaucagcuuuuggaugugcuccaacggaucucuccaaugcagaauuuguaucuga

SEQ ID NO: 187523 - RNA, 1701 nt, Artificial Sequence; identical to SEQ ID NO: 186612
  derived and/or modified sequence opt5 from hemagglutinin__InfluenzaA__ADE34191

SEQ ID NO: 187524 - RNA, 1701 nt, Artificial Sequence; identical to SEQ ID NO: 186612
  derived and/or modified sequence opt5 from hemagglutinin__InfluenzaA__ADE34202

SEQ ID NO: 187525 - RNA, 1701 nt, Artificial Sequence
  derived and/or modified sequence opt5 from hemagglutinin__InfluenzaA__ADE34213
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagacggaaagccuauagcaauuguuacccuuaugacgugcccgauuacgcuucccuccgcucucugguugccagcuccgggacgcuugaauuuaacaaugagagcuucaacuggaccggagugacacagaauggcaccucuuccgcuugcaucagacggagcaacaauuccuuuuucucucgccugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccagcggaagaauuacaguuucuaccaagcggucccagcagacagugaucccgaacauuggcagccgccccagaguccggaauaucccuucccgcaucucuauuuacuggaccaucgugaaacccggggauauucugcugaucaacagcaccggaaaucucauugcuccuagaggcuacuucaagauccgguccgggaaaagcucuaucaugcgcuccgacgcccccauuggaaaguguaacagcgaaugcaucacaccgaauggcucuauuccuaacgacaagcccuuucagaaugugaacagaaucacguauggcgcuuguccucgguacgucaaacaaaauacccugaaacuugccacagggaugcgcaacguucccgagaagcagaccagaggaauuuucggcgcgaucgccggguuuaucgaaaauggaugggagggcaugguggaugggugguauggauuccggcaccagaacagcgagggcagaggccaagcugccgaccugaaguccacacaggcugccauugaucagaucaaugggaaacucaaccgccugauuggaaagaccaacgaaaaauuccaccagaucgagaaggaauuuucugagguggaaggccggauucaagaccuugagaaguacgucgaggauacgaaaaucgaccuguggagcuauaaugccgaacuccugguggcucuggagaaccagcauacaauugaucucaccgacuccgaaaugaauaagcuguucgagaaaaccaagaaacagcuuagagaaaacgcggaggauauggggaauggaugcuuuaagaucuaccacaagugugacaacgccugcaucggcagcauucgcaaugggacauaugaucaugacguuuaccgggacgaggcucugaacaauagauuccagaucaaaggcguggaacucaagucuggauacaaagauuggauucuguggaucuccuuugccauuagcugcuuccuucugugugucgcccuccugggcuuuaucaugugggcuugccaaaaggggaacauccgcuguaauauuugcaucuga

SEQ ID NO: 187526 - RNA, 1701 nt, Artificial Sequence; identical to SEQ ID NO: 186612
  derived and/or modified sequence opt5 from hemagglutinin__InfluenzaA__ADE34224

SEQ ID NO: 187527 - RNA, 1701 nt, Artificial Sequence
  derived and/or modified sequence opt5 from hemagglutinin__InfluenzaA__ADE34235
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacaggacggcaccuccagcgcuugcauccgcagaucuaaaaauuccuuuuucagccggcugaacuggcucacacaucugaauuuuaaauauccugcccuuaacgucaccaugcccaauaacgagcaguucgauaagcuguacauuuggggcgugcaccauccugggacggacaaagaucagaucuuucucuaugcgcaagccucuggacgcacaaccguuuccacaaagagaagccagcagaccgcuauuccgaacaucggcucccggccccgcgugagaaauauuccuucucggaucagcaucuacuggaccauugucaaacccggggacauccugcugauuaacuccacaggaaaucucaucgccccucgcggcuacuucaagauuagaagcgggaagucuuccaucaugcggagcgacgcucccaucggaaaauguaacucugagugcauuacgccgaauggcagcaucccuaacgauaagcccuuucagaaugugaaccgcauuaccuauggcgccuguccuagauacgugaaacaaaauacacugaaacuugcgaccgggaugcggaacguccccgaaaagcagacacgcggaaucuucggcgccauugcuggguuuaucgagaauggaugggaaggcaugguugacgggugguauggauucagacaccagaacuccgagggccggggccaagccgcugaucugaagucuacccaggccgccaucgaccagauuaaugggaaacucaacagacugaucggaaagacgaaugagaaguuccaccagauugaaaaagaguuuagcgaaguggagggccgcauccaagaucuugaaaaguacguggaggacacaaaaauugaucugugguccuauaacgcugagcuccuggucgcgcuggaaaaccagcauaccaucgaccucaccgauagcgagaugaauaagcuguucgaaaagacaaagaagcagcuucgggagaacgccgaagacauggggaauggaugcuuuaaaauuuaccacaagugugauaacgcuugcaucggcucuaucagaaaugggaccuaugaccaugacguguaccgcgaugaggcccugaacaaucgguuccagauuaaaggcguugagcucaaguccggauacaaagacuggauccuguggauuagcuuugccaucucuugcuuccuucuguguguggcucuccugggcuuuauuaugugggccugccaaaaggggaacaucagauguaauaucugcauuuga

SEQ ID NO: 187528 - RNA, 1701 nt, Artificial Sequence; identical to SEQ ID NO: 186612
  derived and/or modified sequence opt5 from hemagglutinin__InfluenzaA__ADE34246

SEQ ID NO: 187529 - RNA, 1701 nt, Artificial Sequence; identical to SEQ ID NO: 186637
  derived and/or modified sequence opt5 from hemagglutinin__InfluenzaA__ADE34257

SEQ ID NO: 187530 - RNA, 1701 nt, Artificial Sequence
  derived and/or modified sequence opt5 from hemagglutinin__InfluenzaA__ADE34268
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugaggugcccgacuacgcuucucuccggagccugguugccuccagcgggacgcuugaauuuaacaaugagucuuucaacuggaccggagugacacaggauggcaccuccagcgcuugcauccgcagaucuaaaaauuccuuuuucagccggcugaacuggcucacacaucugaauuuuaaguauccugcccuuaacgucaccaugcccaauaacgagcaguucgacaagcuguacauuuggggcgugcaccauccugggacggauaaagaccagaucuuucucuaugcgcaagccucuggacgcauuacaguuuccaccaagagaagccagcagacagcuaucccgaacauuggcucccggccccgcgugagaaauaucccuucucggaucagcauuuacuggaccaucgucaaacccggggauauucugcugaucaacuccaccggaaaucucauugccccucgcggcuacuucaagaucagaagcgggaagucuuccaucaugcggagcgacgcucccauuggaaaauguaacucugaaugcaucacaccgaauggcagcauuccuaacgacaagcccuuucagaaugugaaccgcaucacguauggcgccuguccuagauacgugaaacaaaauacccugaaacuugcgacagggaugcggaacguccccgagaagcagacccgcggaauuuucggcgccaucgcuggguuuaucgaaaauggaugggagggcaugguugaugggugguauggauucagacaccagaacuccgagggccggggccaagccgcugaccugaagucuacacaggccgccauugaucagaucaaugggaaacucaacagacugauuggaaagaccaaugaaaaguuccaccagaucgagaaagaauuuagcgagguggaaggccgcauucaagaccuugagaaguacguggaggauacgaaaaucgaccugugguccuauaacgcugaacuccuggucgcgcuggagaaccagcauacaauugaucucaccgacagcgaaaugaauaagcuguucgagaaaaccaagaagcagcuucgggaaaacgccgaggauauggggaauggaugcuuuaaaaucuaccacaagugugacaacgcuugcaucggcucuauuagaaaugggacauaugaucaugacguguaccgcgacgaggcccugaacaaucgguuccagaucaaaggcguugaacucaaguccggauacaaagauuggauucuguggaucagcuuugccauuucuugcuuccuucuguguguggcucuccugggcuuuaucaugugggccugccaaaaggggaacaucagauguaauauuugcaucuga

SEQ ID NO: 187531 - RNA, 1701 nt, Artificial Sequence
  derived and/or modified sequence opt5 from hemagglutinin__InfluenzaA__ADE45499
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucaagcgcuuugaaaucuuccccaagaccagcucuuggccuaaucacgaucccaacaaaggagugacagccgcuuguccucaugccggcgcgaaguccuuuuauaaaaaucugaucuggcucguuaagaaaggcaacagcuaccccaagcugucuaaguccuauauuaaugacaaagggaaggaggugcuuguccuguggggaauccaccacccuagcaccuccgccgaucaacagucucucuaccagaacgcugacgccuacguguucgugggcacaagcagauauuccaaaaaguuuaaaccggaaauugcuauccggcccaagguccgcgaucaggaggggagaaugaauuacuauuggacccugguugagccuggagacaaaauuacguucgaagccacaggcaaccugguggugccccgguacgcguuugccauggagcgcaacgcugggagcggaaucauuaucucugauaccccuguccaugacugcaauacaaccugucaaacccccaagggcgccaucaacacaucccucccguuccagaauauucacccuaucacgauuggcaagugccccaaauaugugaaaagcaccaaacugagacuugcuacagggcugcggaacguuccuucuauccagagccgcggacucuuuggcgccauugccggguucaucgaaggaggcuggaccgggaugguggacggaugguacggcuaucaucaccagaaugagcaaggcuccggguacgcugcggaucugaagucuacacagaacgccaucgacgaaauuaccaauaaagucaacagcgugaucgagaagaugaauacgcaguuuacagcuguuggaaaggaguucaaccaccuugaaaagagaauugagaaucugaacaagaaaguggaugacggcuuccucgauaucuggaccuacaaugccgaacugcugguccuccuggagaacgaacggacccuugacuaucaugauuccaaugugaagaaccuguacgagaaaguccgcagccagcucaagaacaaugccaaggagauugggaacggauguuuugaguucuaucacaaaugcgacaauacauguauggagucugugaagaacggcaccuacgauuaucccaaauacuccgaagaggcuaagcugaauagagaagagaucgacgggguuaaacuugagagcacacggaucuaucaaauucuggccaucuacucuacgguggcguccagccucguccuggugguuucccugggcgcuauuucuuuuuggaugugcagcaacggaucccuccagugccgcaucuguauuuga

SEQ ID NO: 187532 - RNA, 1701 nt, Artificial Sequence; identical to SEQ ID NO: 186491
  derived and/or modified sequence opt5 from hemagglutinin__InfluenzaA__ADE45501

SEQ ID NO: 187533 - RNA, 1701 nt, Artificial Sequence
  derived and/or modified sequence opt5 from hemagglutinin__InfluenzaA__ADE45503
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcagauauuccaagaaauuuaagccggagauugcuauccggcccaaaguccgcgaucaggaggggagaaugaauuacuauuggacccugguugaaccuggagacaagauuacguucgaggccacaggcaaccugguggugccccgguacgcguuugccauggaacgcaacgcugggagcggaaucauuaucucugauaccccuguccaugacugcaauacaaccugucaaacccccaaaggcgccaucaacacaucccucccguuccagaauauucacccuaucacgauuggcaagugccccaaguaugugaaaagcaccaagcugagacuugcuacagggcugcggaacguuccuucuauccagagccgcggacucuuuggcgccauugccggguucaucgagggaggcuggaccgggaugguggacggaugguacggcuaucaucaccagaaugaacaaggcuccggguacgcugcggaucugaaaucuacacagaacgccaucgacgagauuaccaauaaggucaacagcgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauuccaaugugaaaaaccuguacgagaagguccgcagccagcucaaaaacaaugccaaggaaauugggaacggauguuuugaguucuaucacaagugcgacaauacauguauggaaucugugaaaaacggcaccuacgauuaucccaaguacuccgaggaagcuaaacugaauagagaggagaucgacgggguuaaacuugaaagcacacggguguaucaaauccuggccauuuacucuacggucgcguccagccucgugcugguugugucccugggcgcuaucucuuuuuggaugugcagcaacggaucccuccagugccgcauuuguaucuga

SEQ ID NO: 187534 - RNA, 1701 nt, Artificial Sequence; identical to SEQ ID NO: 185693
  derived and/or modified sequence opt5 from hemagglutinin__InfluenzaA__ADE45505

SEQ ID NO: 187535 - RNA, 1701 nt, Artificial Sequence; identical to SEQ ID NO: 186046
  derived and/or modified sequence opt5 from hemagglutinin__InfluenzaA__ADE45507

SEQ ID NO: 187536 - RNA, 1701 nt, Artificial Sequence; identical to SEQ ID NO: 186046
  derived and/or modified sequence opt5 from hemagglutinin__InfluenzaA__ADE45509

SEQ ID NO: 187537 - RNA, 1701 nt, Artificial Sequence; identical to SEQ ID NO: 186491
  derived and/or modified sequence opt5 from hemagglutinin__InfluenzaA__ADE45511

SEQ ID NO: 187538 - RNA, 1701 nt, Artificial Sequence
  derived and/or modified sequence opt5 from hemagglutinin__InfluenzaA__ADE45513
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugccccucuccaucugggcaaaugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacgcuuucgugggcacaagcagauauuccaagaaauuuaagccggagauugccauccggcccaaagugcgcgaucaggaggggagaauuaauuacuauuggacccuggucgaaccuggagacaagaucauuuucgaggcgacgggcaaccugguugugccccgguacgccuuugcuauggaacgcaacgccgggagcggaaucaucauuucugauacacccgcucaugacugcaauaccacaugucaaacccccaaaggcgccaucaacaccucccucccguuccagaauauucacccuaucacaauuggcaagugccccaaguaugugaaaagcacgaagcugagacuugccaccgggcugcggaacgucccuucuauccagagccgcggacucuuuggcgcuaucgcgggguucauugagggaggcuggacagggaugguggacggaugguacggcuaucaucaccagaaugaacaaggcuccggguacgccgcugaucugaaaucuacccagaacgccaucgacgagauuacaaauaagguuaacagcgugaucgagaaaaugaauacccaguuuacggccgucggaaaggaguucaaccaccuugagaagagaauugaaaaucugaacaaaaagguggaugacggcuuccucgauaucuggacauacaaugcugagcugcugguucuccuggaaaacgagcggacccuugacuaucaugauuccaaugugaaaaaccuguacgagaagguccgcagccagcucaaaaacaaugccaaggaaaucgggaacggauguuuugaguucuaucacaagugcgacaauaccuguauggaaucugugaaaaacggcacauacgauuaucccaaguacuccgaggaagcgaaacugaauagagaggagauugacggggucaaacuugaaagcacccggaucuaucaaauucuggcuaucuacucuacaguggccuccagccucguucugguggucucccugggcgccauuucuuuuuggaugugcagcaacggaucccuccagugccgcaucuguauuuga

SEQ ID NO: 187539 - RNA, 1701 nt, Artificial Sequence
  derived and/or modified sequence opt5 from hemagglutinin__InfluenzaA__ADE75388
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgaaaacggcacgugcuauccgggggacuuuauugauuacgaggagcugcgggaacagcuuuccagcgucucuuccuucgagcgcuuugaaaucuuccccaagaccagcucuuggccuaaucacgacuccaacaagggagugacagccgcuuguccccaugccggcgcgaaaucuuuuuauaagaaucugaucuggcucguuaaaaagggcaacagcuacccuaaacuguccaagagcuauauuaaugauaaggggaaagaggugcuuguccuguggggaauccaccaccccuccaccucugccgaccaacagagccucuaccagaacgcugaugccuacguguucgugggcacauccagauauagcaagaaauuuaagccugagauugcuauccggccgaaaguccgcgaccaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaccugaaaagcacacagaacgccaucgaugagauuaccaauaaggucaacuccgugaucgaaaagaugaauacgcaguuuacagcuguuggaaaggaguucaaccaccuugaaaagagaauugagaaucugaacaaaaagguggacgauggcuuccucgacaucuggaccuacaaugccgaacugcugguccuccuggagaacgagcggacccuugauuaucaugacagcaaugugaaaaaccuguacgaaaagguccgcucucagcucaaaaacaaugccaaggagauugggaacggauguuuugaguucuaucacaagugcgauaauacauguauggaauccgugaaaaacggcaccuacgacuauccuaaguacagcgaagaggcuaaacugaauagagaggaaaucgaugggguuaaacuugagucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 187540 - RNA, 1701 nt, Artificial Sequence; identical to SEQ ID NO: 185693
  derived and/or modified sequence opt5 from hemagglutinin__InfluenzaA__ADE75390

SEQ ID NO: 187541 - RNA, 1701 nt, Artificial Sequence; identical to SEQ ID NO: 185693
  derived and/or modified sequence opt5 from hemagglutinin__InfluenzaA__ADF10067

SEQ ID NO: 187542 - RNA, 1701 nt, Artificial Sequence; identical to SEQ ID NO: 185693
  derived and/or modified sequence opt5 from hemagglutinin__InfluenzaA__ADF10077

SEQ ID NO: 187543 - RNA, 1701 nt, Artificial Sequence
  derived and/or modified sequence opt5 from hemagglutinin__InfluenzaA__ADF10087
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccaugaaacgcaacgcugggucuggaaucauuaucuccgauacccccguccaugacugcaauacaaccugucaaaccccuaagggcgccaucaacacaagccuccccuuccagaauauucacccgaucacgauuggcaagugcccuaaauaugugaagucuaccaaacugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaucugaaaagcacacagaacgccaucgacgaaauuaccaauaaagucaacuccgugaucgagaagaugaauacgcaguuuacagcuguuggaaaggaguucaaccaccuugaaaagagaauugagaaucugaacaagaaaguggaugacggcuuccucgauaucuggaccuacaaugccgaacugcugguccuccuggagaacgaacggacccuugacuaucaugauagcaaugugaagaaccuguacgagaaaguccgcaaccagcucaagaauaacgccaaggagauugggaauggauguuuugaguucuaucacaaaugcgacaacacauguauggagucugugaagaauggcaccuacgauuauccuaaauacuccgaagaggcuaagcugaacagagaagagaucgacgggguuaaacuugagagcacacggaucuaucaaauucuggccaucuacucuacgguggcguccagccucguccuggugguuucccugggcgcuauuucuuuuuggaugugcagcaauggaucccuccagugccgcaucuguauuuga

SEQ ID NO: 187544 - RNA, 1701 nt, Artificial Sequence
  derived and/or modified sequence opt5 from hemagglutinin__InfluenzaA__ADF10097
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaaacugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagagccucuaccagaacgcugacgccuacguguucgugggcuccagcaaauauucuaagaaauuuaagccugagauugcuaucagaccgaaaguccgggaucaggaagggcgcaugaauuacuauuggacacugguugagcccggagacaagauuaccuucgaagccacgggcaaccugguggugccuagauacgcguuugccauggagcggaacgcuggguccggaaucauuaucagcgauacacccguccaugacugcaauaccacaugucaaaccccuaaaggcgccaucaacaccucucuccccuuccacaauauucauccgaucacaauuggcaagugcccuaaguaugugaaaagcacgaagcugcgccuugcuaccgggcugagaaacguucccuccauccagucucggggacucuuuggcgccauugccggguucaucgaaggaggcuggacagggaugguggacggaugguacggcuaucaccaccagaaugagcagggcagcggguacgcugcggaucugaaauccacccaaaacgccaucgacgagauuacaaauaaggucaacagcgugaucgaaaagaugaauacccaguuuacggcuguuggaaaggaguucaaccaucuugaaaagcgcauugagaaucugaacaaaaagguggaugacggcuuccucgauaucuggacauacaaugccgaacugcugguccuccuggagaacgagagaacccuugacuaucacgauucuaaugugaaaaaccuguacgaaaagguccggucccagcucaaaaacaaugccaaggagauugggaacggauguuuugaguucuaucauaagugcgacaauaccuguauggaaagcgugaaaaacggcacauacgauuauccuaaguacucugaagaggcuaaacugaaucgcgaggaaaucgacgggguuaaacuugaguccaccaagaucuaucagauucuggccaucuacagcacaguggcguccucucucguccuggugguuagccugggcgcuauuuccuuuuggaugugcucuaacggaagccuccaaugcagaaucuguauuuga

SEQ ID NO: 187545 - RNA, 1701 nt, Artificial Sequence
  derived and/or modified sequence opt5 from hemagglutinin__InfluenzaA__ADF10107
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaaacugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccacccuccuaccuccgccgaucaacagucucucuaccagaacgcugacgccuacguguucgugggcagcuccaaauauagcaagaaauuuaagccggagauugcuaucagacccaaaguccgggaucaggaagggcgcaugaauuacuauuggacacugguugagccuggagacaagauuaccuucgaagccacgggcaaccugguggugcccagauacgcguuugccauggagcggaacgcugggucuggaaucauuaucuccgauacacccgcccaugacugcaauaccacaugucaaacccccaaaggcgcuaucaacaccagccucccguuccacaauauucauccuaucacaauuggcaagugccccaaguaugucaaaucuacgaagcugcgccuugccaccgggcugagaaacgugccuagcauccagucccggggacucuuuggcgccauugcuggguucaucgaaggaggcuggacagggaugguugacggaugguacggcuaucaccaccagaaugagcagggcucuggguacgcggccgaucugaaaagcacccaaaacgcuaucgacgagauuacaaauaaggugaacuccgucaucgaaaagaugaauacccaguuuacggccgugggaaaggaguucaaccaucuugaaaagcgcauugagaaucugaacaaaaagguugaugacggcuuccucgauaucuggacauacaaugccgaacugcuggugcuccuggagaacgagagaacccuugacuaucacgauagcaaugucaaaaaccuguacgaaaaggugcggucucagcucaaaaacaaugcuaaggagauugggaacggauguuuugaguucuaucauaagugcgacaauaccuguauggaauccgucaaaaacggcacauacgauuaucccaaguacagcgaagaggccaaacugaaucgcgaggaaaucgacggggugaaacuugagucuaccaagaucuaucagauucuggcgaucuacuccacaguugcuagcucccucgugcuggucgugucucugggcgccauuagcuuuuggaugugcuccaacggaucucuccaaugcagaaucuguauuuga

SEQ ID NO: 187546 - RNA, 1701 nt, Artificial Sequence; identical to SEQ ID NO: 185693
  derived and/or modified sequence opt5 from hemagglutinin__InfluenzaA__ADF10117

SEQ ID NO: 187547 - RNA, 1701 nt, Artificial Sequence; identical to SEQ ID NO: 187397
  derived and/or modified sequence opt5 from hemagglutinin__InfluenzaA__ADF10127

SEQ ID NO: 187548 - RNA, 1701 nt, Artificial Sequence; identical to SEQ ID NO: 185693
  derived and/or modified sequence opt5 from hemagglutinin__InfluenzaA__ADF10137

SEQ ID NO: 187549 - RNA, 1701 nt, Artificial Sequence
  derived and/or modified sequence opt5 from hemagglutinin__InfluenzaA__ADF10154
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccugaucacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgagcaggaagggagaaugaacuacuauuggacccugguugagcccggagacaagauuacguucgaagccacaggcaaucugguggugccucgguacgcguuugccauggagcgcaacgcugggucuggaaucauuaucuccgauacccccguccaugacugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgaaggaggcuggaccgggaugguggacggaugguacggcuaucaucaccagaacgagcaaggcucuggguacgcugcggaucugaaaagcacacagaaugccaucgacgagauuaccaacaaggucaauuccgugaucgagaaaaugaacacgcaguuuacagcuguuggaaaggaguucaaucaccuugaaaagagaauugagaaccugaauaaaaagguggaugacggcuuccucgauaucuggaccuacaacgccgaacugcugguccuccuggagaaugagcggacccuugacuaucaugauagcaacgugaaaaaucuguacgaacgcgucagaucucagcucaagaacaacgccaaagagauugggaauggauguuuugaguucuaucacaagugcgacaacacauguauggaauccgugaagaauggcaccuacgauuauccuaaauacagcgaagaggcuaagcugaaccgggaggaaaucgacgggguuaaacuugagucuacacgcaucuaucaaauucuggccaucuacuccacgguggcgagcucccucguccuggugguuucucugggcgcuauuagcuuuuggaugugcuccaauggaucucuccagugcagaaucuguauuuga

SEQ ID NO: 187550 - RNA, 1701 nt, Artificial Sequence
  derived and/or modified sequence opt5 from hemagglutinin__InfluenzaA__ADF10174
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaccugaaaagcacacagaacgccaucgaugagauuaccaauaaggucaacuccgugaucgagaaaaugaauacgcaguuuacagcuguuggaaaggaguucaaccaccuugaaaagagaauugagaaucugaacaaaaagguggacgauggcuuccucgacaucuggaccuacaaugccgaacugcugguccuccuggagaacgagcggacccuugauuaucaugacagcaaugugaaaaaccuguacgaacgcgucagaucucagcucaagaacaaugccaaagagauugggaacggauguuuugaguucuaucacaagugcgauaauacauguauggaauccgugaagaacggcaccuacgacuauccuaaauacagcgaagaggcuaagcugaaucgggaggaaaucgaugggguuaaacuugagucuacacgcaucuaucaaauucuggccaucuacuccacgguggcgagcucccucguccuggugguuucucugggcgcuauuagcuuuuggaugugcuccaacggaucucuccagugcagaaucuguauuuga

SEQ ID NO: 187551 - RNA, 1701 nt, Artificial Sequence; identical to SEQ ID NO: 187550
  derived and/or modified sequence opt5 from hemagglutinin__InfluenzaA__ADF10190

SEQ ID NO: 187552 - RNA, 1701 nt, Artificial Sequence; identical to SEQ ID NO: 187397
  derived and/or modified sequence opt5 from hemagglutinin__InfluenzaA__ADF10237

SEQ ID NO: 187553 - RNA, 1701 nt, Artificial Sequence; identical to SEQ ID NO: 187550
  derived and/or modified sequence opt5 from hemagglutinin__InfluenzaA__ADF10262

SEQ ID NO: 187554 - RNA, 1701 nt, Artificial Sequence
  derived and/or modified sequence opt5 from hemagglutinin__InfluenzaA__ADF10288
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaccugaaaagcacacagaacgccaucgaugagauuaccaauaaggucaacuccgugaucgagaaaaugaauacgcaguuuacagcuguuggaaaggaguucaaccaccuugaaaagagaauugagaaucugaacaaaaagguggacgauggcuuccucgacaucuggaccuacaaugccgaacugcugguccuccuggagaacgagcggacccuugauuaucaugacagcaaugugaaaaaccuguacgaacgcgucagaucucagcucaagaacaaugccaaagagauugggaacggauguuuugaguucuaucacaagugcgauaauacauguauggaauccgugaagaacggcaccuacgacuauccuaaauacagcgaagaggcuaagcugaaucgggaggaaaucgaugggguuaaacuugagucuacacgcaucuaucaaauucuggccaucuacuccacgguggcgagcucccucguccuggugguuucucugggcgcuauuagcuuuuggaugugcuccaacggaucucuccagugcagaguguguaucuga

SEQ ID NO: 187555 - RNA, 1701 nt, Artificial Sequence; identical to SEQ ID NO: 187397
  derived and/or modified sequence opt5 from hemagglutinin__InfluenzaA__ADF10302

SEQ ID NO: 187556 - RNA, 1701 nt, Artificial Sequence; identical to SEQ ID NO: 187397
  derived and/or modified sequence opt5 from hemagglutinin__InfluenzaA__ADF10335

SEQ ID NO: 187557 - RNA, 1701 nt, Artificial Sequence; identical to SEQ ID NO: 187397
  derived and/or modified sequence opt5 from hemagglutinin__InfluenzaA__ADF10359

SEQ ID NO: 187558 - RNA, 1701 nt, Artificial Sequence; identical to SEQ ID NO: 187550
  derived and/or modified sequence opt5 from hemagglutinin__InfluenzaA__ADF10369

SEQ ID NO: 187559 - RNA, 1701 nt, Artificial Sequence; identical to SEQ ID NO: 187550
  derived and/or modified sequence opt5 from hemagglutinin__InfluenzaA__ADF10390

SEQ ID NO: 187560 - RNA, 1701 nt, Artificial Sequence; identical to SEQ ID NO: 187397
  derived and/or modified sequence opt5 from hemagglutinin__InfluenzaA__ADF10528

SEQ ID NO: 187561 - RNA, 1701 nt, Artificial Sequence; identical to SEQ ID NO: 187550
  derived and/or modified sequence opt5 from hemagglutinin__InfluenzaA__ADF10598

SEQ ID NO: 187562 - RNA, 1701 nt, Artificial Sequence; identical to SEQ ID NO: 187550
  derived and/or modified sequence opt5 from hemagglutinin__InfluenzaA__ADF10670

SEQ ID NO: 187563 - RNA, 1701 nt, Artificial Sequence; identical to SEQ ID NO: 187550
  derived and/or modified sequence opt5 from hemagglutinin__InfluenzaA__ADF10724

SEQ ID NO: 187564 - RNA, 1701 nt, Artificial Sequence; identical to SEQ ID NO: 187397
  derived and/or modified sequence opt5 from hemagglutinin__InfluenzaA__ADF10757

SEQ ID NO: 187565 - RNA, 1701 nt, Artificial Sequence
  derived and/or modified sequence opt5 from hemagglutinin__InfluenzaA__ADF10828
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucuacagaucaacagagccucuaccagaacgccgacgcuuacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacaagauuacgaauaaagucaacuccgugaucgagaagaugaauacacaguuuaccgccguuggaaaggaguucaaccaccuugagaaaagaauugagaaucugaacaagaaaguggaugacggcuuccucgauaucuggaccuacaaugcugaacugcugguccuccuggagaacgaacggacacuugacuaucaugauagcaaugugaagaaccuguacgagaaaguccgcucucagcucaagaacaaugccaaggagauugggaacggauguuuugaguucuaucacaaaugcgacaauaccuguauggaauccgugaagaacggcacauacgauuauccuaaauacagcgaagaggccaagcugaauagagaagagaucgacgggguuaaacuugagucuacgcggaucuaucaaauucuggcuaucuacuccaccguggccagcucccucguccuggugguuucucugggcgcgauuagcuuuuggaugugcuccaacggaucucuccagugccgcaucuguauuuga

SEQ ID NO: 187566 - RNA, 1701 nt, Artificial Sequence; identical to SEQ ID NO: 185693
  derived and/or modified sequence opt5 from hemagglutinin__InfluenzaA__ADF10874

SEQ ID NO: 187567 - RNA, 1701 nt, Artificial Sequence; identical to SEQ ID NO: 186316
  derived and/or modified sequence opt5 from hemagglutinin__InfluenzaA__ADF10929

SEQ ID NO: 187568 - RNA, 1701 nt, Artificial Sequence; identical to SEQ ID NO: 186316
  derived and/or modified sequence opt5 from hemagglutinin__InfluenzaA__ADF10996

SEQ ID NO: 187569 - RNA, 1701 nt, Artificial Sequence; identical to SEQ ID NO: 185693
  derived and/or modified sequence opt5 from hemagglutinin__InfluenzaA__ADF27367

SEQ ID NO: 187570 - RNA, 1701 nt, Artificial Sequence; identical to SEQ ID NO: 185693
  derived and/or modified sequence opt5 from hemagglutinin__InfluenzaA__ADF27369

SEQ ID NO: 187571 - RNA, 1701 nt, Artificial Sequence
  derived and/or modified sequence opt5 from hemagglutinin__InfluenzaA__ADF27370
augaaggccauccuggugauucuccuguacaccuucgcuacagccaacgcggacacgcuuugcaucggcuaucacgcuaauaacagcaccgauacagucgacaccguucuggagaaaaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaggaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccaagagcuauaucaaugacaaggggaaagaaguucuugugcuguggggcauucaccaccccuccaccucugccgaucaacagagccucuaccagaacgcugacgccuacguccuggugggaacauccagauauagcaagaaauucaagccugagaucgcuauucggccgaaagugcgcgaucaggaggggagaaugaauuacuauuggacccuggucgaacccggagacaagaucacguuugaggccacaggcaaccucguugugccucgguacgcguucgccauggaacgcaacgcugggucuggaauuaucaucuccgauacccccgugcaugacugcaauacaaccugucaaaccccuaaaggcgccauuaacacaagccugcccuuucagaauauccacccgauuacgaucggcaagugcccuaaguaugucaaaucuaccaaacuuagacuggcuacagggcuccggaacgugcccagcauucagucccgcggacuguucggcgccaucgccggguuuaucgagggaggcuggaccgggaugguugacggaugguacggcuaucaucaccagaaugaacaaggcucuggguacgcugcggaucuuaaaagcacacagaacgccauugacaagaucaccaauaaagugaacuccgucauugagaagaugaauacgcaguucacagcugugggaaaggaguuuaaccaccuggaaaagagaaucgagaaucucaacaagaaaguugaugacggcuuccuggauauuuggaccuacaaugccgaacugcucgugcugcuugagaacgaacggacccuggacuaucaugauagcaaugucaagaaccucuacgagaaagugcgcucucagcugaagaacaaugccaaggagaucgggaacggauguuucgaauuuuaucacaaaugcgacaauacauguauggaguccgucaagaacggcaccuacgauuauccuaaauacagcgaagaggcuaaacuuaauagagaagagaucgacggggugaagcuggagucuacacggauuuaucaaauccucgccauuuacuccacgguugcgagcucccuggugcuggucgugucucucggcgcuaucagcuucuggaugugcuccaacggaucucugcagugccgcauuuguaucuga

SEQ ID NO: 187572 - RNA, 1701 nt, Artificial Sequence; identical to SEQ ID NO: 186865
  derived and/or modified sequence opt5 from hemagglutinin__InfluenzaA__ADF27371

SEQ ID NO: 187573 - RNA, 1701 nt, Artificial Sequence
  derived and/or modified sequence opt5 from hemagglutinin__InfluenzaA__ADF27372
augaaggccauccuggugguccuccuguacaccuucgcuacagccaacgcggacacgcuuugcauuggcuaucacaccaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaaaaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacaagauuacgaauaaagucaacuccgugaucgagaagaugaauacacaguuuaccgccguuggaaaggaguucaaccaccuugagaaaagaauugagaaucugaacaagaaaguggaugacggcuuccucgauaucuggaccuacaaugcugaacugcugguccuccuggagaacgaacggacacuugacuaucaugauagcaaugugaagaaccuguacgagaaaguccgcucucagcucaagaacaaugccaaggagauugggaacggauguuuugaguucuaucacaaaugcgacaauaccuguauggaauccgugaagaacggcacauacgauuauccuaaauacagcgaagaggccaagcugaauagagaagagaucgacgggguuaaacuugagucuacgcggaucuaucaaauucuggcuaucuacuccaccguggccagcucccucguccuggugguuucucugggcgcgauuagcuuuuggaugugcuccaacggaucucuccagugccgcaucuguauuuga

SEQ ID NO: 187574 - RNA, 1701 nt, Artificial Sequence
  derived and/or modified sequence opt5 from hemagglutinin__InfluenzaA__ADF27373
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaagcuguguaaacugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugaucgaacagcuuuccagcgucucuuccuucgagcgguuugaaaucuuccccaaaaccagcucuuggccuaaucacgauuccaacaagggagugacagccgcuuguccccaugccggcgccaagagcuuuuauaaaaaucugauuuggcucguuaagaaaggcaacucuuacccuaagcuguccaaaagcuauaucaaugacaaggggaaggaggugcuuguccuguggggcauucaccaccccuccaccucugccgaucaacagagccucuaccagaacgcugacgccuacguguucgugggauccagccgcuauucuaaaaaguuuaaaccugagaucgcuauuagaccgaagguccgggaucaggaagggcgcaugaauuacuauuggacacugguugagcccggagacaaaaucaccuucgaagccacgggcaaccugguggugccuagauacgcguuugccauggagcggaacgcuggguccggaauuaucaucagcgauacacccguccaugacugcaauaccacaugucaaaccccuaagggcgccauuaacaccucucuccccuuccacaauauccauccgauuacaaucggcaaaugcccuaaguauguuaagagcacgaaacugcgccuugcuaccgggcugagaaacgugcccuccauucagacacggggacucuuuggcgccaucgccggguucaucgaaggaggcuggaccgggaugguggacggaugguacggcuaucaccaccagaaugagcagggcucuggguacgcugcggaucuuaagagcacacaaaacgccauugacgagaucaccaauaaagucaacuccgugauugaaaagaugaauacgcaguuuacagcuguuggaaaagaguucaaccaucuugaaaagcgcaucgagaaucugaacaagaaaguggaugacggcuuccucgauauuuggaccuacaaugccgaacugcugguccuccuggagaacgagagaacccuugacuaucacgauagcaaugugaagaaccuguacgaaaaaguccggucucagcucaagaacaaugccaaagagaucgggaacggauguuuugaguucuaucauaagugcgacaauacauguauggaauccgugaagaacggcaccuacgauuauccuaaauacagcgaagaggcuaagcugaaucgcgaggaaaucgacgggguuaaacuugagucuacaagaauuuaucagauccuggccauuuacuccacgguggcgagcucccucguccuggugguuucucugggcgcuaucagcuuuuggaugugcuccaacggaucucuccaaugccggauuuguaucuga

SEQ ID NO: 187575 - RNA, 1701 nt, Artificial Sequence; identical to SEQ ID NO: 185935
  derived and/or modified sequence opt5 from hemagglutinin__InfluenzaA__ADF27374

SEQ ID NO: 187576 - RNA, 1701 nt, Artificial Sequence
  derived and/or modified sequence opt5 from hemagglutinin__InfluenzaA__ADF27375
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagagccucuaccagaacgcugacgccuacguguucgugggcuccagcagauauucuaaaaaguuuaaaccugagauugcuauccggccgaagguccgcgaucaggaagggagaaugaauuacuauuggacacugguugagcccggagacaaaauuaccuucgaagccacgggcaaccugguggugccucgguacgcguuugccauggagcgcaacgcuggguccggaaucauuaucagcgauacacccguccaugacugcaauaccacaugucaaaccccuaagggcgccaucaacaccucucuccccuuccacaauauucauccgaucacaauuggcaaaugcccuaaguauguuaagagcacgaaacugagacuugcuaccgggcugcggaacgugcccuccauccagucucgcggacucuuuggcgccauugccggguucaucgaaggaggcuggacagggaugguggacggaugguacggcuaucaccaccagaaugagcagggcagcggguacgcugcggaucaaaaguccacccagaacgccaucgacgagauuacaaauaaaaucaacagcgucauugaaaagaugaauacccaguuuacggcugugggaaaagaguucaaccaucuggaaaagagaaucgagaaucuuaacaagaaaguugaugacggcuuccuggauauuuggacauacaaugccgaacuccuggugcugcucgagaacgagcggacccuggacuaucacgauucuaaugucaagaaccuuuacgaaaaagugcgcucccagcugaagaacaaugccaaagagaucgggaacggauguuuugaguucuaucauaagugcgacaauaccuguauggaaagcgucaagaacggcacauacgauuauccuaaauacucugaagaggcuaagcucaauagagaggaaaucgacggggugaaacuggaguccacccggauuuaucaaauccuugccauuuacagcacaguugcguccucucuggugcucgucgugagccugggcgcuaucuccuuuuggaugugcucuaacggaagccugcagugccgcauuuguaucuga

SEQ ID NO: 187577 - RNA, 1701 nt, Artificial Sequence
  derived and/or modified sequence opt5 from hemagglutinin__InfluenzaA__ADF27376
augaaggccauccuggugguccuccuguacaccuucguuacagcuaacgccgacacgcuuugcauuggcuaucacgcgaauaacagcaccgauacaguggacaccgugcuggagaaaaaugucacagugacccauuccguuaaccuccuggaagauaagcacaaugggaaacuuuguaagcugagaggaguggcuccccuccaucugggcaaaugcaacaucgccggguggauucugggaaauccugagugugaaucucucagcacagccuccucuuggagcuacaucgucgagaccuccaacucugacaauggcacgugcuauccgggggauuuuauugacuacgaagaacugcgggagcagcuuagcuccgugagcucuuucgaacgcuuugagaucuuccccaagaccuccagcuggccuaaccacgauucuaauaagggaguuacagcugccuguccccaugcuggcgccaaauccuuuuauaagaaccugaucuggcucgugaaaaagggcaauagcuacccuaaacugucuaaguccuauauuaacgacaaggggaaagaaguccuugugcuguggggaauccaccaccccagcaccuccgcggaucaacagucucucuaccagaaugccgacgcuuacguguucgucggcacaagcagauauuccaagaaauuuaagccugagauugagauccggccgaaaguucgcgaucaggaagggagaaugaacuacuauuggacccugguggagcccggagacaagauuacguucgaagccacaggcaaccugguggucccucgguacgcuuuugccauggagcgcaaugcggggagcggaaucauuaucucugauacccccgugcaugacugcaacacaaccugucaaaccccuaaaggcgccaucaauacaucccuccccuuccagaacauucacccgaucacgauuggcaagugcccuaaguauguuaaaagcaccaagcugagacuugcuacagggcugcggaaugugcccucuauccagagccgcggacucuuuggcgccauugcuggguucaucgaaggaggcuggaccgggauggucgacggaugguacggcuaucaucaccagaacgagcaaggcuccggguacgccgccgaucugaaaucuacacagaaugcuaucgacaagauuaccaacaaagugaauagcguuaucgagaagaugaacacgcaguuuacagcggugggaaaggaguucaaucaccuugagaaaagaauugaaaaccugaauaagaaagucgaugacggcuuccucgauaucuggaccuacaacgccgagcugcuggugcuccuggaaaaugagcggacccuugacuaucaugauuccaacgucaagaaccuguacgagaaagugcgcagccagcucaagaauaacgcuaaggaaauugggaauggauguuuugaguucuaucacaaaugcgacaacacauguauggaaucuguuaagaauggcaccuacgauuauccuaaauacuccgaggaagccaagcugaacagagaggagaucgacggggugaaacuugaaagcacacggaucuaucaaauucuggccaucuacucuacggucgcuuccagccucgugcugguugugucccugggcgccauuucuuuuuggaugugcagcaauggaucccuccagugccgcaucuguauuuga

SEQ ID NO: 187578 - RNA, 1701 nt, Artificial Sequence
  derived and/or modified sequence opt5 from hemagglutinin__InfluenzaA__ADF27378
augaaggccauccuggugguccuccuguacaccuucguuacagcuaacgccgacacgcuuugcauuggcuaucacgcgaauaacagcaccgauacaguggacaccgugcuggagaaaaaugucacagugacccauuccguuaaccuccuggaagauaagcacaaugggaaacuuuguaagcugagaggaguggcuccccuccaucugggcaaaugcaacaucgccggguggauucugggaaauccugagugugaaucucucagcacagccuccucuuggagcuacaucgucgagaccuccaacucugacaauggcacgugcuauccgggggauuuuauugacuacgaagaacugcgggagcagcuuagcuccgugagcucuuucgaacgcuuugagaucuuccccaagaccuccagcuggccuaaccacgauucuaauaagggaguuacagcugccuguccccaugcuggcgccaaauccuuuuauaagaaccugaucuggcucgugaaaaagggcaauagcuacccuaaacugucuaaguccuauauuaacgacaaggggaaagaaguccuugugcuguggggaauccaccaccccagcaccuccgcggaucaacagucucucuaccagaaugccgacgcuuacguguucgucggcacaagcagauauuccaagaaauuuaagccugagauugccauccggccgaaaguucgcgaucaggaggggagaaugaacuacuauuggacccugguggaacccggagacaagauuacguucgaggcuacaggcaaccugguggucccucgguacgccuuugcgauggaacgcaaugccgggagcggaaucauuaucucugauacccccgugcaugacugcaacacaaccugucaaaccccuaaaggcgcuaucaauacaucccuccccuuccagaacauucacccgaucacgauuggcaagugcccuaaguauguuaaaagcaccaagcugagacuugccacagggcugcggaaugugcccucuauccagagccgcggacucuuuggcgcuauugccggguucaucgagggaggcuggaccgggauggucgacggaugguacggcuaucaucaccagaacgaacaaggcuccggguacgccgcugaucugaaaucuacacagaaugcgaucgacaagauuaccaacaaagugaauagcguuaucgagaagaugaacacgcaguuuacagccgugggaaaggaguucaaucaccuugagaaaagaauugagaaccugaauaagaaagucgaugacggcuuccucgauaucuggaccuacaacgcugaacugcuggugcuccuggagaaugaacggacccuugacuaucaugauuccaacgucaagaaccuguacgagaaagugcgcagccagcucaagaauaacgccaaggagauugggaauggauguuuugaguucuaucacaaaugcgacaacacauguauggaaucuguuaagaauggcaccuacgauuauccuaaauacuccgaagaggccaagcugaacagagaagagaucgacggggugaaacuugagagcacacggaucuaucaaauucuggcuaucuacucuacggucgccuccagccucgugcugguugugucccugggcgcgauuucuuuuuggaugugcagcaauggaucccuccagugccgcaucuguauuuga

SEQ ID NO: 187579 - RNA, 1701 nt, Artificial Sequence
  derived and/or modified sequence opt5 from hemagglutinin__InfluenzaA__ADF27389
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaccuccgauacacccguccaugacugcaauaccaccugucaaacaccuaaaggcgccaucaacacgagccuccccuuccagaauauccacccgauuaccaucggcaagugcccuaaguaugugaaaucuacaaagcugagacuugcuaccgggcugcggaacguucccagcauucagucccgcggacucuuuggcgccaucgccggguucauugagggaggcuggacagggaugguggacggaugguacggcuaucaucaccagaaugaacaaggcucuggguacgcugcggaucugaaaagcacccagaacgccaucgacgagaucacgaauaaggucaacuccgugauugagaaaaugaauacacaguuuaccgcuguuggaaaggaguucaaccaccuugagaagagaaucgaaaaucugaacaaaaagguggaugacggcuuccucgauauuuggaccuacaaugccgagcugcugguccuccuggaaaacgagcggacacuugacuaucaugauagcaaugugaaaaaccuguacgagaagguccgcucucagcucaaaaacaaugccaaggaaaucgggaacggauguuuugaguucuaucacaagugcgacaauaccuguauggaauccgugaaaaacggcacauacgauuauccuaaguacagcgaggaagcuaaacugaauagagaggagauugacgggguuaaacuugaaucuacgcggaucuaucaaauccuggccauuuacuccaccguggcgagcucccucguccuggugguuucucugggcgcuaucagcuuuuggaugugcuccaacggaucucuccagugccgcauuuguaucuga

SEQ ID NO: 187580 - RNA, 1701 nt, Artificial Sequence
  derived and/or modified sequence opt5 from hemagglutinin__InfluenzaA__ADF27399
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcgagugcccuaaguaugugaagucuaccaaacugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaucuuaagagcacacagaacgccaucgacgagauuaccaauaaagucaacuccgugaucgaaaagaugaauacgcaguuuacagcuguuggaaaagaguucaaccaccuggaaaagagaauugagaaucugaacaagaaaguggaugacggcuuccucgauaucuggaccuacaaugccgaacugcugguccuccuggagaacgagcggacccuugacuaucaugauagcaaugugaagaaccuguacgaaaaaguccgcucucagcucaagaacaaugccaaagagauugggaacggauguuuugaguucuaucacaagugcgacaauacauguauggaguccgugaagaacggcaccuacgauuauccuaaauacagcgaagaggcuaagcugaauagagaggaaaucgacgggguuaaacuugagucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 187581 - RNA, 1701 nt, Artificial Sequence; identical to SEQ ID NO: 186857
  derived and/or modified sequence opt5 from hemagglutinin__InfluenzaA__ADF27409

SEQ ID NO: 187582 - RNA, 1701 nt, Artificial Sequence; identical to SEQ ID NO: 187565
  derived and/or modified sequence opt5 from hemagglutinin__InfluenzaA__ADF27419

SEQ ID NO: 187583 - RNA, 1701 nt, Artificial Sequence
  derived and/or modified sequence opt5 from hemagglutinin__InfluenzaA__ADF27429
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaggaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaaguucuauauuaaugacaaggggaaagaagugcuuguccuguggggaauccaccaccccagcaccuccgccgaucaacagucucucuaccagaacgcugacgccuacguguuugugggcacaagcagauauuccaagaaauucaagccugagauugcuauccggccgaaaguccgcgaucaggaggggagaaugaauuacuauuggacccugguugaacccggagacaagauuacguuugaggccacaggcaaccugguggugccucgguacgcguucgccauggaacgcaacgcugggagcggaaucauuaucucugauacccccguccaugacugcaauacaaccugucaaaccccuaaaggcgccaucaacacaucccuccccuuucagaauauucacccgaucacgauuggcaagugcccuaaguaugugaaaagcaccaagcugagacuugcuacagggcugcggaacguucccucuauccagagccgcggacucuucggcgccauugccggguuuaucgagggaggcuggaccgggaugguggacggaugguacggcuaucaucaccagaaugaacaaggcuccggguacgcugcggaucugaaaucuacacagaacgccaucgacaagauuaccaauaaagucaacagcgugaucgagaagaugaauacgcaguucacagcuguuggaaaggaguucaaccaccuugaaaagagaauugagaaucugaacaagaaaguggaugacggcuuucucgauaucuggaccuacaaugccgaacugcugguccuccuggagaacgaacggacccuugacuaucaugauuccaaugugaagaaccuguacgagaaaguccgcagccagcucaagaacaaugccaaggagauugggaacggauguuucgaauuuuaucacaaaugcgacaauacauguaugaagucugugaaaaacggcaccuacgauuauccuaaguacuccgaggaagcuaaacugaauagagaggaaaucgacgggguuaaacuugagagcacacggaucuaucaaauucuggccaucuacucuacgguggcguccagccucguccuggugguuucccugggcgcuauuucuuucuggaugugcagcaacggaucccuccagugccgcaucuguauuuga

SEQ ID NO: 187584 - RNA, 1701 nt, Artificial Sequence; identical to SEQ ID NO: 185693
  derived and/or modified sequence opt5 from hemagglutinin__InfluenzaA__ADF27439

SEQ ID NO: 187585 - RNA, 1701 nt, Artificial Sequence
  derived and/or modified sequence opt5 from hemagglutinin__InfluenzaA__ADF27449
augaaggccauccuggugguccuccuguacaccuucgcuacaguuaacgccgacacgcuuugcauuggcuaucacgcgaauaacagcaccgauacaguggacaccgugcuggagaaaaaugucacagugacccauuccguuaaccuccuggaagauaagcacaaugggaaacuuuguaagcugagaggaguggcuccccuccaucugggcaaaugcaacaucgccggguggauucugggaaauccugagugugaaucucucagcacagccuccucuuggagcuacaucgucgagaccuccucuagcgacaacggcacgugcuauccgggggauuuuauugacuacgaagaacugcgggagcagcuuuccagcgugucuuccuucgaacgcuuugagaucuuccccaagaccagcucuuggccuaaucacgauuccaacaagggaguuacagcugccuguccccaugcuggcgccaagagcuuuuauaagaaucugaucuggcucgugaaaaagggcaacucuuacccuaaacuguccaagagcuauauuaaugacaaggggaaagaaguccuugugcuguggggaauccaccaccccuccaccucugcggaucaacagagccucuaccagaacgccgacgcuuacguguucgucggcacauccagauauagcaagaaauuuaagccugagauugccauccggccgaaaguucgcgaucaggaggggagaaugaauuacuauuggacccugguggaacccggagacaagauuacguucgaggcuacaggcaaccugguggucccucgguacgccuuugcgauggaacgcaacgccgggucuggaaucauuaucuccgauacccccgugcaugacugcaauacaaccugucaaaccccuaaaggcgcuaucaacacaagccuccccuuccagaauauucacccgaucacgauuggcaagugcccuaaguauguuaaaucuaccaagcugagacuugccacagggcugcggaacauccccagcauucagucccgcggacucuuuggcgcuaucgccggguucaucgagggaggcuggaccgggaugguggacggaugguacggcuaucaucaccagaaugaacaaggcucuggguacgccgcugaucugaaaagcacacagaacgcgauugacgagaucaccaauaaggucaacuccgugauugagaaaaugaauacgcaguuuacagccguuggaaaggaguucaaccaccuugagaagagaaucgaaaaucugaacaaaaagguggaugacggcuuccucgauauuuggaccuacaaugcugagcugcugguccuccuggaaaacgagcggacccuugacuaucaugauagcaaugugaaaaaccuguacgagaagguccgcucucagcucaaaaacaaugccaaggaaaucgggaacggauguuuugaguucuaucacaagugcgacaauacauguauggaauccgugaaaaacggcaccuacgauuauccuaaguacagcgaggaagccaaacugaauagagaggagaucgacgggguuaaacuugaaucuacacggauuuaucaaauccuggcuauuuacuccacgguggccagcucccucguccuggugguuucucugggcgcgaucagcuuuuggaugugcuccaacggaucucuccagugccgcauuuguaucuga

SEQ ID NO: 187586 - RNA, 1701 nt, Artificial Sequence; identical to SEQ ID NO: 186853
  derived and/or modified sequence opt5 from hemagglutinin__InfluenzaA__ADF27459

SEQ ID NO: 187587 - RNA, 1701 nt, Artificial Sequence; identical to SEQ ID NO: 185693
  derived and/or modified sequence opt5 from hemagglutinin__InfluenzaA__ADF27469

SEQ ID NO: 187588 - RNA, 1701 nt, Artificial Sequence
  derived and/or modified sequence opt5 from hemagglutinin__InfluenzaA__ADF27479
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccauucccgcggacucuuuggcgccauugccggguucaucgagggaggcuggaccgggaugguggacggaugguacggcuaucaccaccagaaugaacagggcucuggguacgcugcggaucugaaaagcacacaaaacgccaucgacaagauuaccaauaaagucaacuccgugaucgagaagaugaauacgcaguuuacagcuguuggaaaggaguucaaccaucuugagaaaagaauugagaaucugaacaagaaaguggaugacggcuuccucgauaucuggaccuacaaugccgaacugcugguccuccuggagaacgaacggacccuugacuaucacgauagcaaugugaagaaccuguacgagaaaguccgcucucagcucaagaacaaugccaaggagauugggaacggauguuuugaguucuaucauaaaugcgacaauacauguauggaauccgugaagaacggcaccuacgauuauccuaaauacagcgaagaggcuaagcugaauagagaagagaucgacgggguuaaacuugagucuacacggaucuaucagauucuggccaucuacuccacgguggcgagcucccucguccuggugguuucucugggcgcuauuagcuuuuggaugugcuccaacggaucucuccaaugccgcaucuguauuuga

SEQ ID NO: 187589 - RNA, 1701 nt, Artificial Sequence
  derived and/or modified sequence opt5 from hemagglutinin__InfluenzaA__ADF27489
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaauacaagcacaaugggaaacuuuguaagcugagaggaguugcuccccuccaucugggcaaaugcaacaucgccggguggauucugggaaauccugagugugaaucucucagcacagccuccucuuggagcuauaucguggagaccuccucuagcgauaacggcacgugcuacccgggggacuuuauugauuaugaagaacugcgggagcagcuuuccagcgucucuuccuucgaacgcuuugagaucuuccccaagaccagcucuuggccuaaucacgacuccaacaagggagugacagccgcuuguccccaugccggcgcgaaaucuuuuuacaagaaucugaucuggcucguuaaaaagggcaacagcuauccuaaacuguccaagagcuacauuaaugauaaggggaaagaagugcuuguccuguggggaauccaccaccccuccaccucugccgaccaacagagccucuaccagaacgcugaugccuauguguucgugggcacauccagauacagcaagaaauuuaagccugagauugcuauccggccgaaaguccgcgaccaggaggggagaaugaauuauuacuggacccugguugaacccggagauaagauuacguucgaggccacaggcaaccugguggugccucgguaugcguuugccauggaacgcaacgcugggucuggaaucauuaucuccgacacccccguccaugauugcaauacaaccugucaaaccccuaaaggcgccaucaacacaagccuccccuuccagaauauucacccgaucacgauuggcgagugcccuaaguacgugaagucuaccaaacugagacuugcuacagggcugcggaacguucccagcauccagucccgcggacucuuuggcgccauugccggguucaucgaaggaggcuggaccgggaugguggacggaugguauggcuaccaucaccagaaugagcaaggcucuggguacgcugcggaccuuaagagcacacagaacgccaucgaugagauuaccaauaaagucaacuccgugaucgaaaagaugaauacgcaguuuacagcuguuggaaaagaguucaaccaccuggaaaagagaauugagaaucugaacaagaaaguggacgauggcuuccucgacaucuggaccuauaaugccgaacugcugguccuccuggagaacgagcggacccuugauuaccaugacagcaaugugaagaaccuguaugaaaaaguccgcucucagcucaagaacaaugccaaagagauugggaacggauguuuugaguucuaccacaagugcgauaauacauguauggaguccgugaagaacggcaccuaugacuacccuaaauauagcgaagaggcuaagcugaauagagaggaaaucgaugggguuaaacuugagucuacacggaucuaccaaauucuggccaucuacuccacgguggcgagcucccucguccuggugguuucucugggcgcuauuagcuuuuggaugugcuccaacggaucucuccagugccgcaucuguauuuga

SEQ ID NO: 187590 - RNA, 1701 nt, Artificial Sequence; identical to SEQ ID NO: 186857
  derived and/or modified sequence opt5 from hemagglutinin__InfluenzaA__ADF27499

SEQ ID NO: 187591 - RNA, 1701 nt, Artificial Sequence; identical to SEQ ID NO: 185693
  derived and/or modified sequence opt5 from hemagglutinin__InfluenzaA__ADF27509

SEQ ID NO: 187592 - RNA, 1701 nt, Artificial Sequence; identical to SEQ ID NO: 187290
  derived and/or modified sequence opt5 from hemagglutinin__InfluenzaA__ADF27529

SEQ ID NO: 187593 - RNA, 1701 nt, Artificial Sequence; identical to SEQ ID NO: 186865
  derived and/or modified sequence opt5 from hemagglutinin__InfluenzaA__ADF27539

SEQ ID NO: 187594 - RNA, 1701 nt, Artificial Sequence; identical to SEQ ID NO: 186865
  derived and/or modified sequence opt5 from hemagglutinin__InfluenzaA__ADF27549

SEQ ID NO: 187595 - RNA, 1701 nt, Artificial Sequence; identical to SEQ ID NO: 185693
  derived and/or modified sequence opt5 from hemagglutinin__InfluenzaA__ADF27559

SEQ ID NO: 187596 - RNA, 1701 nt, Artificial Sequence
  derived and/or modified sequence opt5 from hemagglutinin__InfluenzaA__ADF27569
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaguuaauuacuauuggacccugguggaacccggagacaagauuacguucgaggccacaggcaaccugguggucccucgguacgcguuugccauggaacgcaacgcugggucuggaaucauuaucuccgauacccccgugcaugacugcaauacaaccugucaaaccccuaaaggcgccaucaacacaagccuccccuuccagaauauucacccgaucacgauuggcaagugcccuaaguauguuaaaucuaccaagcugagacuugcuacagggcugcggaacgugcccagcauccagucccgcggacucuuuggcgccauugccggguucaucgagggaggcuggaccgggauggucgacggaugguacggcuaucaucaccagaaugaacaaggcucuggguacgcugcggaucugaaaagcacacagaacgccaucgacaagauuaccaauaaagugaacuccguuaucgagaagaugaauacgcaguuuacagcugugggaaaggaguucaaccaccuugagaaaagaauugagaaucugaacaagaaagucgaugacggcuuccucgauaucuggaccuacaaugccgaacugcuggugcuccuggagaacgaacggacccuugacuaucaugauagcaaugucaagaaccuguacgagaaagugcgcucucagcucaagaacaaugccaaggagauugggaacggauguuuugaguucuaucacaaaugcgacaauacauguauggaauccguuaagaacggcaccuacgauuauccuaaauacagcgaagaggcuaagcugaauagagaagagaucgacggggugaaacuugagucuacacggaucuaucaaauucuggccaucuacuccacggucgcgagcucccucgugcugguugugucucugggcgcuauuagcuuuuggaugugcuccaacggaucucuccagugccgcaucuguauuuga

SEQ ID NO: 187597 - RNA, 1701 nt, Artificial Sequence; identical to SEQ ID NO: 186865
  derived and/or modified sequence opt5 from hemagglutinin__InfluenzaA__ADF27579

SEQ ID NO: 187598 - RNA, 1701 nt, Artificial Sequence
  derived and/or modified sequence opt5 from hemagglutinin__InfluenzaA__ADF27589
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauaccagcguccaugacugcaauacaaccugucaaacccccaaaggcgccaucaacacaucucucccuuuccagaauauucaccccaucacgauuggcaagugcccgaaguaugugaaaagcaccaagcugagacuugcuacagggcugcggaacguuccuuccauccagucucgcggacucuuuggcgccauugccggguucaucgagggaggcuggaccgggaugguggacggaugguacggcuaucaucaccagaaugaacaaggcagcggguacgcugcggaucugaaauccacacagaacgccaucgacgagauuaccaauaaggucaacagcgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauucuaaugugaaaaaccuguacgagaagguccgcucccagcucaaaaacaaugccaaggaaauugggaacggauguuuugaguucuaucacaagugcgacaauacauguauggaaagcgugaaaaacggcaccuacgauuaucccaaguacucugaggaagcuaaacugaauagagaggagaucgacgggguuaaacuugaauccacacggaucuaucaaauucuggccaucuacagcacgguggcguccucucucguccuggugguuagccugggcgcuauuuccuuuuggaugugcucuaacggaagccuccagugccgcaucuguauuuga

SEQ ID NO: 187599 - RNA, 1701 nt, Artificial Sequence
  derived and/or modified sequence opt5 from hemagglutinin__InfluenzaA__ADF27599
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuuaccauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacgagauuacgaauaaggucaacuccgugaucgagaaaaugaauacacaguuuaccgccguuggaaaggaguucaaccaccuugagaagagaauugaaaaucugaacaaaaagguggaugacggcuuccucgauaucuggaccuacaaugcugagcugcugguccuccuggaaaacgagcggacacuugacuaucaugauagcaaugugaaaaaccuguacgagaagguccgcucucagcucaaauccaacgccaaggaaauugggaauggauguuuugaguucuaucacaagugcgacaacaccuguauggaaagcgugaaaaauggcacauacgauuauccuaaguacucugaggaagccaaacugaacagagaggagaucgacgggguuaaacuugaauccacgcggaucuaucaaauucuggcuaucuacagcaccguggccuccucucucguccuggugguuagccugggcgcgauuuccuuuuggaugugcucuaauggaagccuccagugccgcaucuguauuuga

SEQ ID NO: 187600 - RNA, 1701 nt, Artificial Sequence
  derived and/or modified sequence opt5 from hemagglutinin__InfluenzaA__ADF27609
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaagccggcgcgaaaucuuuuuauaagaaucugaucuggcucguuaaaaagggcaacagcuacccuaaacuguccaagagcuauauuaaugacaaggggaaagaagugcuuguccuguggggaauccaucaccccuccaccucugccgaucagcagagccucuaccagaacgcugacgccuacguguucgugggcacauccagauauagcaagaaauuuaagccugagauugcuauccggccgaaaguccgcgaucaagaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccacgacugcaauacaaccugucagaccccuaaaggcgccaucaacacaagccuccccuuccagaauauucauccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaccaucaaaaugaacagggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucacgauagcaaugugaaaaaccuguacgagaagguccgcucucaacucaaaaacaaugccaaggaaauugggaacggauguuuugaguucuaucauaagugcgacaauacauguauggaauccgugaaaaacggcaccuacgauuauccuaaguacagcgaggaagcuaaacugaauagagaggagaucgacgggguuaaacuugaaucuacacggaucuaucagauucuggccaucuacuccacgguggcgagcucccucguccuggugguuucucugggcgcuauuagcuuuuggaugugcuccaacggaucucuccagugccgcaucuguauuuga

SEQ ID NO: 187601 - RNA, 1701 nt, Artificial Sequence
  derived and/or modified sequence opt5 from hemagglutinin__InfluenzaA__ADF27619
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugugccccuccaucugggcaaaugcaacaucgccggguggauucugggaaauccugagugugaaucucucagcacagccuccucuuggagcuacaucgucgagaccuccucuagcgacaacggcacgugcuauccgggggauuuuauugacuacgaagaacugcgggagcagcuuuccagcgugucuuccuucgaacgcuuugagaucuuccccaagaccagcucuuggccuaaucacgauuccaacaagggaguuacagcugccuguccccaugcuggcgccaagagcuuuuauaaaaaucugaucuggcucgugaaaaagggcaacucuuacccuaaacuguccaagagcuauauuaaugacaaggggaaagaaguccuugugcuguggggaauccaccaccccuccaccucugcggaucaacagagccucuaccagaacgccgacgcuuacguguucgucggcacauccagauauagcaagaaauuuaagccugagauugccauccggccgaaaguucgcgaucaggaggggagaaugaauuacuauuggacccugguggaacccggagacaagauuacguucgaggcuacaggcaaccugguggucccucgguacgccuuugcgauggaacgcaacgccgggucuggaaucauuaucuccgauacccccgugcaugacugcaauacaaccugucaaaccccuaaaggcgcuaucaacacaagccuccccuuccagaauauucacccgaucacgauuggcaagugcccuaaguauguuaaaucuaccaagcugagacuugccacagggcugcggaacgugcccagcauccagucccgcggacucuuuggcgcuauugccggguucaucgagggaggcuggaccgggauggucgacggaugguacggcuaucaucaccagaaugaacaaggcucuggguacgccgcugaucugaaaagcacacagaacgcgaucgacaagauuaccaauaaagugaacuccguuaucgagaagaugaauacgcaguuuacagccgugggaaaggaguucaaccaccuugagaaaagaauugagaaucugaacaagaaagucgaugacggcuuccucgauaucuggaccuacaaugcugaacugcuggugcuccuggagaacgaacggacccuugacuaucaugauagcaaugucaagaaccuguacgagaaagugcgcucucagcucaagaacaaugccaaggagauugggaacggauguuuugaguucuaucacaaaugcgacaauacauguauggaauccguuaagaacggcaccuacgauuauccuaaauacagcgaagaggccaagcugaauagagaagagaucgacggggugaaacuugagucuacacggaucuaucaaauucuggcuaucuacuccacggucgccagcucccucgugcugguugugucucugggcgcgauuagcuuuuggaugugcuccaacggaucucuccagugccgcaucuguauuuga

SEQ ID NO: 187602 - RNA, 1701 nt, Artificial Sequence; identical to SEQ ID NO: 186865
  derived and/or modified sequence opt5 from hemagglutinin__InfluenzaA__ADF27629

SEQ ID NO: 187603 - RNA, 1701 nt, Artificial Sequence
  derived and/or modified sequence opt5 from hemagglutinin__InfluenzaA__ADF27649
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagccucgcggacucuuuggcgccauugccggguucaucgagggaggcuggaccgggaugguggacggaugguacggcuaucaucaccagaaugaacaaggcuccggguacgcugcggaucugaaaucuacacagaacgccaucgacaagauuaccaauaaagucaacagcgugaucgagaagaugaauacgcaguuuacagcuguuggaaaggaguucaaccaccuugagaaaagaauugagaaucugaacaagaaaguggaugacggcuuccucgauaucuggaccuacaaugccgaacugcugguccuccuggagaacgaacggacccuugacuaucaugauuccaaugugaagaaccuguacgagaaaguccgcagccagcucaagaacaaugccaaggagauugggaacggauguuuugaguucuaucacaaaugcgacaauacauguauggaaucugugaagaacggcaccuacgauuaucccaaauacuccgaagaggcuaagcugaauagagaagagaucgacgggguuaaacuugagagcacacggaucuaucaaauucuggccaucuacucuacgguggcguccagccucguccuggugguuucccugggcgcuauuucuuuuuggaugugcagcaacggaucccuccagugccgcaucuguauuuga

SEQ ID NO: 187604 - RNA, 1701 nt, Artificial Sequence; identical to SEQ ID NO: 186865
  derived and/or modified sequence opt5 from hemagglutinin__InfluenzaA__ADF27659

SEQ ID NO: 187605 - RNA, 1701 nt, Artificial Sequence; identical to SEQ ID NO: 187342
  derived and/or modified sequence opt5 from hemagglutinin__InfluenzaA__ADF27669

SEQ ID NO: 187606 - RNA, 1701 nt, Artificial Sequence; identical to SEQ ID NO: 186794
  derived and/or modified sequence opt5 from hemagglutinin__InfluenzaA__ADF27679

SEQ ID NO: 187607 - RNA, 1701 nt, Artificial Sequence; identical to SEQ ID NO: 187403
  derived and/or modified sequence opt5 from hemagglutinin__InfluenzaA__ADF27689

SEQ ID NO: 187608 - RNA, 1701 nt, Artificial Sequence
  derived and/or modified sequence opt5 from hemagglutinin__InfluenzaA__ADF27699
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagauguuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauaucaaugacaaggggaaagaagugcuuguccuguggggcauucaccaccccuccaccucugccgaucaacagagccucuaccagaacgcugacgccuacguguucgugggaacauccagauauagcaagaaauuuaagccugagaucgcuauucggccgaaaguccgcgaucaggaggggagaaugaauuacuauuggacccugguugaacccggagacaagaucacguucgaggccacaggcaaccugguggugccucgguacgcguuugccauggaacgcaacgcugggucuggaauuaucauuuccgauacccccguccauaauugcaacacaaccugucaaaccccuaaaggcgccaucaauacaagccuccccuuccagaacauccacccgauuacgaucggcaagugcccuaaguaugugaaaucuaccaagcugagacuugcuacagggcugcggaauguucccagcauucagucccgcggacucuuuggcgccaucgccggguucauugagggaggcuggaccgggaugguggacggaugguacggcuaucaucaccagaacgaacaaggcucuggguacgcugcggaccugaaaagcacacagaaugccaucgaugagaucaccaacaaggucaauuccgugauugagaaaaugaacacgcaguuuacagcuguuggaaaggaguucaaucaccuugagaagagaaucgaaaaccugaauaaaaagguggacgauggcuuccucgacauuuggaccuacaacgccgagcugcugguccuccuggaaaaugagcggacccuugauuaucaugacagcaacgugaaaaaccuguacgagaagguccgcucucagcucaaaaauaacgccaaggaaguggggaauggauguuuugaguucuaucacaagugcgauaacacauguauggaauccguuaaaaauggcaccuacgacuauccuaaguacagcgaggaagcuaaacugaacagagaggagaucgauggggugaaacuugaaucuacacggauuuaucaaauccuggccaucuacuccacggucgcgagcucccucgugcugguugugucucugggcgcuauuagcuuuuggaugugcuccaauggaucucuccagugccgcaucuguauuuga

SEQ ID NO: 187609 - RNA, 1701 nt, Artificial Sequence
  derived and/or modified sequence opt5 from hemagglutinin__InfluenzaA__ADF27709
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagauuuccucuagcgacaacggaaccugcuauccgggggauuuuaucaauuacgaagaacugcgggagcagcuuuccagcgucucuuccuucgaacgcuuugagaucuuccccaagacgagcucuuggccuaaccacgacuccaauaagggagugaccgccgcuuguccccaugccggcgcgaaaucuuuuuauaagaaccugauuuggcucguuaaaaagggcaauagcuacccuaaacuguccaagagcuauaucaacgauaaggggaaagaagugcuuguccuguggggcauucaccaccccuccacaucugccgaccaacagagccucuaccagaaugcugaugccuacguguucgugggcaccuccagauauagcaagaaauuuaagccugagaucgcuauucggccgaaaguccgcgaccaggaggggagaaugaacuacuauuggacacugguugaacccggagauaagaucaccuucgaggccacgggcaaccugguggugccucgguacgcguuugccauggaacgcaaugcugggucuggaauuaucaucuccgacacacccguccaugauugcaacaccacaugucaaaccccuaaaggcgccauuaauaccagccuccccuuccagaacauccacccgauuacaaucggcaagugcccuaaguaugugaaaucuacgaagcugagacuugcuaccgggcugcggaauguucccagcauucagucccgcggacucuuuggcgccaucgccggguucaucgagggaggcuggacagggaugguggacggaugguacggcuaucaucaccagaacgaacaaggcucuggguacgcugcggaccugaaaagcacccagaaugccauugauaagaucacaaacaaagucaauuccgugauugagaagaugaacacccaguuuacggcuguuggaaaggaguucaaucaccuugagaaaagaaucgagaaccugaauaagaaaguggacgauggcuuccucgacauuuggacauacaacgccgaacugcugguccuccuggagaaugaacggacccuugauuaucaugacagcaacgugaagaaccuguacgagaaaguccgcucucagcucaagaauaacgccaaggagaucgggaauggauguuuugaguucuaucacaaaugcgauaacaccuguauggaauccgugaagaauggcacauacgacuauccuaaauacagcgaagaggcuaagcugaacagagaagagaucgaugggguuaaacuugagucuacccggauuuaucaaauccuggccauuuacuccacaguggcgagcucccucguccuggugguuucucugggcgcuaucagcuuuuggaugugcuccaauggaucucuccagugccgcauuuguaucuga

SEQ ID NO: 187610 - RNA, 1701 nt, Artificial Sequence; identical to SEQ ID NO: 186857
  derived and/or modified sequence opt5 from hemagglutinin__InfluenzaA__ADF27785

SEQ ID NO: 187611 - RNA, 1701 nt, Artificial Sequence
  derived and/or modified sequence opt5 from hemagglutinin__InfluenzaA__ADF27795
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguuaagcccggagacaaaauuacguucgaagccacaggcaaccugguggugccucgguacgcguuugccauggagcgcaacgcugggucuggaaucauuaucuccgauacccccguccaugacugcaauacaaccugucaaaccccuaagggcgccaucaacacaagccuccccuuccagaauauucacccgaucacgauuggcaagugcccuaaauaugugaagucuaccaaacugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaucugaaaagcacacagaacgccaucgacgaaauuaccaauaaagucaacuccgugaucgagaagaugaauacgcaguuuacagcuguuggaaaggaguucaaccaccuugaaaagagaauugagaaucugaacaagaaaguggaugacggcuuccucgauaucuggaccuacaaugccgaacugcugguccuccuggagaacgaacggacccuugacuaucaugauagcaaugugaagaaccuguacgagaaaguccgcucucagcucaagaacaaugccaaggagauugggaacggauguuuugaguucuaucacaaaugcgacaauacauguauggaguccgugaagaacggcaccuacgauuauccuaaauacagcgaagaggcuaagcugaauagagaagagaucgacgggguuaaacuugagucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 187612 - RNA, 1701 nt, Artificial Sequence; identical to SEQ ID NO: 186865
  derived and/or modified sequence opt5 from hemagglutinin__InfluenzaA__ADF27805

SEQ ID NO: 187613 - RNA, 1701 nt, Artificial Sequence
  derived and/or modified sequence opt5 from hemagglutinin__InfluenzaA__ADF27815
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugacggcgccaagagcuuuuauaaaaaucugaucuggcucguuaaaaagggcaacucuuacccuaaacuguccaagagcuauauuaaugauaaggggaaagaagugcuuguccuguggggaauccaccaccccuccaccucugcggaccaacagagccucuaccagaacgccgaugcuuacguguucgugggcacauccagauauagcaagaaauuuaagccugagauugccauccggccgaaaguccgcgaccaggaggggagaaugaauuacuauuggacccugguugaacccggagauaagauuacguucgaggcuacaggcaaccugguggugccucgguacgccuuugcgauggaacgcaacgccgggucuggaaucauuaucuccgacacccccguccaugacugcaauacaaccugucaaaccccuaaaggcgcuaucaacacaagccuccccuuccagaauauucacccgaucacgauuggcaagugcccuaaguaugugaaaucuaccaagcugagacuugccacagggcugcggaacguucccagcauccagucccgcggacucuuuggcgcuauugccggguucaucgagggaggcuggaccgggaugguggauggaugguacggcuaucaucaccagaaugaacaaggcucuggguacgccgcugaccugaaaagcacacagaacgcgaucgauaagauuaccaauaaagucaacuccgugaucgagaagaugaauacgcaguuuacagccguuggaaaggaguucaaccaccuugagaaaagaauugagaaucugaacaagaaaguggacgauggcuuccucgacaucuggaccuacaaugcugaacugcugguccuccuggagaacgaacggacccuugauuaucaugacagcaaugugaagaaccuguacgagaaaguccgcucucagcucaagaacaaugccaaggagauugggaacggauguuuugaguucuaucacaaaugcgauaauacauguauggaauccgugaagaacggcaccuacgacuauccuaaauacagcgaagaggccaagcugaauagagaagagaucgaugggguuaaacuugagucuacacggaucuaucaaauucuggcuaucuacuccacgguggccagcucccucguccuggugguuucucugggcgcgauuagcuuuuggaugugcuccaacggaucucuccagugccgcaucuguauuuga

SEQ ID NO: 187614 - RNA, 1701 nt, Artificial Sequence
  derived and/or modified sequence opt5 from hemagglutinin__InfluenzaA__ADF27825
augaaggccauccuggugguccuccuguacaccuucgcuacagccaacgcggacacgcuuugcauuggcuaucacgcuaauaacagcaccgauacaguugacaccgugcuggagagaaaugugacagucacccauuccgugaaccuccuggaagauaaacacaaugggaaacuuuguaagcugcggggaguugcuccccuccaucugggcaagugcaacaucgccggguggauucugggaaauccugagugugaaucucucagcacagccuccucuuggagcuacaucguggagaccuccucuagcgacaacggcacgugcuauccgggggauuuuauugacuccgaagaacugcgcgagcagcuuagcucugucuccagcuucgaaagauuugagaucuuccccaaaaccucuuccuggccuaaucacgauagcaacaagggagugacagccgcuuguccccaugccggcgcgaagucuuuuuacaaaaaucugaucuggcucguuaagaaaggcaacuccuauccuaagcugagcaaauccuacauuaaugacaaggggaaggaagugcuuguccuguggggaauccaccaccccucuaccagcgccgaucaacagucccucuaucagaacgcugacgccuacguguucgugggcacaagccgguacucuaaaaaguuuaaaccugagauugcuauccgcccgaaggucagagaucaggaggggcggaugaauuauuacuggacccugguugaacccggagacaaaauuacguucgaggccacaggcaaccugguggugccucgcuaugcguuugccauggaaagaaacgcuggguccggaaucauuaucagcgauacccccguccaugacugcaauacaaccugucaaaccccuaagggcgccaucaacacaucucuccccuuccagaauauucacccgaucacgauuggcaaaugcccuaaguacguuaagagcaccaaacugcggcuugcuacagggcugcgcaacgugcccuccauccagucuagaggacucuuuggcgccauugccggguucaucgagggaggcuggaccgggaugguggacggaugguauggcuaccaucaccagaaugaacaaggcagcggguaugcugcggaucugaaguccacacagaacgccaucgacgagauuaccaauaaagucaacagcgugaucgagaagaugaauacgcaguuuacagcuguuggaaaagaguucaaccaccuugagaagcggauugaaaaucugaacaagaaaguggaugacggcuuccucgauaucuggaccuacaaugccgagcugcugguccuccuggaaaacgagcgcacccuugacuaccaugauucuaaugugaagaaccuguaugagaaagucagaucccagcucaagaacaaugccaaagaaauugggaacggauguuuugaguucuaccacaagugcgacaauacauguauggaaagcgugaagaacggcaccuaugauuacccuaaauauucugaggaagcuaagcugaaucgggaggagaucgacgggguuaaacuugaauccacacgcaucuaccaaauucuggccaucuauagcacgguggcguccucucucguccuggugguuagccugggcgcuauuuccuuuuggaugugcucuaacggaagccuccagugcagaaucuguauuuga

SEQ ID NO: 187615 - RNA, 1701 nt, Artificial Sequence
  derived and/or modified sequence opt5 from hemagglutinin__InfluenzaA__ADF27845
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgccaaccuccuggaagauaagcacaaugggaaacuuuguaagcugagaggaguggcuccccuccaucugggcaaaugcaacaucgccggguggauucugggaaauccugagugugaaucucucagcacagccuccucuuggagcuacaucguugagaccuccucuagcgacaacggcacgugcuauccgggggauuuuauugacuacgaagaacugcgggagcagcuuuccagcgugucuuccuucgaacgcuuugagaucuuccccaagaccagcucuuggccuaaucacgauuccaacaagggagucacagcugccuguccccaugcgggcgccaagagcuuuuauaagaaucugaucuggcucgugaaaaagggcaacucuuacccuaaacuguccaagagcuauauuaaugacaaggggaaagaaguucuugugcuguggggaauccaccaccccuccaccaacgcugaucaacagucucucuaccagaaugccgacgcuuacgucuucgugggcacaagcagauauuccaagaaauuuaagccugagauugccauccggccgaaagugcgcgaucaggaggggagaaugaacuacuauuggacccuggucgaacccggagacaagauuacguucgaggcgacaggcaaccugguugugccucgguacgccuuugcuauggaacgcaaugccgggagcggaaucauuaucucugauacccccgugcaugacugcaacacaaccugucaaaccccuaaaggcgcuaucaauacaucccuccccuuccagaacauucacccgaucacgauuggcaagugcccuaaguaugucaaaagcaccaagcugagacuugccacagggcugcggaaugugcccucuauccagagccgcggacucuuuggcgccauugcuggguucaucgagggaggcuggaccgggaugguugacggaugguacggcuaucaucaccagaacgaacaaggcuccggguacgcggccgaucugaaaucuacacagaaugcuaucgacgagauuaccaacaaggugaauagcgucaucgagaaaaugaacacgcaguuuacagccgugggaaaggaguucaaucaccuugagaagagaauugaaaaccugaauaaaaagguugaugacggcuuccucgauaucuggaccuacaacgccgagcugcuggugcuccuggaaaaugagcggacccuugacuaucaugauuccaacgucaaaaaccuguacgagaaggugcgcagccagcucaaaaauaacgcuaaggaaauugggaauggauguuuugaguucuaucacaagugcgacaacacauguauggaaucugucaaaaauggcaccuacgauuauccuaaguacuccgaggaagccaaacugaacagagaggagaucgacggggugaaacuugaaagcacacggaucuaucaaauucuggcgaucuacucuacgguugcuuccagccucgugcuggucgugucccugggcgccauuucuuuuuggaugugcagcaauggaucccuccagugccgcaucuguauuuga

SEQ ID NO: 187616 - RNA, 1701 nt, Artificial Sequence; identical to SEQ ID NO: 186857
  derived and/or modified sequence opt5 from hemagglutinin__InfluenzaA__ADF27855

SEQ ID NO: 187617 - RNA, 1701 nt, Artificial Sequence; identical to SEQ ID NO: 186857
  derived and/or modified sequence opt5 from hemagglutinin__InfluenzaA__ADF27865

SEQ ID NO: 187618 - RNA, 1701 nt, Artificial Sequence; identical to SEQ ID NO: 186857
  derived and/or modified sequence opt5 from hemagglutinin__InfluenzaA__ADF27875

SEQ ID NO: 187619 - RNA, 1701 nt, Artificial Sequence; identical to SEQ ID NO: 186857
  derived and/or modified sequence opt5 from hemagglutinin__InfluenzaA__ADF27885

SEQ ID NO: 187620 - RNA, 1701 nt, Artificial Sequence; identical to SEQ ID NO: 185693
  derived and/or modified sequence opt5 from hemagglutinin__InfluenzaA__ADF27895

SEQ ID NO: 187621 - RNA, 1701 nt, Artificial Sequence
  derived and/or modified sequence opt5 from hemagglutinin__InfluenzaA__ADF27915
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccgccucugcugaucaacagagccucuaccagaacgccgacgcuuacguguucgugggcaccuccagauauagcaagaaauuuaagccugagauugccauccggccgaaaguccgcgaucaggaggggagaaugaauuacuauuggacacugguugaacccggagacaagauuaccuucgaggcgacgggcaaccugguggugccucgguacgccuuugcuauggaacgcaacgccgggucuggaaucauuaucuccgauacacccguccaugacugcaauaccacaugucaaaccccuaaaggcgcuaucaacaccagccuccccuuccagaauauucacccgaucacaauuggcaagugcccuaaguaugugaaaucuacgaagcugagacuugccaccgggcugcggaacguucccagcauccagucccgcggacucuuuggcgccauugcuggguucaucgagggaggcuggacagggaugguggacggaugguacggcuaucaucaccagaaugaacaaggcucuggguacgcggccgaucugaaaagcacccagaacgcuaucgacaagauuacaaauaaagucaacuccgugaucgagaagaugaauacccaguuuacggccguuggaaaggaguucaaccaccuugagaaaagaauugagaaucugaacaagaaaguggaugacggcuuccucgauaucuggacauacaaugccgaacugcugguccuccuggagaacgaacggacccuugacuaucaugauagcaaugugaagaaccuguacgagaaaguccgcucucagcucaagaacaaugcuaaggagauugggaacggauguuuugaguucuaucacaaaugcgacaauaccuguauggaauccgugaagaacggcacauacgauuauccuaaauacagcgaagaggccaagcugaauagagaagagaucgacgggguuaaacuugagucuacccggaucuaucaaauucuggcgaucuacuccacaguggcuagcucccucguccuggugguuucucugggcgccauuagcuuuuggaugugcuccaacggaucucuccagugccgcaucuguauuuga

SEQ ID NO: 187622 - RNA, 1701 nt, Artificial Sequence
  derived and/or modified sequence opt5 from hemagglutinin__InfluenzaA__ADF27925
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaauccuuuuauaagaaucugaucuggcucguuaaaaagggcaacucuuacccuaaacuguccaauagcuauauuaacgacaaggggaaggaagugcuuguccuguggggaauccaccaccccuccaccucugccgaucaacagagccucuaccagaaugcugacgccuacguguucgugggcacauccagauauagcaaaaaguuuaaaccugagauugcuauccggccgaagguccgcgaucaggaggggagaaugaacuacuauuggacccugguugaacccggagacaaaauuacguucgaggccacaggcaaccugguggugccucgguacgcguuugccauggaacgcaaugcugggucuggaaucauuaucuccgauacccccgcccaugacugcaacacaaccugucaaaccccuaagggcgcuaucaauacaagccuccccuuccagaacauucacccgaucacgauuggcaaaugcccuaaguaugucaagucuaccaaacugagaauggccacagggcuucggaaugugcccagcauccagucccgcggacuguuuggcgccauugcuggguucaucgagggaggcuggaccgggaugguugacggaugguacggcuaucaucaccagaacgaacaaggcucuggguacgcggccgaucucaagagcacacagaaugcuaucgacgagauuaccaacaaagugaauagcgucaucgagaagaugaacacgcaguuuacagccgugggaaaagaguucaaucaccuggagaagagaauugaaaaccuuaauaagaaaguugaugacggcuuccuggauaucuggaccuacaacgccgagcuccuggugcugcucgaaaaugagcggacccuggacuaucaugauagcaacgucaagaaccuuuacgagaaagugcgcucucagcugaagaauaacgcuaaagaaauugggaauggauguuuugaguucuaucacaagugcgacaacacauguauggaauccgucaagaauggcaccuacgauuauccuaaauacagcgaggaagccaagcucaacagagaggagaucgacggggugaaacuggaaucuacacggaucuaucaaauucuugcgaucuacuccacgguugcuagcucccuggugcucgucgugucucugggcgccauuagcuuuuggaugugcuccaauggaucucugcagugccgcaucuguauuuga

SEQ ID NO: 187623 - RNA, 1701 nt, Artificial Sequence
  derived and/or modified sequence opt5 from hemagglutinin__InfluenzaA__ADF27935
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccuaagugugagucucucagcacagaauccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaaaggagugacagccgccuguccccaugcuggcgccaagagcuuuuauaaaaaccugaucuggcucguuaagaaaggcaauucuuacccuaagcuguccaagagcuauauuaacgauaaagggaaggaagugcuuguccuguggggaauccaccaccccuccaccucugcggaccaacagagccucuaccagaaugccgaugcuuacguguucgugggcacauccagauauagcaaaaaguuuaaaccugagauugccauccggccgaagguccgcgaccaggaggggagaaugaacuacuauuggacccugguugaacccggagauaaaauuacguucgaggcuacaggcaaccugguggugccucgguacgccuuugcgauggaacgcaaugccgggucuggaaucauuaucuccgacacccccguccaugauugcaacacaaccugucaaaccccuaagggcgcuaucaauacaagccuccccuuccagaacauucacccgaucacgauuggcaagugcccuaaauaugugaagucuaccaaacugagacuugccacagggcugcggaauguucccagcauccagucccgcggacucuuuggcgcuauugccggguucaucgagggaggcuggaccgggaugguggacggaugguacggcuaucaucaccagaacgaacaaggcucuggguacgccgcugaccuuaagagcacacagaaugcgaucgauaaaauuaccaacaaggucaauuccgugaucgagaagaugaacacgcaguuuacagccguuggaaaagaguucaaucaccuugaaaagagaauugagaaccugaauaaaaagguggacgauggcuuccucgacaucuggaccuacaacgcugaacugcugguccuccuggagaaugaacggacccuugauuaucaugacagcaacgugaaaaaccuguacgagaagguccgcucucagcucaagaauaacgccaaagagauugggaauggauguuuugaguucuaucacaagugcgauaacacauguauggaguccgugaaaaauggcaccuacgacuauccuaaguacagcgaagaggccaaacugaacagagaagagaucgaugggguuaagcuggagucuacacggaucuaucaaauucuggcuaucuacuccacgguggccagcucccucguccuggugguuucucugggcgcgauuagcuuuuggaugugcuccaauggaucucuccagugccgcaucuguauuuga

SEQ ID NO: 187624 - RNA, 1701 nt, Artificial Sequence
  derived and/or modified sequence opt5 from hemagglutinin__InfluenzaA__ADF27955
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaauagcuauauuaacgacaaggggaaggaagugcuuguccuguggggaauccaccaccccuccaccucugccgaucaacagagccucuaccagaaugcugacgccuacguguucgugggcacauccagauauagcaaaaaguuuaaaccugagauugcuauccggccgaagguccgcgaucaggaggggagaaugaacuacuauuggacccugguugaacccggagacaaaauuacguucgaggccacaggcaaccugguggugccucgguacgcguuugccauggaacgcaaugcugggucuggaaucauuaucuccgauacccccguccaugacugcaacacaaccugucaaaccccuaagggcgccaucaauacaagccuccccuuccagaacauucacccgaucacgauuggcaaaugcccuaaguaugugaagucuaccaaacugagacuugcuacagggcugcggaauguucccagcauccagucccgcggacucuuuggcgccauugccggguucaucgagggaggcuggaccgggaugguggacggaugguacggcuaucaucaccagaacgaacaaggcucuggguacgcugcggaucuuaagagcacacagaaugccaucgacaaaauuaccaacaaggucaauuccgugaucgagaaaaugaacacgcaguuuacagcuguuggaaaggaguucaaucaccuugaaaagagaauugagaaccugaauaaaaagguggaugacggcuuccucgauaucuggaccuacaacgccgaacugcugguccuccuggagaaugaacggacccuugacuaucaugauagcaacgugaaaaaccuguacgagaagguccgcucucagcucaaaaauaacgccaaggagauugggaauggauguuuugaguucuaucacaagugcgacaacacauguauggaguccgugaaaaauggcaccuacgauuauccuaaguacagcgaagaggcuaaacugaacagagaagagaucgacgggguuaagcuggagucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 187625 - RNA, 1701 nt, Artificial Sequence
  derived and/or modified sequence opt5 from hemagglutinin__InfluenzaA__ADF27965
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaggaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaaaaggugcuuguccuguggggaauccaccaccccuccaccucugccgaucaacagagccucuaccagaacgcugacgccuacguguucgugggcacauccagauauagcaaaaaguuuaaaccugaaauugcuauccggccgaagguccgcgaucaggaggggagaaugaauuacuauuggacccugguugagcccggagacaaaauuacguucgaagccacaggcaaccugguggugccucgguacgcguuugccauggagcgcaacgcugggucuggaaucauuaucuccgauacccccgucaaugacugcaacacaaccugucaaaccccuaagggcgccaucaauacaagccuccccuuccagaacauucauccgaucacgauuggcaagugcccuaaauaugugaagucuaccaaacugagacuugcuacagggcugcggaauguucccagcauccagucccgcggacucuuuggcgccauugccggguucaucgaaggaggcuggaccgggaugguggacggaugguacggcuaucaccaucagaacgagcaaggcucuggguacgcugcggaucuuaagagcacacagaaugccaucgacaaaauuaccaacaaggucaauuccgugaucgaaaagaugaacacgcaguuuacagcuguuggaaaagaguucaaucaccuugagaagagaauugaaaaccugaauaaaaagguggaugacggcuuccucgauaucuggaccuacaacgccgagcugcugguccuccuggaaaaugagcggacccuugacuaucacgauagcaacgugaaaaaccuguacgaaaagguccgcucucagcucaagaauaacgccaaagagauugggaauggauguuuugaguucuaucauaagugcgacaacacauguauggaauccgugaaaaauggcaccuacgauuauccuaaguacagcgaggaagcuaaacugaacagagaggaaaucgacgggguuaagcuggagucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 187626 - RNA, 1701 nt, Artificial Sequence; identical to SEQ ID NO: 186857
  derived and/or modified sequence opt5 from hemagglutinin__InfluenzaA__ADF27975

SEQ ID NO: 187627 - RNA, 1701 nt, Artificial Sequence; identical to SEQ ID NO: 186865
  derived and/or modified sequence opt5 from hemagglutinin__InfluenzaA__ADF27985

SEQ ID NO: 187628 - RNA, 1701 nt, Artificial Sequence
  derived and/or modified sequence opt5 from hemagglutinin__InfluenzaA__ADF27995
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgccaaccuccuggaagauaagcacaaugggaaacuuuguaagcugagaggaguggcuccccuccaucugggcaaaugcaacaucgccggguggauucugggaaauccugagugugaaucucucagcacagccuccucuuggagcuacaucguugagaccuccucuagcgacaacggcacgugcuauccgggggauuuuauugacuacgaagaacugcgggagcagcuuuccagcgugucuuccuucgaacgcuuugagaucuuccccaagaccagcucuuggccuaaucacgauuccaacaagggagucacagcugccuguccccaugcgggcgccaagagcuuuuauaagaaucugaucuggcucgugaaaaagggcaacucuuacccuaaacuguccaagagcuauauuaaugacaaggggaaagaaguucuugugcuguggggaauccaccaccccuccaccaacgcugaucaacagucucucuaccagaaugccgacgcuuacgucuucgugggcacaagcagauauuccaagaaauuuaagccugagauugccauccggccgaaagugcgcgaucaggaggggagaaugaacuacuauuggacccuggucgaacccggagacaagauuacguucgaggcgacaggcaaccugguugugccucgguacgccuuugcuauggaacgcaaugccgggagcggaaucauuaucucugauacccccgcucaugacugcaacacaaccugucaaaccccuaaaggcgccaucaauacaucccuccccuuccagaacauucacccgaucacgauuggcaagugcccuaaguaugugaaaagcaccaagcugagacuugccacagggcugcggaauauccccucuauucagagccgcggacucuuuggcgcuaucgcgggguucaucgagggaggcuggaccgggauggucgacggaugguacggcuaucaucaccagaacgaacaaggcuccggguacgccgcugaucugaaaucuacacagaaugccauugacgagaucaccaacaaggugaauagcguuauugagaaaaugaacacgcaguuuacagccgugggaaaggaguucaaucaccuugagaagagaaucgaaaaccugaauaaaaaggucgaugacggcuuccucgauauuuggaccuacaacgcugagcugcuggugcuccuggaaaaugagcggacccuugacuaucaugauuccaacguuaaaaaccuguacgagaaggugcgcagccagcucaaaaauaacgccaaggaaaucgggaauggauguuuugaguucuaucacaagugcgacaacacauguauggaaucugucaaaaauggcaccuacgauuauccuaaguacuccgaggaagcgaaacugaacagagaggagaucgacggggugaaacuugaaagcacacggauuuaucaaauccuggcuauuuacucuacggucgccuccagccucgugcugguugugucccugggcgccaucucuuuuuggaugugcagcaauggaucccuccagugccgcauuuguaucuga

SEQ ID NO: 187629 - RNA, 1701 nt, Artificial Sequence; identical to SEQ ID NO: 187245
  derived and/or modified sequence opt5 from hemagglutinin__InfluenzaA__ADF28005

SEQ ID NO: 187630 - RNA, 1701 nt, Artificial Sequence; identical to SEQ ID NO: 187245
  derived and/or modified sequence opt5 from hemagglutinin__InfluenzaA__ADF28015

SEQ ID NO: 187631 - RNA, 1701 nt, Artificial Sequence; identical to SEQ ID NO: 186857
  derived and/or modified sequence opt5 from hemagglutinin__InfluenzaA__ADF28025

SEQ ID NO: 187632 - RNA, 1701 nt, Artificial Sequence; identical to SEQ ID NO: 186857
  derived and/or modified sequence opt5 from hemagglutinin__InfluenzaA__ADF28045

SEQ ID NO: 187633 - RNA, 1701 nt, Artificial Sequence
  derived and/or modified sequence opt5 from hemagglutinin__InfluenzaA__ADF28055
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaauuaugauuccaacaagggagugacagccgcuuguccccacgccggcgcgaaaucuuuuuacaagaaucugaucuggcucguuaaaaagggcaacagcuauccuaaacuguccaagagcuacauuaaugacaaggggaaagaagugcuuguccuguggggaauccaucaccccuccaccucugccgaucaacagagccucuaccagaacgcugacgccuauguguucgugggcacauccagauacagcaagaaauuuaagccugagauugcuauccggccgaaaguccgcgaucaggaggggagaaugaauuauuacuggacccugguugaacccggagacaagauuacguucgaggccacaggcaaccugguggugccucgguaugcguuugccauggaacgcaacgcugggucuggaaucauuaucuccgauacccccguccacgacugcaauacaaccugucaaaccccuaaaggcgccaucaacacaagccuccccuuccagaauauucauccgaucacgauuggcaagugcccuaaguacgugaaaucuaccaagcugagacuugcuacagggcugcggaacguucccagcauccagucccgcggacucuuuggcgccauugccggguucaucgagggaggcuggaccgggaugguggacggaugguauggcuaccaccaucagaaugaacaaggcucuggguacgcugcggaucugaaaagcacacagaacgccaucgacaagauuaccaauaaagucaacuccgugaucgagaagaugaauacgcaguuuacagcuguuggaaaggaguucaaccaccuugagaaaagaauugagaaucugaacaagaaaguggaugacggcuuccucgauaucuggaccuauaaugccgaacugcugguccuccuggagaacgaacggacccuugacuaccacgauagcaaugugaagaaccuguaugagaaaguccgcucucagcucaagaacaaugccaaggagauugggaacggauguuuugaguucuaccauaaaugcgacaauacauguauggaauccgugaagaacggcaccuaugauuacccuaaauauagcgaagaggcuaagcugaauagagaagagaucgacgggguuaaacuugagucuacacggaucuaccaaauucuggccaucuacuccacgguggcgagcucccucguccuggugguuucucugggcgcuauuagcuuuuggaugugcuccaacggaucucuccagugccgcaucuguauuuga

SEQ ID NO: 187634 - RNA, 1701 nt, Artificial Sequence; identical to SEQ ID NO: 186857
  derived and/or modified sequence opt5 from hemagglutinin__InfluenzaA__ADF28065

SEQ ID NO: 187635 - RNA, 1701 nt, Artificial Sequence; identical to SEQ ID NO: 185875
  derived and/or modified sequence opt5 from hemagglutinin__InfluenzaA__ADF28075

SEQ ID NO: 187636 - RNA, 1701 nt, Artificial Sequence; identical to SEQ ID NO: 186794
  derived and/or modified sequence opt5 from hemagglutinin__InfluenzaA__ADF28085

SEQ ID NO: 187637 - RNA, 1701 nt, Artificial Sequence; identical to SEQ ID NO: 185873
  derived and/or modified sequence opt5 from hemagglutinin__InfluenzaA__ADF28107

SEQ ID NO: 187638 - RNA, 1701 nt, Artificial Sequence; identical to SEQ ID NO: 187245
  derived and/or modified sequence opt5 from hemagglutinin__InfluenzaA__ADF28117

SEQ ID NO: 187639 - RNA, 1701 nt, Artificial Sequence
  derived and/or modified sequence opt5 from hemagglutinin__InfluenzaA__ADF29918
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccagaagcuauauuaaugacaaggggaaggaagugcuuguccuguggggaauccaccaccccuccaccucugccgaucaacagagccucuaccagaacgcugacgccuacguguucgugggcacaucccgguauagcaaaaaguuuaaaccugagauugcuauccgcccgaaggucagaaaucaggaggggcggaugaacuacuauuggacccugguugaacccggagauaaaauuacguucgaggccacaggcaaccugguggugccucgcuacgcguuugccauggaaagaaaugcugggucuggaaucauuaucuccgacacccccguccaugauugcaacacaaccugucaaaccccuaagggcgccaucaauacaagccuccccuuccagaacauucacccgaucacgauuggcaaaugcccuaaguaugugaagucuaccaaacugcggcuugcuacagggcugcgcaauguucccagcauccaguccagaggacucuuuggcgccauugccggguucaucgagggaggcuggaccgggaugguggacggaugguacggcuaucaucaccagaacgaacaaggcucuggguacgcugcggaccuuaagagcacacagaaugccaucgaugagauuaccaacaaagucaauuccgugaucgagaagaugaacacgcaguuuacagcuguuggaaaagaguucaaucaccuggagaagcggauugaaaaccugaauaagaaaguggacgauggcuuccucgacaucuggaccuacaacgccgagcugcugguccuccuggaaaaugagcgcacccuugauuaucaugacagcaacgugaagaaccuguacgagaaagucagaucucagcucaagaauaacgccaaagaaauugggaauggauguuuugaguucuaucacaagugcgauaacacauguauggaauccgugaagaauggcaccuacgacuauccuaaauacagcgaggaagcuaagcugaaccgggaggagaucgaugggguuaaacuugaaucuacacgcaucuaucaaauucuggccaucuacuccacgguggcgagcucccucguccuggugguuucucugggcgcuauuagcuuuuggaugugcuccaauggaucucuccagugcagaaucuguauuuga

SEQ ID NO: 187640 - RNA, 1701 nt, Artificial Sequence
  derived and/or modified sequence opt5 from hemagglutinin__InfluenzaA__ADF42689
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggaucuaucaaauucuggccaucuacuccacgguggcgagcucccucguccuggcugugucucugggcgccauuggauuuuggaugugcagcaacggcucccuccagugccgcaucuguauuuga

SEQ ID NO: 187641 - RNA, 1701 nt, Artificial Sequence
  derived and/or modified sequence opt5 from hemagglutinin__InfluenzaA__ADF42699
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggacacuuuguaaacugagaggaguugcgccccuccaucugggcaagugcaacaucgccggguggauucugggaaauccugagugugaaucucucagcaccgcuuccucuuggagcuacaucguggagacguccucuagcgacaacggaaccugcuauccgggggauuuuauugacuacgaagaacugcgggagcagcuuuccagcgucucuuccuucgaacgcuuugagauguuccccaaaacaagcucuuggccuaaucacgauuccaacaagggagugaccgccgcuuguccccaugccggcgccaagagcuuuuauaaaaaucugaucuggcucguuaagaaaggcaacucuuacccuaagcuguccaaaagcuauaucaaugacaaggggaaggaagugcuuguccuguggggcauucaccaccccuccacaucugccgaucaacagagccucuaccagaacgcugacgccuacguguucgugggcaccuccagauauagcaaaaaguuuaaaccugagaucgcuauucggccgaagguccgcgaucaggaggggagaaugaauuacuauuggacgcugguugaacccggagacaaaaucacauucgaggccaccggcaaccugguggugccucgguacgcguuugccauggaacgcaacgcugggucuggaauuaucauuuccgauacacccguccaugacugcaauaccaccugucaaacaccuaagggcgccaucaacacgagccuccccuuccagaauauccacccgauuaccaucggcaaaugcccuaaguaugugaagucuacaaaacugagacuugcuaccgggcugcggaacguucccagcauucagucccgcggacucuuuggcgccaucgccggguucauugagggaggcuggacagggaugguggacggaugguacggcuaucaucaccagaaugaacaaggcucuggguacgcugcggaucuuaagagcacccagaacgccaucgacgagaucacgaauaaagucaacuccgugauugagaagaugaauacacaguuuaccgcuguuggaaaagaguucaaccaccuggagaagagaaucgaaaaucugaacaagaaaguggaugacggcuuccucgauauuuggaccuacaaugccgagcugcugguccuccuggaaaacgagcggacacuugacuaucaugauagcaaugugaagaaccuguacgagaaaguccgcucucagcucaagaacaaugccaaagaaaucgggaacggauguuuugaguucuaucacaagugcgacaauaccuguauggaauccgugaagaacggcacauacgauuauccuaaauacagcgaggaagcuaagcugaauagagaggagauugacgggguuaaacuugaaucuacgcggaucuaucaaauccuggccauuuacuccaccguggcgagcucccucguccuggugguuucucugggcgcuaucagcuuuuggaugugcuccaacggaucucuccagugccgcauuuguaucuga

SEQ ID NO: 187642 - RNA, 1701 nt, Artificial Sequence; identical to SEQ ID NO: 186857
  derived and/or modified sequence opt5 from hemagglutinin__InfluenzaA__ADF42709

SEQ ID NO: 187643 - RNA, 1701 nt, Artificial Sequence; identical to SEQ ID NO: 186857
  derived and/or modified sequence opt5 from hemagglutinin__InfluenzaA__ADF42719

SEQ ID NO: 187644 - RNA, 1701 nt, Artificial Sequence; identical to SEQ ID NO: 186857
  derived and/or modified sequence opt5 from hemagglutinin__InfluenzaA__ADF42729

SEQ ID NO: 187645 - RNA, 1701 nt, Artificial Sequence; identical to SEQ ID NO: 186857
  derived and/or modified sequence opt5 from hemagglutinin__InfluenzaA__ADF42739

SEQ ID NO: 187646 - RNA, 1701 nt, Artificial Sequence
  derived and/or modified sequence opt5 from hemagglutinin__InfluenzaA__ADF58349
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccugaucacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgagagagaagggcggaugaacuacuauuggacccugguugagcccggagacaagauuacguucgaagccacaggcaaucugguggugccucgcuacgcguuugccauggagagaaacgcugggucuggaaucauuaucuccgauacccccguccaugacugcaacacaaccugucagaccccuaaaggcgccaucaauacaagccuccccuuccaaaacauucacccgaucacgauuggcaagugcccuaaguaugugaaaucuaccaagcugcggcuugcuacagggcugcgcaauguucccagcauccaguccagaggacucuuuggcgccauugccggguucaucgaaggaggcuggaccgggaugguggacggaugguacggcuaucaucaccagaacgagcagggcucuggguacgcugcggaucugaaaagcacacaaaaugccaucgacgagauuaccaacaaggucaauuccgugaucgaaaagaugaacacgcaguuuacagcuguuggaaaggaguucaaucaccuugaaaagcggauugagaaccugaauaaaaagguggaugacggcuuccucgauaucuggaccuacaacgccgaacugcugguccuccuggagaaugagcgcacccuugacuaucaugauagcaacgugaaaaaucuguacgaaaaggucagaucucagcucaaaaacaacgccaaggagauugggaauggauguuuugaguucuaucacaagugcgacaacacauguauggaguccgugaaaaauggcaccuacgauuauccuaaguacagcgaagaggcuaaacugaaccgggaggaaaucgacgggguuaaacuugagucuacacgcaucuaucagauucuggccaucuacuccacgguggcgagcucccucguccuggugguuucucugggcgcuauuagcuuuuggaugugcuccaauggaucucuccaaugcagaaucuguauuuga

SEQ ID NO: 187647 - RNA, 1701 nt, Artificial Sequence; identical to SEQ ID NO: 187290
  derived and/or modified sequence opt5 from hemagglutinin__InfluenzaA__ADF58351

SEQ ID NO: 187648 - RNA, 1701 nt, Artificial Sequence
  derived and/or modified sequence opt5 from hemagglutinin__InfluenzaA__ADF80454
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccugagggcgccaucaacacaagccuccccuuccagaauauucacccgaucacgauuggcaaaugcccuaaguaugugaagucuaccaaacugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaucuuaagagcacacagaacgccaucgacgagauuaccaauaaagucaacuccaucauugaaaagaugaauacgcaguuuacagcugugggaaaagaguucaaccaccuggaaaagagaaucgagaaucugaacaagaaaguugaugacggcuuccucgauauuuggaccuacaaugccgaacugcuggugcuccuggagaacgagcggacccuugacuaucaugauagcaaugucaagaaccuguacgaaaaagugcgcucucagcucaagaacaaugccaaagagaucgggaacggauguuuugaguucuaucacaagugcgacgauacauguauggaguccgucaagaauggcaccuacgacuauccuaaauacagcgaagaggcuaagcugaacagagaggaaaucgauggggugaaacuugagucuacacggauuuaucaaauccuggccauuuacuccacgguugcgagcucccucgugcuggucgugucucugggcgcuaucagcuuuuggaugugcuccaauggaucucuccagugccgcauuuguaucuga

SEQ ID NO: 187649 - RNA, 1701 nt, Artificial Sequence
  derived and/or modified sequence opt5 from hemagglutinin__InfluenzaA__ADF80462
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccaacucugacaauggcacgugcuauccgggggauuuuauugacuacgaagaacugcgggagcagcuuagcuccgucagcucuuucgaacgcuuugagaucuuccccaagaucuccagcuggccuaaccacgauucuaauaagggagugaccgccgcuuguccccaugccggcgcgaaauccuuuuauaagaaccugauuuggcucguuaaaaagggcaauagcuacccuaaacugucuaaguccuauaucaacgacaaggggaaagaagugcuuguccuguggggcauucaccaccccagcacauccgccgaucaacagucucucuaccagaaugcugacgccuacguguucgugggaaccagcagauauuccaagaaauuuaagccugagaucgcuauucggccgaaaguccgcgaucaggaggggagaaugaacuacuauuggacacugguugaacccggagacaagaucaccuucgaggccacgggcaaccugguggugccucgguacgcguuugccauggaacgcaaugcugggagcggaauuaucaucucugauacacccguccaugacugcaacaccacaugucaaaccccuaaaggcgccauuaauaccucccuccccuuccagaacauccacccgauuacaaucggcaagugcccuaaguaugugaaaagcacgaagcugagacuugcuaccgggcugcggaauguucccucuauucagagccgcggacucuuuggcgccaucgccggguucaucgagggaggcuggacagggaugguggacggaugguacggcuaucaucaccagaacgaacaaggcuccggguacgcugcggaucugaaaucuacccagaaugccauugacgagaucacaaacaaggucaauagcgugauugagaaaaugaacacccaguuuacggcuguuggaaaggaguucaaucaccuugagaagagaaucgaaaaccugaauaaaaagguggaugacggcuuccucgauauuuggacauacaacgccgagcugcugguccuccuggaaaaugagcggacccuugacuaucaugauuccaacgugaaaaaccuguacgagaagguccgcagccagcucaaaaauaacgccaaggaaaucgggaauggauguuuugaguucuaucacaagugcgacaacaccuguauggaaucugugaaaaauggcacauacgauuauccuaaguacuccgaggaagcuaaacugaacagagaggagaucgacgggguuaaacuugaaagcacccggauuuaucaaauccuggccauuuacucuacaguggcguccagccucguccuggugguuucccugggcgcuaucucuuuuuggaugugcagcaauggaucccuccagugccgcauuuguaucuga

SEQ ID NO: 187650 - RNA, 1701 nt, Artificial Sequence; identical to SEQ ID NO: 185693
  derived and/or modified sequence opt5 from hemagglutinin__InfluenzaA__ADF80470

SEQ ID NO: 187651 - RNA, 1701 nt, Artificial Sequence
  derived and/or modified sequence opt5 from hemagglutinin__InfluenzaA__ADF80478
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcagauauuccaagaaauuuaagccggagauugcuauccggcccaaaguccgcgaucaggaggggagaaugaauuacuauuggacccugguugaaccuggagacaagauuacguucgaggccacaggcaaccugauggugccccgguacgcguuugccauggaacgcaacgcugggagcggaaucauuaucucugauaccccugugcaugacugcaauacaaccugucaaacccccaaaggcgccaucaacacaucccucccguuccagaauauucacccuaucacgauuggcaagugccccaaguaugucaaaagcaccaagcugagacuugcuacagggcugcggaacgugccuucuauccagagccgcggacucuuuggcgccauugccggguucaucgagggaggcuggaccgggaugguugacggaugguacggcuaucaucaccagaaugaacaaggcuccggguacgcugcggaucugaaaucuacacagaacgccaucgacgagauuaccaauaaggugaacagcgucaucgagaaaaugaauacgcaguuuacagcugugggaaaggaguucaaccaccuugagaagagaauugaaaaucugaacaaaaagguugaugacggcuuccucgauaucuggaccuacaaugccgagcugcuggugcuccuggaaaacgagcggacccuugacuaucaugauuccaaugucaaaaaccuguacgagaaggugcgcagccagcucaaaaacaaugccaaggaaauugggaacggauguuuugaguucuaucacaagugcgacaauacauguauggaaucugucaaaaacggcaccuacgauuaucccaaguacuccgaggaagcuaaacugaauagagaggagaucgacggggugaaacuugaaagcacacggaucuaucaaauucuggccaucuacucuacgguugcguccagccucgugcuggucgugucccugggcgcuauuucuuuuuggaugugcagcaacggaucccuccagugccgcaucuguauuuga

SEQ ID NO: 187652 - RNA, 1701 nt, Artificial Sequence
  derived and/or modified sequence opt5 from hemagglutinin__InfluenzaA__ADF80494
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugcucgugccucgguacgcguuugccauggaacgcaacgcugggucuggaaucauuaucuccgauacccccgugcaugacugcaauacaaccugucaaaccccuaaaggcgccaucaacacaagccugcccuuccagaauauucacccgaucacgauuggcaagugcccuaaguaugucaaaucuaccaaacuuagacuggcuacagggcuccggaacgugcccagcauccagucccgcggacuguuuggcgccauugccggguucaucgagggaggcuggaccgggaugguugacggaugguacggcuaucaucaccagaaugaacaaggcucuggguacgcugcggaucuuaagagcacacagaacgccaucgacgagauuaccaauaaggugaacuccgucaucgagaaaaugaauacgcaguuuacagcugugggaaaggaguucaaccaccuggagaagagaauugaaaaucucaacaaaaagguugaugacggcuuccuggauaucuggaccuacaaugccgagcugcucgugcugcuugaaaacgagcggacccuggacuaucaugauagcaaugucaaaaaccucuacgagaaggugcgcucucagcugaaaacaaacgccaaggaaauugggaauggauguuuugaguucuaucacaagugcgacaacaccuguauggaauccgucaaaaauggcacauacgauuauccuaaguacagcgaggaagcuaaacuuaacagagaggagaucgacggggugaagcuggaaucuacgcggaucuaucaaauucucgccaucuacuccaccguugcgagcucccuggugcuggucgugucucucggcgcuauuagcuuuuggaugugcuccaauggaucucugcagugccgcaucuguauuuga

SEQ ID NO: 187653 - RNA, 1701 nt, Artificial Sequence; identical to SEQ ID NO: 187652
  derived and/or modified sequence opt5 from hemagglutinin__InfluenzaA__ADF80498

SEQ ID NO: 187654 - RNA, 1701 nt, Artificial Sequence; identical to SEQ ID NO: 186317
  derived and/or modified sequence opt5 from hemagglutinin__InfluenzaA__ADF80502

SEQ ID NO: 187655 - RNA, 1701 nt, Artificial Sequence
  derived and/or modified sequence opt5 from hemagglutinin__InfluenzaA__ADF80506
augaaggccauccuggugguccuccuguacaccuucgcuacagccaacgcggacacgcuuugcauuggcuaucacgcuaauaacagcaccgauacaguugacaccgugcuggagagaaaugugacagucacccauuccgugaaccuccuggaagauaaacacaaugggaagcuguguaaacugcggggaguugcgccccuccaucugggcaagugcucuaucgccggguggauucugggaaacccugagugugaaagccucuccacagcuucuagcugguccuacaucguggagaccucuagcuccgacaauggcacgugcuauccgggggauuuuauugacuacgaagaacugcgcgagcagcuuagcucugucuccagcuucgaaagauuugagaucuuccccaaaaccucuuccuggccuaaccacgaucccaauaagggagugacagccgcuuguccucaugccggcgccaagagcuuuuauaaaaaccugaucuggcucguuaagaaagaaaauucuuaccccaagcuguccaaaagcuauauuaacgacaagggcaaggaggugcuuguccugugggggauccaccacccuuccaccucugccgaucaacagagccucuaccagaaugcugacgccuacguguucgugggaacaucccgguauagcaaaaaguuuaaaccggagauugcuauccgccccaaggucagagaucaggaaggccggaugaacuacuauuggacccugguugagccuggggacaaaauuacguucgaagccacaggaaaucugguggugccccgcuacgcguuugccauggagagaaacgcuggcucugggaucauuaucuccgauaccccuguccaugacugcaacacaaccugucaaacccccaagggagccaucaauacaagccucccguuccagaacauucacccuaucacgauuggcaaaugccccaaguaugugaagucuaccaaacugcggcuugcuacaggccugcgcaauguuccuagcauccaguccagagggcucuuuggagccauugccggcuucaucgaagggggauggaccggcaugguggacgggugguacggauaucaucaccagaacgagcaaggcucuggcuacgcugcggaucuuaagagcacacagaaugccaucgacgagauuaccaacaaagucaauuccgugaucgaaaagaugaacacgcaguuuacagcuguugggaaagaguucaaucaccuugaaaagcggauugagaaccugaauaagaaaguggaugacggauuccucgauaucuggaccuacaacgccgaacugcugguccuccuggagaaugagcgcacccuugacuaucaugauagcaacgugaagaaucuguacgaaaaagucagaucucagcucaagaacaacgccaaagagauuggcaauggguguuuugaguucuaucacaagugcgacaacacauguauggaguccgugaagaauggaaccuacgauuaucccaaauacagcgaagaggcuaagcugaaccgggaggaaaucgacggcguuaaacuugagucuacacgcaucuaucaaauucuggccaucuacuccacgguggcgagcucccucguccuggugguuucucugggggcuauuagcuuuuggaugugcuccaauggcucucuccagugcagaaucuguauuuga

SEQ ID NO: 187656 - RNA, 1701 nt, Artificial Sequence
  derived and/or modified sequence opt5 from hemagglutinin__InfluenzaA__ADF83741
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauccgcagaucuaagaacuccuuuuucagccggcugaauuggcucacacaucugaacuuuaaauauccugcccuuaaugucaccaugcccaacaacgagcaguucgacaagcuguacauuuggggcgugcaccauccugggacggauaaagaccagaucuuucucuaugcgcaagccucuggacgcauuacaguuuccaccaagagaagccagcagacagcuaucccgaauauuggcucccggccccgcgugagaaacaucccuucucggaucagcauuuacuggaccaucgucaaacccggggauauucugcugaucaauuccaccggaaaccucauugccccucgcggcuacuucaagaucagaagcgggaagucuuccgugaugcggagcgacgcucccaucggaaaauguaauucugacugcauuacaccgaacggcagcaucccuaaugauaagcccuuucagaacgugaaucgcauuacguauggcgccuguccuagauacgucaaacaaaacacccugaaacuugcgacagggaugcggaauguucccgagaagcagacccgcggaaucuucggcgccauugcuggguuuaucgaaaacggaugggagggcaugguggacgggugguauggauucagacaccaaaauuccgaaggccggggccaggccgcugaucugaagucuacacaggccgccaucgaccagauuaacgggaaacucaauagacugaucggaaagaccaacgagaaguuccaccagauugagaaagaauuuagcgagguggaaggccgcauccaagaucuugagaaguacgucgaagacacgaaaauugaucugugguccuauaacgcugagcuccugguggcgcuggagaaucagcauacaaucgaccucaccgauagcgaaaugaacaagcuguucgagaaaaccaagaagcagcuucgggaaaaugccgaggacauggggaacggaugcuuuaaaauuuaccacaagugugauaaugcuugcaucggcucuaucagaaacgggacauaugaccaugacguuuaccgcgaugaagcccugaauaaccgguuccagauuaaaggcguggagcucaaguccggauacaaagacuggauccuguggauuagcuuugccaucucuugcuuccuucugugugucgcucuccugggcuuuauuaugugggccugccaaaaggggaauaucagauguaacaucugcauuuga

SEQ ID NO: 187657 - RNA, 1701 nt, Artificial Sequence; identical to SEQ ID NO: 186435
  derived and/or modified sequence opt5 from hemagglutinin__InfluenzaA__ADF83752

SEQ ID NO: 187658 - RNA, 1701 nt, Artificial Sequence; identical to SEQ ID NO: 187245
  derived and/or modified sequence opt5 from hemagglutinin__InfluenzaA__ADF83763

SEQ ID NO: 187659 - RNA, 1701 nt, Artificial Sequence; identical to SEQ ID NO: 187245
  derived and/or modified sequence opt5 from hemagglutinin__InfluenzaA__ADF83773

SEQ ID NO: 187660 - RNA, 1701 nt, Artificial Sequence
  derived and/or modified sequence opt5 from hemagglutinin__InfluenzaA__ADF83783
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgacgaccaucggcaagugcccuaaguaugugaaaucuacaaagcugagacuugcuaccgggcugcggaacguucccagcauucagucccgcggacucuuuggcgccaucgccggguucauugagggaggcuggacagggaugguggacggaugguacggcuaucaucaccagaaugaacaaggcucuggguacgcugcggaucugaaaagcacccagaacgccaucgacgagaucacgaauaaggucaacuccgugauugagaaaaugaauacacaguuuaccgcuguuggaaaggaguucaaccaccuugagaagagaaucgaaaaucugaacaaaaagguggaugacggcuuccucgauauuuggaccuacaaugccgagcugcugguccuccuggaaaacgagcggacacuugacuaucaugauagcaaugugaaaaaccuguacgagaagguccgcucucagcucaaaaacaaugccaaggaaaucgggaacggauguuuugaguucuaucacaagugcgacaauaccuguauggaauccgugaaaaacggcacauacgauuauccuaaguacagcgaggaagcuaaacugaauagagaggagauugacgggguuaaacuugaaucuacgcggaucuaucaaauccuggccauuuacuccaccguggcgagcucccucguccuggugguuucucugggcgcuaucagcuuuuggaugugcuccaacggaucucuccagugccgcauuuguaucuga

SEQ ID NO: 187661 - RNA, 1701 nt, Artificial Sequence; identical to SEQ ID NO: 187320
  derived and/or modified sequence opt5 from hemagglutinin__InfluenzaA__ADF83793

SEQ ID NO: 187662 - RNA, 1701 nt, Artificial Sequence
  derived and/or modified sequence opt5 from hemagglutinin__InfluenzaA__ADF83803
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaacacucucuaccgccagcuccuggucuuacaucguggagacgagcuccucugacaacgggaccugcuauccgggcgauuuuauugacuacgaagaacugcgggagcagcuuagcuccgucagcucuuucgaacgcuuugagaucuuccccaagacauccagcuggccuaaucacgauucuaacaagggagugaccgccgcuuguccccaugccggcgcgaaauccuuuuauaagaaucugaucuggcucguuaaaaagggcaacagcuacccuaaacugucuaaguccuauauuaaugacaaggggaaagaagugcuuguccuguggggaauccaccaccccagcacauccgccgaucaacagucucucuaccagaacgcugacgccuacguguucgugggcaccagcagauauuccaagaaauuuaagccugagauugcuauccggccgaaaguccgcgaucaggaggggagaaugaauuacuauuggacgcugguugaacccggagacaagauuacauucgaggccaccggcaaccugguggugccucgguacgcguuugccauggaacgcaacgcugggagcggaaucauuaucucugauacacccguccaugacugcaauaccaccugucaaacaccuaaaggcgccaucaacacgucccuccccuuccagaaugugcacccgauuaccaucggcaagugcccuaaguauguuaaaagcacaaagcugagacuugcuaccgggcugcggaacgugcccucuauucagagccgcggacucuuuggcgccaucgccggguucauugagggaggcuggacagggauggucgacggaugguacggcuaucaucaccagaaugaacaaggcuccggguacgcugcggaucugaaaucuacccagaacgccaucgacgagaucacgaauaaggugaacagcguuauugagaaaaugaauacacaguuuaccgcugugggaaaggaguucaaccaccuugagaagagaaucgaaaaucugaacaaaaaggucgaugacggcuuccucgauauuuggaccuacaaugccgagcugcuggugcuccuggaaaacgagcggacacuugacuaucaugauuccaaugucaaaaaccuguacgagaaggugcgcagccagcucaaaaacaaugccaaggaaaccgggaacggauguuuugaguucuaucacaagugcgacaauacauguauggaaucuguuaaaaacggcacguacgauuauccuaaguacuccgaggaagcuaaacugaauagagaggagaucgacggggugaaacuugaaagcacccggauuuaucaaauccuggccaucuacucuacagucgcguccagccucgugcugguugugucccugggcgcuauuucuuuuuggaugugcagcaacggaucccuccagugccgcaucuguauuuga

SEQ ID NO: 187663 - RNA, 1701 nt, Artificial Sequence
  derived and/or modified sequence opt5 from hemagglutinin__InfluenzaA__ADF83813
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucuacagaucaacagagccucuaccagaacgccgacgcuuacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacgagauuacgaauaaggucaacuccgugaucgagaaaaugaauacacaguuuaccgccguuggaaaggaguucaaccaccuugagaagagaauugaaaaucugaacaaaaagguggaugacggcuuccucgauaucuggaccuacaaugcugagcugcugguccuccuggaaaacgagcggacacuugacuaucaugauagcaaugugaaaaaccuguacgagaagguccgcucucagcucaaaaacaaugccaaggaaauugggaacggauguuuugaguucuaucacaagugcgacaauaccuguauggaauccgugaaaaacggcacauacgauuauccuaaguacagcgaggaagccaaacugaauagagaggagaucgacgggguuaaacuugaaucuacgcggaucuaucaaauucuggcuaucuacuccaccguggccagcucccucguccuggugguuucucugggcgcgauuagcuuuuggaugugcuccaacggaucucuccagugccgcaucuguauuuga

SEQ ID NO: 187664 - RNA, 1701 nt, Artificial Sequence
  derived and/or modified sequence opt5 from hemagglutinin__InfluenzaA__ADF83823
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacuccuacguguucgugggcacaagcagauauucuaagaaauuuaagccugagauugccauccggccgaaaguccgcgaucaggaggggagaaugaauuacuauuggacccugguugaacccggagacaagauuacguucgaggcuacaggcaaccugguggugccucgguacgccuuugcgauggaacgcaacgccggguccggaaucauuaucagcgauacccccguccaugacugcaauacaaccugucaaaccccuaaaggcgcuaucaacacaucucuccccuuccagaauauucacccgaucacgauuggcaagugcccuaaguaugugaaaagcaccaagcugagacuugccacagggcugcggaacauccccuccauucagucucgcggacucuuuggcgcuaucgccggguucaucgagggaggcuggaccgggaugguugacggaugguacggcuaucaucaccagaaugaacaaggcagcggguacgccgcugaucugaaauccacacagaacgcgauugacgagaucaccaauaaggugaacagcgucauugagaaaaugaauacgcaguuuacagccgugggaaaggaguucaaccaccuugagaagagaaucgaaaaucugaacaaaaagguugaugacggcuuccucgauauuuggaccuacaaugcugagcugcuggugcuccuggaaaacgagcggacccuugacuaucaugauucuaaugucaaaaaccuguacgagaaggugcgcucccagcucaaaaacaaugccaaggaaaucgggaacggauguuuugaguucuaucacaagugcgacaauacauguauggaaagcgucaaaaacggcaccuacgauuauccuaaguacucugaggaagccaaacugaauagagaggagaucgacggggugaaacuugaauccacacggauuuaucaaauccuggcuauuuacagcacgguugccuccucucucgugcuggucgugagccugggcgcgaucuccuuuuggaugugcucuaacggaagccuccagugccgcauuuguaucuga

SEQ ID NO: 187665 - RNA, 1701 nt, Artificial Sequence; identical to SEQ ID NO: 187245
  derived and/or modified sequence opt5 from hemagglutinin__InfluenzaA__ADF83833

SEQ ID NO: 187666 - RNA, 1701 nt, Artificial Sequence; identical to SEQ ID NO: 187245
  derived and/or modified sequence opt5 from hemagglutinin__InfluenzaA__ADF83843

SEQ ID NO: 187667 - RNA, 1701 nt, Artificial Sequence; identical to SEQ ID NO: 187245
  derived and/or modified sequence opt5 from hemagglutinin__InfluenzaA__ADF83853

SEQ ID NO: 187668 - RNA, 1701 nt, Artificial Sequence
  derived and/or modified sequence opt5 from hemagglutinin__InfluenzaA__ADF83873
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccaacuccuggucuuacaucguggagaccagcuccucugacaauggcacgugcuauccgggggauuuuauugacuacgaagaacugcgggagcagcuuagcuccgucagcucuuucgaacgcuuugagaucuuccccaagaccuccagcuggccuaaccacgauucuaauaagggagugacagccgcuuguccccaugccggcgcgaaauccuuuuauaagaaccugaucuggcucguuaaaaagggcaauagcuacccuaaacugucuaaguccuauauuaacgacaaggggaaagaagugcuuguccuguggggaauccaccaccccagcaccuccacagaucaacagucucucuaccagaaugccgacgcuuacguguucgugggcaccagcagauauuccaagaaauuuaagccugagauugccauccggccgaaaguccgcgaucaggaggggagaaugaacuacuauuggacgcugguugaacccggagacaagauuacauucgaggcuaccggcaaccugguggugccucgguacgccuuugcgauggaacgcaaugccgggagcggaaucauuaucucugauacacccguccaugacugcaacaccaccugucaaacaccuaaaggcgcuaucaauacgucccuccccuuccagaacauucacccgaucaccauuggcaagugcccuaaguaugugaaaagcacaaagcugagacuugccaccgggcugcggaauguucccucuauccagagccgcggacucuuuggcgcuauugccggguucaucgagggaggcuggacagggaugguggacggaugguacggcuaucaucaccagaacgaacaaggcuccggguacgccgcugaucugaaaucuacccagaaugcgaucgacaagauuacgaacaaagucaauagcgugaucgagaagaugaacacacaguuuaccgccguuggaaaggaguucaaucaccuugagaaaagaauugagaaccugaauaagaaaguggaugacggcuuccucgauaucuggaccuacaacgcugaacugcugguccuccuggagaaugaacggacacuugacuaucaugauuccaacgugaagaaccuguacgagaaaguccgcagccagcucaagaauaacgccaaggagauugggaauggauguuuugaguucuaucacaaaugcgacaacaccuguauggaaucugugaagaauggcacauacgauuauccuaaauacuccgaagaggccaagcugaacagagaagagaucgacgggguuaaacuugagagcacgcggaucuaucaaauucuggcuaucuacucuaccguggccuccagccucguccuggugguuucccugggcgcgauuucuuuuuggaugugcagcaauggaucccuccagugccgcaucuguauuuga

SEQ ID NO: 187669 - RNA, 1701 nt, Artificial Sequence; identical to SEQ ID NO: 186857
  derived and/or modified sequence opt5 from hemagglutinin__InfluenzaA__ADF83885

SEQ ID NO: 187670 - RNA, 1701 nt, Artificial Sequence
  derived and/or modified sequence opt5 from hemagglutinin__InfluenzaA__ADF83895
augaaggccauccuggugguccuccuguacaccuucgcuacaguuaacgccgacacgcuuugcauuggcuaucacgcgaauaacagcaccgauacaguggacaccgugcuggagaaaaaugucacagugacccauuccguuaaccuccuggaagauaagcacaaugggaaacuuuguaagcugagaggaguggcuccccuccaucugggcaaaugcaacaucgccggguggauucugggaaauccugagugugaaucucucagcacagccuccucuuggagcuacaucgucgagaccuccucuagcgacaacggcacgugcuauccgggggauuuuauugacuacgaagaacugcgggagcagcuuuccagcgugucuuccuucgaacgcuuugagaucuuccccaagaccagcucuuggccuaaucacgauuccaacaagggaguuacagcugccuguccccaugcuggcgccaagagcuuuuauaaaaaucugaucuggcucgugaaaaagggcaacucuuacccuaaacuguccaagagcuauauuaaugacaaggggaaagaaguccuugugcuguggggaauccaccaccccuccaccucugcggaucaacagagccucuaccagaacgccgacgcuuacguguucgucggcacauccagauauagcaagaaauuuaagccugagauugccauccggccgaaaguucgcgaucaggaggggagaaugaauuacuauuggacccugguggaacccggagacaagauuacguucgaggcuacaggcaaccugguggucccucgguacgccuuugcgauggaacgcaacgccgggucuggaaucauuaucuccgauacccccgugcaugacugcaauacaaccugucaaaccccuaaaggcgcuaucaacacaagccuccccuuccagaauauucacccgaucacgauuggcaagugcccuaaguauguuaaaucuaccaagcugagacuugccacagggcugcggaacgugcccagcauccagucccgcggacucuuuggcgcuauugccggguucaucgagggaggcuggaccgggauggucgacggaugguacggcuaucaucaccagaaugaacaaggcucuggguacgccgcugaucugaaaagcacacagaacgcgaucgacaagauuaccaauaaagugaacuccguuaucgagaagaugaauacgcaguuuacagccgugggaaaggaguucaaccaccuugagaaaagaauugagaaucugaacaagaaagucgaugacggcuuccucgauaucuggaccuacaaugcugaacugcuggugcuccuggagaacgaacggacccuugacuaucaugauagcaaugucaagaaccuguacgagaaaauucgcucucagcucaagaacaaugccaaggagaucgggaacggauguuuugaguucuaucacaaaugcgacaauacauguauggaauccgugaagaacggcaccuacgauuauccuaaauacagcgaagaggccaagcugaauagagaagagaucgacgggguuaaacuugagucuacacggauuuaucaaauccuggcuauuuacuccacgguggccagcucccucguccuggugguuucucugggcgcgaucagcuuuuggaugugcuccaacggaucucuccagugccgcauuuguaucuga

SEQ ID NO: 187671 - RNA, 1701 nt, Artificial Sequence; identical to SEQ ID NO: 187245
  derived and/or modified sequence opt5 from hemagglutinin__InfluenzaA__ADF83915

SEQ ID NO: 187672 - RNA, 1701 nt, Artificial Sequence
  derived and/or modified sequence opt5 from hemagglutinin__InfluenzaA__ADF84441
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuucccacgacagcaacaagggagugacagccgcuuguccccaugccggcgcgaaaucuuuuuauaagaaucugaucuggcucguuaaaaagggcaacuccuacccuaaacugagcaaguccuauauuaaugauaaggggaaagaagugcuuguccuguggggaauccaccaccccucuaccagcgccgaccaacagucccucuaccagaacgcugaugccuacguguucgugggcacaagcagauauucuaagaaauuuaagccugagauugcuauccggccgaaaguccgcgaccaggaggggagaaugaauuacuauuggacccugguugaacccggagauaagauuacguucgaggccacaggcaaccugguggugccucgguacgcguuugccauggaacgcaacgcuggguccggaaucauuaucagcgacacccccguccaugauugcaauacaaccugucaaaccccuaaaggcgccaucaacacaucucuccccuuccagaauauucacccgaucacgauuggcaagugcccuaaguaugugaaaagcaccaagcugagacuugcuacagggcugcggaacguucccuccauccagucucgcggacucuuuggcgccauugccggguucaucgagggaggcuggaccgggaugguggacggaugguacggcuaucaucaccagaaugaacaaggcagcggguacgcugcggaccugaaauccacacagaacgccaucgauaagauuaccaauaaagucaacagcgugaucgagaagaugaauauucaguuuacggcuguuggaaaggaguucaaccaccuugagaaaagaaucgagaaucugaacaagaaaguggacgauggcuuccucgacauuuggacauacaaugccgaacugcugguccuccuggagaacgaacggacccuugauuaucaugacucuaaugugaagaaccuguacgagaaaguccgcucccagcucaagaacaaugccaaggagaucgggaacggauguuuugaguucuaucacaaaugcgauaauaccuguauggaaagcgugaagaacggcacauacgacuauccuaaauacucugaagaggcuaagcugaauagagaagagaucgaugggguuaaacuugaguccacccggauuuaucaaauccuggccauuuacagcacaguggcguccucucucguccuggugguuagccugggcgcuaucuccuuuuggaugugcucuaacggaagccuccagugccgcauuuguaucuga

SEQ ID NO: 187673 - RNA, 1701 nt, Artificial Sequence; identical to SEQ ID NO: 186857
  derived and/or modified sequence opt5 from hemagglutinin__InfluenzaA__ADF84459

SEQ ID NO: 187674 - RNA, 1701 nt, Artificial Sequence; identical to SEQ ID NO: 187245
  derived and/or modified sequence opt5 from hemagglutinin__InfluenzaA__ADF84469

SEQ ID NO: 187675 - RNA, 1701 nt, Artificial Sequence; identical to SEQ ID NO: 187306
  derived and/or modified sequence opt5 from hemagglutinin__InfluenzaA__ADF84479

SEQ ID NO: 187676 - RNA, 1701 nt, Artificial Sequence; identical to SEQ ID NO: 187245
  derived and/or modified sequence opt5 from hemagglutinin__InfluenzaA__ADF84489

SEQ ID NO: 187677 - RNA, 1701 nt, Artificial Sequence; identical to SEQ ID NO: 187245
  derived and/or modified sequence opt5 from hemagglutinin__InfluenzaA__ADF85017

SEQ ID NO: 187678 - RNA, 1701 nt, Artificial Sequence; identical to SEQ ID NO: 187245
  derived and/or modified sequence opt5 from hemagglutinin__InfluenzaA__ADF87152

SEQ ID NO: 187679 - RNA, 1701 nt, Artificial Sequence
  derived and/or modified sequence opt5 from hemagglutinin__InfluenzaA__ADF87162
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacuccuacguguucgugggcacaagcaaguauucuaaaaaguuuaaaccugagauugccaucagaccgaagguccgggaucaggaggggcgcaugaauuacuauuggacccugguugaacccggagacaaaauuacguucgaggcuacaggcaaccugguggugccuagauacgccuuugcgauggaacggaacgccggguccggaaucauuaucagcgauacccccguccaugacugcaauacaaccugucaaaccccugagggcgcuaucaacacaucucuccccuuccagaauauucacccgaucacgauuggcaagugcccuaaguaugugaaaagcaccaagcugcgccuugccacagggcugagaaacguucccuccauccagucucggggacucuuuggcgcuauugccggguucaucgaaggaggcuggaccgggaugguggacggaugguacggcuaucaucaccagaaugagcaaggcagcggguacgccgcugaucugaaauccacacagaacgcgaucgacgagauuaccaauaaggucaacagcgugaucgaaaagaugaauacgcaguuuacagccguuggaaaggaguucaaccaccuugaaaagcgcauugagaaucugaacaaaaagguggaugacggcuuccucgauaucuggaccuacaaugcugaacugcugguccuccuggagaacgagagaacccuugacuaucaugauucuaaugugaaaaaccuguacgaaaagguccggucccagcucaaaaacaaugccaaggagauugggaacggauguuuugaguucuaucacaagugcgacaauacauguauggagagcgugaaaaacggcaccuacgauuauccuaaguacucugaagaggccaaacugaaucgcgaggaaaucgacgggguuaaacuugaguccacaagaaucuaucaaauucuggcuaucuacagcacgguggccuccucucucguccuggugguuagccugggcgcgauuuccuuuuggaugugcucuaacggaagccuccagugccggaucuguauuuga

SEQ ID NO: 187680 - RNA, 1701 nt, Artificial Sequence; identical to SEQ ID NO: 187245
  derived and/or modified sequence opt5 from hemagglutinin__InfluenzaA__ADF87172

SEQ ID NO: 187681 - RNA, 1701 nt, Artificial Sequence
  derived and/or modified sequence opt5 from hemagglutinin__InfluenzaA__ADF87182
augaacgccauccuggugguccuccuguacaccuucgcuacagccaaugcggacacgcuuugcauuggcuaucacgcuaacaauagcaccgauacaguugacacccugcucgagaagaacgugacagugacccauuccgucaaucugcuugaagauaaacacaacgggaagcuguguaaacucagaggaguggcgccccugcaucugggcaagugcaauaucgccggguggauucucggaaacccugagugugaaucucugagcacagcuuccucuuggagcuacaucguugagaccuccucuagcgacaauggcacgugcuauccgggggauuuuauugacuacgaagaacuucgggagcagcuguccagcgugucuuccuucgaacgcuuugagaucuuccccaaaaccagcucuuggccuaaccacgauuccaauaagggagucacagccgcuuguccccaugccggcgccaagagcuuuuauaaaaaccucaucuggcuggugaagaaaggcaauucuuacccuaaacuuuccaagagcuauauuaacgacaaggggaaggaaguucuggugcucuggggaauccaccaccccuccaccucugccgaucaacagagccuguaccagaaugcugacgccuacgucuucgugggcacauccagauauagcaaaaaguuuaaaccugagauugcuauccggccgaaggugcgcgaucaggaggggagaaugaacuaccauuggacccuggucgaacccggagacaaaauuacguucgaggccacaggcaaccucguugugccucgguaugcguuugccauggaacgcaaugcugggucuggaaucauuaucuccgaugcccccgugcacgacugcaacaccacaugucaaaccccuaagggcgcuaucaauaccagccugcccuuccagaacauucauccgaucacaauuggcaaaugcccuaaguacgucaagucuacgaaacuuagacuggccaccgggcuccggaaugugcccagcauccagucccgcggacuguuuggcgccauugcuggguucaucgagggaggcuggacagggaugguugacggaugguauggcuaccaccaccagaacgaacaaggcucuggguaugcggccgaucuuaagagcacccagaaugcuaucgacgagauuacaaacaaaaucaauuccgugauugagaagaugaacacccaguuuacggccgucggaaaagaguucaaucaucuggagaagagaaucgaaaaccucaauaagaaaguggaugacggcuuccuggauauuuggacauacaacgccgagcugcucguucugcuugaaaaugagcggacccuggacuaccacgauagcaacgugaagaaccucuaugagaaaguccgcucucagcugaagaauaacgcuaaagaaaucgggaauggauguuuugaguucuaccauaagugcgacaacaccuguauggaauccgugaagaauggcacauaugauuacccuaaauauagcgaggaagccaaacuuaacagagaggagaucgacggggucaagcuggaaucuacccggauuuaccaaauccucgcgauuuauuccacaguggcuagcucccugguucugguggucucucucggcgccaucagcuuuuggaugugcuccaauggaucucugcagugccgcauuuguaucuga

SEQ ID NO: 187682 - RNA, 1701 nt, Artificial Sequence; identical to SEQ ID NO: 187245
  derived and/or modified sequence opt5 from hemagglutinin__InfluenzaA__ADF87192

SEQ ID NO: 187683 - RNA, 1701 nt, Artificial Sequence
  derived and/or modified sequence opt5 from hemagglutinin__InfluenzaA__ADF87202
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguuugcugcggaucugaaaagcacacagaacgccaucgacaagauuaccaauaaagucaacuccgugaucgagaagaugaauacgcaguucacagcuguuggaaaggaguucaaccaccuugagaaaagaauugagaaucugaacaagaaaguggaugacggcuuucucgauaucuggaccuacaaugccgaacugcugguccuccuggagaacgaacggacccuugacuaccaugauagcaaugugaagaaccuguaugagaaaguccgcucucagcucaagaacaaugccaaggagauugggaacggauguuucgaauuuuaccacaaaugcgacaauacauguauggaguccgugaagaacggcaccuaugauuacccuaaauauagcgaagaggcuaagcugaauagagaagagaucgacgggguuaaacuugagucuacacggaucuaccaaauucuggccaucuauuccacgguggcgagcucccucguccuggugguuucucugggcgcuauuagcuucuggaugugcuccaacggaucucuccagugccgcaucuguauuuga

SEQ ID NO: 187684 - RNA, 1701 nt, Artificial Sequence; identical to SEQ ID NO: 187245
  derived and/or modified sequence opt5 from hemagglutinin__InfluenzaA__ADF87212

SEQ ID NO: 187685 - RNA, 1701 nt, Artificial Sequence; identical to SEQ ID NO: 187408
  derived and/or modified sequence opt5 from hemagglutinin__InfluenzaA__ADF87232

SEQ ID NO: 187686 - RNA, 1701 nt, Artificial Sequence; identical to SEQ ID NO: 187245
  derived and/or modified sequence opt5 from hemagglutinin__InfluenzaA__ADF87242

SEQ ID NO: 187687 - RNA, 1701 nt, Artificial Sequence
  derived and/or modified sequence opt5 from hemagglutinin__InfluenzaA__ADF87252
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaaaagcuacccuaagcuguccaagagcuauauuaaugauaaagggaaggaagugcuuguccuguggggaauccaccaccccuccaccucugccgaccaacagagccucuaccagaacgcugaugccuacguguucgugggcacauccagauauagcaaaaaguuuaaaccugagauugcuauccggccgaagguccgcgaccaggaggggagaaugaauuacuauuggacccugguugaacccggagauaaaauuacguucgaggccacaggcaaccugguggugccucgguacgcguuugccauggaacgcaacgcugggucuggaaucauuaucuccgacacccccguccaugauugcaauacaaccugucaaaccccuaagggcgccaucaacacaagccuccccuuccagaauauucacccgaucacgauuggcaagugcccuaaauaugugaagucuaccaaacugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaccuuaagagcacacagaacgccaucgauaaaauuaccaauaaggucaacuccgugaucgagaagaugaauacgcaguuuacagcuguuggaaaagaguucaaccaccuugaaaagagaauugagaaucugaacaaaaagguggacgauggcuuccucgacaucuggaccuacaaugccgaacugcugguccuccuggagaacgaacggacccuugauuaucaugacagcaaugugaaaaaccuguacgagaagguccgcucucagcucaagaacaaugccaaagagauugggaacggauguuuugaguucuaucacaagugcgauaauacauguauggaguccgugaaaaacggcaccuacgacuauccuaaguacagcgaagaggcuaaacugaauagagaagagaucgaugggguuaagcuggagucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 187688 - RNA, 1701 nt, Artificial Sequence; identical to SEQ ID NO: 187245
  derived and/or modified sequence opt5 from hemagglutinin__InfluenzaA__ADF87262

SEQ ID NO: 187689 - RNA, 1701 nt, Artificial Sequence; identical to SEQ ID NO: 186857
  derived and/or modified sequence opt5 from hemagglutinin__InfluenzaA__ADF87272

SEQ ID NO: 187690 - RNA, 1701 nt, Artificial Sequence; identical to SEQ ID NO: 186857
  derived and/or modified sequence opt5 from hemagglutinin__InfluenzaA__ADF87282

SEQ ID NO: 187691 - RNA, 1701 nt, Artificial Sequence
  derived and/or modified sequence opt5 from hemagglutinin__InfluenzaA__ADF87292
augaaggccauccuggugguccuccuguacaccuucgcuacagccaacgcggacacgcuuugcauuggcuaucacgcuaauaacagcaccgauacaguugacaccgugcugaaaaagaaugugacagucacccauuccgugaaccuccuggaggauaaacacaaugggaaacuuuguaaacugagaggaguugcuccccuccaucugggcaagugcaacaucgccggguggauucugggaaauccugaaugugagucucucagcacagccggcuccuggucuuacaucguggaaaccagcuccucugacaacgggacgugcuauccgggagauuuuauugacuacgaggaacugcgggagcagcuuagcuccgucagcucuuucgagcgcuuugaaaucuuccccaagaccuccagcuggccuaaucacgauucuaacaaaggcgugacagccgcuuguccccaugccggcgcgaaguccuuuuauaaaaaucugaucuggcucguuaagaaagggaacagcuacccuaagcugucuaaguccuauauuaaugacaaaggaaaggaggugcuuguccuguggggcauccaccaccccagcaccuccgccgaucaacagucucucuaccagaacgcugacgccuacguguucguggggacaagcagauauuccaaaaaguuuaaaccugaaauugcuauccggccgaagguccgcgaucaggagggaagaaugaauuacuauuggacccugguugagcccggcgacaaaauuacguucgaagccacagggaaccugguggugccucgguacgcguuugccauggagcgcaacgcuggaagcggcaucauuaucucugauacccccguccaugacugcaauacaaccugucaaaccccuaagggcgccaucaacacaucccuccccuuccagaauauucacccgaucacgauugggaagugcccuaaauauguuaagagcaccaaacugagacuugcuacaggacugcggaacgugcccucuauccagagccgcggccucuuuggggccauugccggauucaucgaaggcggguggaccggaaugguggacggcugguacggcuaucaucaccagaaugagcaaggguccggauacgcugcggaucugaagucuacacagaacgccaucgacgaaauuaccaauaaagucaacagcgugaucgagaagaugaauacgcaguuuacagcuguuggcaaggaguucaaccaccuugaaaagagaauugagaaucugaacaagaaaguggaugacggguuccucgauaucuggaccuacaaugccgaacugcugguccuccuggagaacgaacggacccuugacuaucaugauuccaaugugaagaaccuguacgagaaaguccgcagccagcucaagaacaaugccaaggagauuggaaacggcuguuuugaguucuaucacaaaugcgacaauauguguauggaaucugugaagaacgggacauacgauuauccuaaauacuccgaagaggcuaagcugaauagagaagagaucgacggcguuaaacuugagagcacccggaucuaucaaauucuggccaucuacucuacaguggcguccagccucguccuggugguuucccugggagcuauuucuuuuuggaugugcagcaacggcucccuccagugccgcaucuguauuuga

SEQ ID NO: 187692 - RNA, 1701 nt, Artificial Sequence; identical to SEQ ID NO: 186857
  derived and/or modified sequence opt5 from hemagglutinin__InfluenzaA__ADF87302

SEQ ID NO: 187693 - RNA, 1701 nt, Artificial Sequence
  derived and/or modified sequence opt5 from hemagglutinin__InfluenzaA__ADF87331
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccaacucugacaauggcacgugcuauccgggggauuuuauuaacuacgaagaacugcgggagcagcuuagcuccgucagcucuuucgaacgcuuugagaucuuccccaagaccuccagcuggccuaaucacgacucuaacaagggaaucacagccgcuuguccccaugccggcgcgaaauccuuuuauaagaaucugauuuggcucgugaaaaagggcaacagcuacccuaaacugucuaaguccuauaucaaugauaaggggaaagaaguucuugugcuguggggcauucaccaccccagcaccuccgccgaccaacagucucucuaccagaacgcugaugccuacgucuucgugggaagcuccagauauagcaagaaauuuaagccugagaucgcuauucggccgaaagugcgcgaccaggaggggagaaugaacuacuauuggacacuggucgaacccggagauaagaucaccuucgaggccacgggcaaucugguugugccucgguacgcguuugccauggaacgcaacgcugggucuggaauuaucaucuccgacacacccgugcaugauugcaauaccacaugucaaaccccuaaaggcgccauuaacaccagccuccccuuccagaauauccacccgauuacaaucggcaagugcccuaaguaugucaaaucuacgaagcugagacuugcuaccgggcugcggaacgugcccagcauucagucccgcggacucuuuggcgccaucgccggguucaucgagggaggcuggacagggaugguugacggaugguacggcuaucaucaccagaaugaacaaggcucuggguacgcugcggaccugaaaagcacccagaacgccauugauaagaucacaaauaaagugaacuccgucauugagaagaugaauacccaguuuacggcugugggaaaggaguucaaccaccuugagaaaagaaucgagaaucugaacaagaaaguugacgauggcuuccucgacauuuggacauacaaugccgaacugcuggugcuccuggagaacgaacggacccuugauuaucaugacagcaacgucaagaaucuguacgagaaagugcgcucucagcucaagaacaaugccaaggagaucgggaacggauguuuugaguucuaucacaaaugcgauaauaccuguauggaauccgucaagaacggcacauacgacuauccuaaauacagcgaagaggcuaagcugaauagagaagagaucgauggggugaaacuugagucuacccggauuuaucaaauccuggccauuuacuccacaguugcgagcucccucgugcuggucgugucucugggcgcuaucagcuuuuggaugugcuccaacggaucucuccagugccgcauuuguaucuga

SEQ ID NO: 187694 - RNA, 1701 nt, Artificial Sequence; identical to SEQ ID NO: 185693
  derived and/or modified sequence opt5 from hemagglutinin__InfluenzaA__ADF87341

SEQ ID NO: 187695 - RNA, 1701 nt, Artificial Sequence
  derived and/or modified sequence opt5 from hemagglutinin__InfluenzaA__ADF87351
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugacucucucagcacagccuccucuuggagcuacaucguggaaaccuccucuagcgauaacggcacgugcuauccgggggacuuuauugauuacgaggaacugcgggagcagcuuuccagcgucucuuccuucgagcgcuuugaaauguuccccaagaccagcucuuggccuaaucacgacuccaacaagggagugacagccgcuuguccccaugccggcgcgaaaucuuuuuauaagaaucugaucuggcucguuaaaaagggcaacagcuacccuaaacuguccaagagcuauaucaaugauaaggggaaagaggugcuuguccuguggggcauucaccaccccuccaccucugccgaccaacagagccucuaccagaacgcugaugccuacguguucgugggaacauccagauauagcaagaaauuuaagccugaaaucgcuauucggccgaaaguccgcgaccaggaggggagaaugaauuacuauuggacccugguugagcccggagauaagaucacguucgaagccacaggcaaccugguggugccucgguacgcguuugccauggagcgcaacgcugggucuggaauuaucauuuccgacacccccguccaugacugcaauacaaccugucaaaccccuaaaggcgccaucaacacaagccuccccuuccagaauauccacccgauuacgaucggcaagugcccuaaguaugugaaaucuaccaagcugagacuugcuacagggcugcggaacguucccagcauucagucccgcggacucuuuggcgccaucgccggguucauugaaggaggcuggaccgggaugguggauggaugguacggcuaucaucaccagaaugagcaaggcucuggguacgcugcggaccugaaaagcacacagaacgccaucgaugaaaucaccaauaaggucaacuccgugauugagaaaaugaauacgcaguuuacagcuguuggaaaggaguucaaccaccuugaaaagagaaucgagaaucugaacaaaaagguggacgauggcuuccucgacauuuggaccuacaaugccgaacugcugguccuccuggagaacgaacggacccuugauuaucaugacagcaaugugaaaaaccuguacgagaagguccgcucucagcucaaaaacaaugccaaggagaucgggaacggauguuuugaguucuaucacaagugcgauaauacauguauggaauccgugaaaaacggcaccuacgacuauccuaaguacagcgaagaggcuaaacugaauagagaagagauugaugggguuaaacuugagucuacacggaucuaucaaauccuggccauuuacuccacgguggcgagcucccucguccuggugguuucucugggcgcuaucagcuuuuggaugugcuccaacggaucucuccagugccgcauuuguaucuga

SEQ ID NO: 187696 - RNA, 1701 nt, Artificial Sequence; identical to SEQ ID NO: 187320
  derived and/or modified sequence opt5 from hemagglutinin__InfluenzaA__ADF87361

SEQ ID NO: 187697 - RNA, 1701 nt, Artificial Sequence; identical to SEQ ID NO: 186857
  derived and/or modified sequence opt5 from hemagglutinin__InfluenzaA__ADF87371

SEQ ID NO: 187698 - RNA, 1701 nt, Artificial Sequence
  derived and/or modified sequence opt5 from hemagglutinin__InfluenzaA__ADG08115
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcggcaacgggacgugcuauccgggagacuuuauugauuacgaggagcugcgggagcagcuuuccagcgucucuuccuucgaacgcuuugagaucuuccccaagaccagcucuuggccuaaucacgacuccaacaagggcgugacagccgcuuguccccaugccggcgcgaaaucuuuuuauaagaaucugaucuggcucguuaaaaaggggaacagcuacccuaaacuguccaagagcuauauuaaugauaagggaaaagaagugcuuguccuguggggcauccaccaccccuccaccucugccgaccaacagagccucuaccagaacgcugaugccuacguguucguggggacauccagauauagcaagaaauuuaagccugagauugcuauccggccgaaaguccgcggacaggagggcagaaugaauuacuauuggacccugguugaacccggggacaagauuacguucgaggccacaggaaaccugguggugccucgguacgcguuugccauggaacgcaacgcuggcucuggcaucauuaucuccgauacccccguccaugacugcaauacaaccugucaaaccccuaaaggggccaucaacacaagccuccccuuccagaauauucacccgaucacgauuggaaagugcccuaaguaugugaaaucuaccaagcugagacuugcuacaggccugcggaacguucccagcauccagucccgcgggcucuuuggagccauugccggcuucaucgaagggggauggaccggcaugguggauggcugguacggguaucaucaccagaaugaacaaggaucuggcuacgcugcggaccugaaaagcacacagaacgccaucgacgagauuaccaauaaggucaacuccgugaucgagaaaaugaauacgcaguuuacagcuguugggaaggaguucaaccaccuugaaaagagaauugaaaaucugaacaaaaagguggaugacggauuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauuggcaacggguguuuugaguucuaucacaagugcgacaauacauguauggaauccgugaaaaacggcaccuacgauuauccuaaguacagcgaggaagcuaaacugaauagagaggagaucgacggaguuaaacuugaaucuacacggaucuaucaaauucuggccaucuacuccacgguggcgagcucccucguccuggugguuucucugggcgcuauuagcuuuuggaugugcuccaacgggucucuccagugccgcaucuguauuuga

SEQ ID NO: 187699 - RNA, 1701 nt, Artificial Sequence; identical to SEQ ID NO: 186435
  derived and/or modified sequence opt5 from hemagglutinin__InfluenzaA__ADG21004

SEQ ID NO: 187700 - RNA, 1701 nt, Artificial Sequence; identical to SEQ ID NO: 186435
  derived and/or modified sequence opt5 from hemagglutinin__InfluenzaA__ADG21006

SEQ ID NO: 187701 - RNA, 1701 nt, Artificial Sequence
  derived and/or modified sequence opt5 from hemagglutinin__InfluenzaA__ADG21008
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugaucaaaucgaggugacaaacgcuaccgaacucgugcagucuagcuccacaggcgagaucugcgacucuccgcaccagauucuggauggggaaaauuguacccuuaucgacgcccugcucggagauccccagugcgacggcuuucaaaacaaaaagugggaucuguucgucgagagaagcaaauccuauucuaauuguuacccuuaugacgugcccgauuacgccagccugcggucccucguugcuagcucugggacgcuggaauuuaacaaugaguccuucaacuggaccggagugacacagaauggcaccagcucugccugcauucgcaaguccaacaauagcuuuuucucuagacuuaacuggcugacacaucucaaguuuaaauauccugcucugaaugucaccaugcccaacaacgagcaguucgacaaacuuuacaucuggggcgugcaccauccugggacggauaaugaccagauuuuucuguaugcccaagcguccggacggaucacaguuagcaccaagcgcucccagcagacagugauuccgaacaucggcucuagaccccggguccgcaauaucccuagcagaauuuccaucuacuggaccauugugaagcccggggauauccuccugauuaacagcaccggaaaucugaucgccccucggggcuacuucaaaauccgcucugggaaguccagcauuaugagaucugacgcucccaucggaaaguguaacagcgaaugcauuacaccgaauggcuccaucccuaacgacaaacccuuucagaaugugaaccggauuacguauggcgccuguccucgcuacgucaagcaaaauacccucaaacuggcuacagggaugagaaacguucccgagaagcagacccggggaaucuucggcgccaucgcgggguuuauugaaaauggaugggagggcaugguggaugggugguauggauuccgccaccagaacucugagggcagaggccaagccgcugaccuuaaaagcacacaggccgcuaucgaucagauuaaugggaagcugaaccggcucaucggaaaaaccaacgaaaaguuccaccagauugagaaggaauuuuccgagguggaaggcagaauccaagaccuggagaaauacgucgaggauacgaagauugaccuuuggagcuauaaugccgaacugcucguggcccuggagaaccagcauacaaucgaucugaccgacucugaaaugaauaaacucuucgagaagaccaaaaagcagcugcgcgaaaacgcugaggauauggggaauggaugcuuuaagaucuaccacaaaugugacaacgcgugcauuggcuccauccggaaugggacauaugaucaugacguuuacagagacgaggcccuuaacaaucgcuuccagauuaagggcguggaacugaaaagcggauacaaggauuggauccucuggauuucuuuugcuaucuccugcuuccugcuuugugucgcccugcucggcuuuaucaugugggccugccaaaaagggaacauucgguguaauaucugcauuuga

SEQ ID NO: 187702 - RNA, 1701 nt, Artificial Sequence
  derived and/or modified sequence opt5 from hemagglutinin__InfluenzaA__ADG21009
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagccuauuccaacuguuacccuuaugaugugcccgacuacgcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaucugcgcuuuaaguauccugcccuuaacgucaccaugcccaacaaugagcaguucgauaagcuguacauuuggggcgugcaccauccugggacggacaacgaucagaucuuucucuaugcgcaagccucuggaagaauuacaguuuccaccaaacggagccagcagacagugaucccgaauauuggcucccgccccagaguccggaacaucccuucucgcaucagcauuuacuggaccaucgugaagcccggggacauucugcugaucaauuccaccggaaaccucauugcuccuagaggcuacuucaaaauccggagcgggaagucuuccaucaugcgcagcgaugcccccauuggaaaauguaauucugaaugcaucacaccgaacggcagcauuccuaaugacaagcccuuucagaacgugaauagaaucacguauggcgcuuguccucgguacgucaagcaaaacacccugaaacuugccacagggaugcgcaauguucccgagaagcagaccagaggaauuuucggcgcgaucgccggguuuaucgaaaacggaugggagggcaugguggacgggugguauggauuccggcaccaaaauuccgagggcagaggccaggcugccgaucugaaaucuacacaggcugccauugaccagaucaacgggaagcucaaccgccugauuggaaaaaccaaugaaaaguuccaccagaucgagaaagaauuuagcgagguggaaggccggauucaagaucuugagaaguacgucgaggacacgaagaucgaucugugguccuauaacgccgaacuccugguggcucuggagaaucagcauacaauugaccucaccgauagcgaaaugaacaaacuguucgagaagaccaaaaagcagcuuagagaaaaugcggaggacauggggaacggaugcuuuaaaaucuaccacaagugugauaaugccugcaucggcucuauucgcaacgggacauaugaccaugauguuuaccgggacgaggcucugaauaacagauuccagaucaagggcguggaacucaaauccggauacaaggacuggauucuguggaucagcuuugccauuucuugcuuccuucugugugucgcccuccugggcuuuaucaugugggcuugccaaaaagggaauauccgcuguaacauuugcaucuga

SEQ ID NO: 187703 - RNA, 1701 nt, Artificial Sequence; identical to SEQ ID NO: 186435
  derived and/or modified sequence opt5 from hemagglutinin__InfluenzaA__ADG21010

SEQ ID NO: 187704 - RNA, 1701 nt, Artificial Sequence
  derived and/or modified sequence opt5 from hemagglutinin__InfluenzaA__ADG21011
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaauuuuaaguauccugcccuuaacgucaccaugcccaacaaugagcaguucgacaagcuguacauuuggggcgugcaccauccugggacggauaaagaccagaucuuucucuaugcgcaagccucuggacgcauuacaguuuccaccaagagaagccagcaggcugugaucccgaacauuggcucccggccccgcgucagagauaucccuucucggaucagcauuuacuggacaaucgugaaacccggggacauucugcugaucaauuccaccggaaaccucauugccccucgcggcuacuucaagaucagaagcgggaaaucuuccaucaugcggagcgacgcucccauuggaaaguguaauucugaaugcaucaccccgaacggcagcauuccuaaugauaagcccuuucagaacgugaaucgcaucacauauggcgccuguccuagauacgucaaacaaaacacgcugaaacuugcgaccgggaugcggaauguucccgagaagcagacacgcggaauuuucggcgccaucgcuggguuuaucgaaaacggaugggagggcaugguggacgggugguauggauucagacaccaaaauuccgagggccggggccaggccgcugaucugaagucuacccaggccgccauugaccagaucaacgggaaacucaauagacugauuggaaagacaaacgaaaaauuccaccagaucgagaaggaauuuagcgagguggaaggccgcauucaagaucuugagaaguacgucgaggacaccaaaaucgaucugugguccuauaacgcugaacuccugguggcgcuggagaaucagcauacgauugaccucacagauagcgaaaugaacaagcuguucgagaaaaccaagaaacagcuucgggaaaaugccgaggacauggggaacggaugcuuuaagaucuaccacaagugugauaaugcuugcaucggcucuauuagaaacgggaccuaugaccaugacguuuaccgcgaugaggcccugaauaaccgguuccagaucaaaggcguggaacucaaguccggauacaaagacuggauucuguggaucagcuuugccauuucuugcuuccuucugugugucgcucuccugggcuuuaucaugugggccugccaaaaggggaauaucagauguaacauuugcaucuga

SEQ ID NO: 187705 - RNA, 1701 nt, Artificial Sequence; identical to SEQ ID NO: 186435
  derived and/or modified sequence opt5 from hemagglutinin__InfluenzaA__ADG21012

SEQ ID NO: 187706 - RNA, 1701 nt, Artificial Sequence; identical to SEQ ID NO: 186435
  derived and/or modified sequence opt5 from hemagglutinin__InfluenzaA__ADG21013

SEQ ID NO: 187707 - RNA, 1701 nt, Artificial Sequence
  derived and/or modified sequence opt5 from hemagglutinin__InfluenzaA__ADG21014
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugaucaaaucgaggugacaaacgcuaccgaacucgugcagucuagcuccacaggcgagaucugcgacucuccgcaccagauucuggauggggaaaauuguacccuuaucgacgcccugcucggagauccccagugcgacggcuuucaaaacaaaaagugggaucuguucgucgagagaagcaaagccuauuccaauuguuacccuuaugacgugcccgauuacgcuucucugcggagccucguugccuccagcgggacgcuggaauuuaacaaugagucuuucaacuggaccggagugacacagaauggcaccuccagcgcuugcauucgcagaucuaacaauuccuuuuucagccggcuuaacuggcugacacaucucaauuuuaaguauccugcccugaacgucaccaugcccaacaaugagcaguucgacaaacuuuacaucuggggcgugcaccauccugggacggauaaggaccagauuuuucuguaugcgcaagccucuggacgcaucacaguuuccaccaagagaagccagcaggcugugauuccgaacaucggcucccggccccgcgucagaaauaucccuucucggauuagcaucuacuggacaauugugaaacccggggauauccuccugauuaacuccaccggaaaucugaucgccccucgcggcuacuucaagaucagaagcgggaaaucuuccauuaugcggagcgacgcucccaucggaaaguguaacucugaaugcauuaccccgaauggcagcaucccuaacgacaagcccuuucagaaugugaaccgcauuacauauggcgccuguccuagauacgucaaacaaaauacgcucaagcuggcgaccgggaugcggaacguucccgagaaacagacacgcggaaucuucggcgccaucgcuggguuuauugaaaauggaugggagggcaugguggaugggugguauggauucagacaccagaacuccgagggccggggccaagccgcugaccuuaagucuacccaggccgccaucgaucagauuaaugggaaacugaacagacucaucggaaagacaaacgaaaaauuccaccagauugagaaggaauuuagcgagguggaaggccgcauccaagaccuggagaaguacgucgaggauaccaaaauugaccuuugguccuauaaugcugaacugcucguggcgcuggagaaccagcauacgaucgaucugacagacagcgaaaugaauaaacucuucgagaagaccaagaaacagcugcgggaaaacgccgaggauauggggaauggaugcuuuaagaucuaccacaagugugacaacgcuugcauuggcucuaucagaaaugggaccuaugaucaugacguuuaccgcgacgaggcccuuaacaaucgguuccagauuaaaggcguggaacugaaguccggauacaaagauuggauccucuggauuagcuuugccaucucuugcuuccugcuuugugucgcucugcucggcuuuaucaugugggccugccaaaaggggaacauuagauguaauaucugcauuuga

SEQ ID NO: 187708 - RNA, 1701 nt, Artificial Sequence
  derived and/or modified sequence opt5 from hemagglutinin__InfluenzaA__ADG21017
augaagaccaucauugcccugagcuacauccucuaucugguguucgcucagaaacuucccggcaacgacaauuccacagccacgcugugccucgggcaccaugcggucccuaacggaaccauuguuaagacaaucaccaaugaucaaauugaggugacaaacgcuaccgaacuggugcagucuagcuccacaggcgagaucugugacucuccgcaccagauccuugauggggaaaauugcacccugauugacgcccuccugggagauccccagugugacggcuuucaaaacaaaaagugggaucuguucaucgagagaagcaaagccuacuccaauugcuauccuuacgacguccccgauuaugcuucucuccggagccugguggccuccagcgggacgcuugaauuuaacaaugagucuuucaacuggaccggaguuacacagaauggcaccuccagcgcuuguauucgcagaucuaacaauuccuuuuucagccggcugaacuggcucacacaucugaauuuuaaguacccugcccuuaacgugaccaugcccaacaaugagcaguucgacaagcuguauaucuggggcguccaccauccugggacggauaaagaccagauuuuucucuacgcgcaagccucuggacgcaucacaguguccaccaagagaagccagcaggcuguuauuccgaacaucggcucccggccccgcgugagaaauaucccuucucggauuagcaucuacuggacaauugucaaacccggggauauccugcugauuaacuccaccggaaaucucaucgccccucgcggcuauuucaagaucagaagcgggaaaucuuccauuaugcggagcgacgcucccaucggaaagugcaacucugaauguauuaccccgaauggcagcaucccuaacgacaagcccuuucagaaugugaaccgcauuacauacggcgccugcccuagauaugugaaacaaaauacgcugaaacuugcgaccgggaugcggaacguccccgagaagcagacacgcggaaucuucggcgccaucgcuggguuuauugaaaauggaugggagggcaugguugaugggugguacggauucagacaccagaacuccgagggccggggccaagccgcugaccugaagucuacccaggccgccaucgaucagauuaaugggaaacucaacagacugaucggaaagacaaacgaaaaauuccaccagauugagaaggaauuuagcgagguggaaggccgcauccaagaccuugagaaguauguggaggauaccaaaauugaccugugguccuacaaugcugaacuccuggucgcgcuggagaaccagcauacgaucgaucucacagacagcgaaaugaauaagcuguucgagaaaaccaagaaacagcuucgggaaaacgccgaggauauggggaauggauguuuuaagaucuaucacaagugcgacaacgcuuguauuggcucuaucagaaaugggaccuacgaucaugacguguaccgcgacgaggcccugaacaaucgguuccagauuaaaggcguugaacucaaguccggauauaaagauuggauccuguggauuagcuuugccaucucuugcuuccuucugugcguggcucuccugggcuuuaucaugugggccugucaaaaggggaacauuagaugcaauaucuguauuuga

SEQ ID NO: 187709 - RNA, 1701 nt, Artificial Sequence
  derived and/or modified sequence opt5 from hemagglutinin__InfluenzaA__ADG21018
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacauucuaauuuuaaguauccugcccugaacgucaccaugcccaacaaugagcaguucgacaagcuguacauuuggggcgugcaccauccugggacggauaaagaccagaucuuucuguaugcgcaagccuccggacgcauuacaguuagcaccaagagaucccagcaggcugugaucccgaacauuggcucucggcaccgcgucagaaauauccccagccggaucuccauuuacuggacaaucgugaaaccuggggauauucuccugaucaacagcaccggaaaucugauugcuccccgcggcuacuucaagaucagaucugggaaauccagcaucaugcggucugacgccccuauuggaaaguguaacagcgaaugcaucacccccaauggcuccauuccgaacgacaagccuuuucagaaugugaaccgcaucacauauggcgccugucccagauacgucaaacaaaauacgcucaagcuggcgaccgggaugcggaacguuccugagaaacagacacgcggaauuuucggcgccaucgcuggguuuaucgaaaauggaugggagggcaugguggaugggugguauggauucagacaccagaacucugagggccggggccaagccgcugaccuuaagagcacccaggccgccauugaucagaucaaugggaaacugaacagacucauuggaaagacaaacgaaaaauuccaucagaucgagaaggaauuuuccgagguggaaggccgcauucaagaccuggagaaguacgucgaggauaccaaaaucgaccuuuggagcuauaaugcugaacugcucguggcgcuggagaaccagcacacgauugaucugacagacucugaaaugaauaaacucuucgagaagaccaagaaacagcugcgggaaaacgccgaggauauggggaauggaugcuuuaagaucuaccauaagugugacaacgcuugcaucggcuccauuagaaaugggaccuaugaucacgacguuuaccgcgacgaggcccuuaacaaucgguuccagaucaaaggcguggaacuuaagagcggauacaaagauuggauucucuggaucucuuuugccauuuccugcuuccugcuuugugucgcucugcucggcuuuaucaugugggccugccaaaaggggaacaucagauguaauauuugcaucuga

SEQ ID NO: 187710 - RNA, 1701 nt, Artificial Sequence
  derived and/or modified sequence opt5 from hemagglutinin__InfluenzaA__ADG21019
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacacgcuccugggagauccccagugcgacggcuuucaaaacaagaaaugggaucuguucgucgaaagaagcaaggccuauuccaauuguuacccuuaugacgugcccgauuacgccucucuccggagccugguugcuuccagcgggacccuugaguuuaacaaugaaucuuucaacuggacaggagugacccagaauggcacauccagcgccugcauccgcagaucuaagaacuccuuuuucagccggcugaauuggcucacccaucugaacuuuaaauauccugcucuuaaugucacgaugcccaacaacgagcaguucgacaagcuguacauuuggggcgugcaccauccugggacagauaaagaccagaucuuucucuaugcccaagcgucuggaaagauuaucguuuccaccaaacgcagccagcagacagugauuccgaauaucggcuccagaccccggguccgcaacaucccuucuauuaucagcauuuacuggaccaucgugaagcccggggauauucugcugaucaauuccaccggaaaccucaucgccccuagaggcuacuucaagauucggagcgggaaaucuuccaucaugcgcagcgacgcucccauuggaaaguguaauucugagugcaucacaccgaacggcagcauuccuaaugacaaacccuuucagaacgugaauagaaucacguauggcgccuguccucgguacgucaagcaaaacacccugaaacuugcuacagggaugcgcaauguucccgaaaagcagaccagaggaaucuucggcgccauugcgggguuuaucgagaacggaugggaaggcaugguggaugggugguauggauuccggcaccaaaauuccgagggccgcggccaggccgcugaccugaaaucuacacaggccgcuauugaucagaucaacgggaagcucaauagacugauuggaaagaccaacgagaaauuccaccagaucgaaaaggaguuuagcgaaguggagggccggauucaagaccuugaaaaauacgucgaggauacgaagaucgaccugugguccuauaacgccgagcuccugguggcccuggaaaaucagcauacaaucgaucucaccgacagcgagaugaacaaacuguucgaaaagaccaagaaacagcuuagagagaaugcugaagauauugggaacggaugcuuuaagaucuaccacaaaugugacaaugcgugcauuggcucuauccgcaacgggacauaugaucaugacguuuaccgggacgaggcccugaauaacagauuccagauuaagggcguggagcucaaauccggauacaaggauuggauccuguggaucagcuuugcuauuucuugcuuccuucugugugucgcccuccugggcuuuaucaugugggccugccaaaaggggaauauucgcuguaacaucugcauuuga

SEQ ID NO: 187711 - RNA, 1701 nt, Artificial Sequence
  derived and/or modified sequence opt5 from hemagglutinin__InfluenzaA__ADG21020
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacaguccggcaccagcucugcuugcauccgcagauccaagaauagcuuuuucucucggcugaacuggcucacacaucugaauuuuaaauauccugcccuuaacgucaccaugcccaauaacgagcaguucgacaagcuguacauuuggggcgugcaccauccugggacggauaaagaccagaucuuucucuaugcgcaagccuccggacgcauuaucguuagcacaaagagaucccagcagaccgugacaccgaacauuggcucucggccccgcgucagaaauaucccuagccggaucuccauuuacuggaccaucgugaaacccggggauauucugcugaucaacagcaccggaaaucucauugcuccucgcggcuacuucaagaucagaucugggaaguccagcaucaugcggucugacgcccccauuggaaaauguaacagcgagugcaucacaccgaauggcuccauuccuaacgacaagcccuuucagaaugugaaccgcaucacguauggcgcuuguccuagauacgucaaacaaaauacccugaaacuugccacagggaugcggaacguucccgaaaaacagacccgcggaauuuucggcgcgaucgccggguuuaucgagaauggaugggaaggcaugguggaugggugguauggauucagacaccagaacucugagggccggggccaagcugccgaccucaagagcacacaggcugccauugaucagaucaaugggaaacugaacagacugauuggaaagaccaaugagaaguuccaccagaucgaaaaagaguuuuccgaaguggagggccgcauucaagaccuugaaaaguacgucgaggauacgaaaaucgaccuguggagcuauaacgccgagcuccugguggcucuggaaaaccagcauacaauugaucucaccgacucugagaugaauaagcuguucgaaaagaccaagaagcagcuucgggagaacgcggaagauauggggaauggaugcuuuaaaaucuaccacaagugugacaacgccugcaucggcuccauuagaaaugggacauaugaucaugacguuuaccgcgacgaggcucugaacaaucgguuccagaucaaaggcguggagcucaagagcggauacaaagauuggauucuguggaucucuuuugccauuuccugcuuccuucugugugucgcccuccugggcuuuaucaugugggcuugccaaaaggggaacaucagauguaauauuugcaucuga

SEQ ID NO: 187712 - RNA, 1701 nt, Artificial Sequence; identical to SEQ ID NO: 185458
  derived and/or modified sequence opt5 from hemagglutinin__InfluenzaA__ADG21022

SEQ ID NO: 187713 - RNA, 1701 nt, Artificial Sequence; identical to SEQ ID NO: 185458
  derived and/or modified sequence opt5 from hemagglutinin__InfluenzaA__ADG21023

SEQ ID NO: 187714 - RNA, 1701 nt, Artificial Sequence
  derived and/or modified sequence opt5 from hemagglutinin__InfluenzaA__ADG21024
augaagaccaucauugcccugagcuacauccucugccugguguucacacagaaacuucccggcaacgacaauuccacggcuacccugugucucgggcaccaugccgucccuaacggaacaauuguuaagaccaucacaaaugaucaaauugaggugaccaacgcgacagaacuggugcagucuagcuccaccggcgagaucugcgacucuccgcaccagauccuugauggggaaaauuguacgcugauugacgcucuccugggagauccccagugcgacggcuuucaaaacaaaaagugggaucuguucgucgagagaagcaaagccuauuccaauuguuacccuuaugacgugcccgauuacgccucucuccggagccugguugcuuccagcggggcccuugaauuuaacaaugagucuuucaacuggaccggagugacacagaauggcaccuccagcgcuugcauccgcagaucuaacaauuccuuuuucagccggcugaacuggcucacacaucugaauuuuaaguauccugcccuuaacgucaccaugcccaacaaugagcaguucgacaagcuguacauuuggggcgugcaccauccugggacggauaaagaccagaucuuucucuaugcgcaagccucuggacgcauuacaguuuccaccaagagaagccagcaggcugugaucccgaacauuggcucccggccccgcgucagaaauaucccuucucggaucagcauuuacuggacaaucgugaaacccggggauauucugcugaucaacuccaccggaaaucucauugccccucgcggcuacuucaagauccagagcgggaaaucuuccaucaugagaagcgacgcucccauuggaaaguguaacucugaaugcaucaccccgaauggcagcauuccuaacgacaagcccuuucaaaaugugaaccggaucacauauggcgccuguccucgcuacgucaaacaguccacgcugaagcuggcgaccgggaugagaaauguucccgagaaacagacacggggaauuuucggcgccaucgcuggguuuaucgaaaacggaugggagggcaugguggaugggugguauggauuccgccaccaaaauucugagggcagaggccaggccgcugaccuuaagagcacccaggccgccauugaucagaucaacgggaaacucaaucggcugauuggaaagacaaacgaaaaauuccaccaaaucgagaaggaauuuuccgagguggaaggccgcauucaggaccuugagaaguacgucgaggauaccaaaaucgaccuguggagcuauaacgcugaacuccugguggcgcuggagaaucagcauacgauugaucucacagacucugaaaugaacaagcuguucgagaaaaccaagaaacagcuuagagaaaaugccgaggauauggggaacggaugcuuuaagaucuaccacaagugugacaaugcuugcaucggcuccauucggaacgggaccuaugaucaugacguuuacagagacgaggcccugaauaaccgcuuccaaaucaaaggcguggaacucaagagcggauacaaagauuggauucuguggaucucuuuugccauuuccugcuuccuucugugugucgcucuccugggcuuuaucaugugggccugccagaaggggaauauccgguguaacauuugcaucuga

SEQ ID NO: 187715 - RNA, 1701 nt, Artificial Sequence
  derived and/or modified sequence opt5 from hemagglutinin__InfluenzaA__ADG21026
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaauuuuaaguauccugcccuuaacgucaccaugcccaacaaugagcaguucgacaagcuguacauuuggggcgugcaccauccugggacggauaaagaccagaucuuucucuaugcgcaagccucuggacgcauuacaguuuccaccaagagaagccagcaggcugugaucccgaacauuggcucccggcugcgcgucagaaauauccccucucggaucagcauuuacuggacaaucgugaaaccuggggauauucugcucaucaacuccaccggaaaucugauugcuccccgcggcuacuucaagaucagaagcgggaaaucuuccaucaugcggagcgacgccccuauuggaaaguguaacucugaaugcaucacccccaauggcagcauuccgaacgacaagccuuuucagaaugugaaccgcaucacauauggcgccugucccagauacgucaaacaauccacgcuuaagcuggcgaccgggaugcggaauguuccugagaaacagacacgcggaauuuucggcgccaucgcuggguuuaucgaaaacggaugggagggcaugguggaugggugguauggauucagacaccaaaauucugagggccggggccaggccgcugaccucaagagcacccaggccgccauugaucagaucaacgggaaacugaauagacuuauuggaaagacaaacgaaaaauuccaccagaucgagaaggaauuuuccgagguggaaggccgcauucaagaccuggagaaguacgucgaggauaccaaaaucgaccucuggagcuauaacgcugaacugcugguggcgcucgagaaucagcauacgauugaucugacagacucugaaaugaacaaacuuuucgagaagaccaagaaacagcugcgggaaaaugccgaggauauggggaacggaugcuuuaccaucuaccacaagugugacaaugcuugcaucggcuccauuagaaacgggacauaugaucauaauguuuaccgcgacgaggcccucaacaaucgguuccagaucaagggcguggaacugaaaagcggauacaaggacuggauucuuuggaucucuuuugccauuuccugcuuccugcucugugucgcucugcugggcuuuaucaugugggccugccaaaaagggaacaucagauguaauauuugcaucuga

SEQ ID NO: 187716 - RNA, 1701 nt, Artificial Sequence; identical to SEQ ID NO: 185693
  derived and/or modified sequence opt5 from hemagglutinin__InfluenzaA__ADG21037

SEQ ID NO: 187717 - RNA, 1701 nt, Artificial Sequence
  derived and/or modified sequence opt5 from hemagglutinin__InfluenzaA__ADG21038
augaaggccauccuggugguccuccuguacaccuucgcuacagccgacgcggauacgcuuugcauuggcuaucacgcuaacaauagcaccgacacaguugauaccgugcuggagaagaacgugacagucacccauuccgugaaucuccuggaagacaagcacaacgggaaacuuuguaagcugagaggaguugcuccccuccaucugggcaaaugcaauaucgccggguggauucugggaaacccugagugugaaucucucagcacagccuccucuuggagcuacaucguggagaccuccucuagcgauaauggcacgugcuauccgggggacuuuauugauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaucugguggugccucgguacgcguuugccauggaacgcaacgcugggucuggaaucauuaucuccgacacccccguccaugacugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggauggaugguacggcuaucaucaccagaacgaacaaggcucuggguacgcugcggaccugaaaagcacacagaaugccaucgaugagauuaccaacaaggucaauuccgugaucgagaaaaugaacacgcaguuuacagcuguuggaaaggaguucaaucaccuugagaagagaauugaaaaccugaauaaaaagguggacgauggcuuccucgacaucuggaccuacaacgccgagcugcugguccuccuggaaaaugagcggacccuugauuaucaugacagcaacgugaaaaaucuguacgagaagguccgcucucagcucaaaaacaacgccaaggaaauugggaauggauguuuugaguucuaucacaagugcgauaacacauguauggaauccgugaaaaauggcaccuacgacuauccuaaguacagcgaggaagcuaaacugaacagagaggagaucgaugggguuaaacuugaaucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 187718 - RNA, 1701 nt, Artificial Sequence
  derived and/or modified sequence opt5 from hemagglutinin__InfluenzaA__ADG21040
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaaugugcacccgauuacgaucggcaagugcccuaaguauguuaaaucuaccaagcugagacuugcuacagggcugcggaacgugcccagcauucagucccgcggacucuuuggcgccaucgccggguucauugagggaggcuggaccgggauggucgacggaugguacggcuaucaucaccagaaugaacaaggcucuggguacgcugcggaucugaaaagcacacagaacgccaucgacgagaucaccaauaaggugaacuccguuauugagaaaaugaauacgcaguuuacagcugugggaaaggaguucaaccaccuugagaagagaaucgaaaaucugaacaaaaaggucgaugacggcuuccucgauauuuggaccuacaaugccgagcugcuggugcuccuggaaaacgagcggacccuugacuaucaugauagcaaugucaaaaaccuguacgagaaggugcgcucucagcucaaaaacaaugccaaggaaaucgggaacggauguuuugaguucuaucacaagugcgacaauacauguauggaauccguuaaaaacggcaccuacgauuauccuaaguacagcgaggaagcuaaacugaauagagaggagauugacggggugaaacuugaaucuacacgggucuaucaaauccuggccaucuacuccacgguggcgagcucccucguucugguggucucucugggcgcuauuagcuuuuggaugugcuccaacggaucucuccagugccgcaucuguauuuga

SEQ ID NO: 187719 - RNA, 1701 nt, Artificial Sequence
  derived and/or modified sequence opt5 from hemagglutinin__InfluenzaA__ADG21041
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgagcaggaagggagaaugaauuacuauuggacgcugguugagcccggagauaagauuacauucgaagcuaccggcaaccugguggugccucgguacgccuuugcgauggagcgcaacgccgggucuggaaucauuaucuccgacacacccguccaugauugcaauaccaccugucaaacaccuaaaggcgcuaucaacacgagccuccccuuccagaauauucacucuaucaccauuggcaagugcccgaaguaugugaaaagcacaaagcugagacuugccaccgggcugcggaacguuccuuccauccagucucgcggacucuuuggcgcuauugccggguucaucgaaggaggcuggacagggaugguggacggaugguacggcuaucaucaccagaaugagcaaggcagcggguacgccgcugaccugaaauccacccagaacgcgaucgaugagauuacgaauaaggucaacagcgugaucgagaaaaugaauacacaguuuaccgccguuggaaaggaguucaaccaccuugaaaagagaauugagaaucugaacaaaaagguggacgauggcuuccucgacaucuggaccuacaaugcugaacugcugguccuccuggagaacgagcggacacuugauuaucaugacucuaaugugaaaaaccuguacgaaaagguccgcucccagcucaaaaacaaugccaaggagauugggaacggauguuuugaguucuaucacaagugcgauaauaccuguauggaaagcgugaaaaacggcacauacgacuaucccaaguacucugaagaggccaaacugaauagagaggaaaucgaugggguuaaacuugaguccacgcggaucuaucaaauucuggcuaucuacagcaccguggccuccucucucguccuggugguuagccugggcgcgguguccuuuuggaugugcucuaacggaagccuccagugccgcauuuguaucuga

SEQ ID NO: 187720 - RNA, 1701 nt, Artificial Sequence; identical to SEQ ID NO: 186794
  derived and/or modified sequence opt5 from hemagglutinin__InfluenzaA__ADG21042

SEQ ID NO: 187721 - RNA, 1701 nt, Artificial Sequence
  derived and/or modified sequence opt5 from hemagglutinin__InfluenzaA__ADG21043
augaaggccauccuggugguccuccuguacaccuucacaacggcuaacgccgacacccuuugcguuggcuaucacgcgaauaacagcacagauaccguggacacagugcuggagaaaaaugucaccgugacacauuccguuaaccuccuggaagauaagcacaaugggaaacuuuguaagcugagaggaguggcuccccuccaucugggcaaaugcaacauugccggguggauccugggaaauccugagugugaaucucucagcaccgccuccucuuggagcuacauugucgagacguccucuagcgacaacggaaccugcuauccgggggauuuuaucgacuacgaagaacugcgggagcagcuuuccagcgugucuuccuucgaacgcuuugagauuuuccccaagacaagcucuuggccuaaucacgauuccaacaagggaguuaccgcugccuguccccaugcuggcgccaagagcuuuuauaagaaucugaucuggcucgugaaaaagggcaacucuuacccuaaacuguccaagagcuauaucaaugacaaggggaaagaaguccuugugcuguggggcauucaccaccccuccacaucugcggaucaacagagccucuaccagaacgccgacgcuuacguguucgucggcaccuccagauauagcaagaaauuuaagccugagaucgccauucggccgaaaguucgcgagcaggaagggagaaugaauuacuauuggacgcugguggagcccggagauaagaucacauucgaagcuaccggcaaccugguggucccucgguacgccuuugcgauggagcgcaacgccgggucuggaauuaucauuuccgacacacccgugcaugauugcaauaccaccugucaaacaccuaaaggcgcuaucaacacgagccuccccuuccagaauauccacucuauuaccaucggcaagugcccgaaguauguuaaaagcacaaagcugagacuugccaccgggcugcggaacgugccuuccauucagucucgcggacucuuuggcgcuaucgccggguucauugaaggaggcuggacagggauggucgacggaugguacggcuaucaucaccagaaugagcaaggcagcggguacgccgcugaccugaaauccacccagaacgcgaucgaugagaucacgaauaaggugaacagcguuauugagaaaaugaauacacaguuuaccgccgugggaaaggaguucaaccaccuugaaaagagaaucgagaaucugaacaaaaaggucgacgauggcuuccucgacauuuggaccuacaaugcugaacugcuggugcuccuggagaacgagcggacacuugauuaucaugacucuaaugucaaaaaccuguacgaaaaggugcgcucccagcucaaaaacaaugccaaggagaucgggaacggauguuuugaguucuaucacaagugcgauaauaccuguauggaaagcguuaaaaacggcacauacgacuaucccaaguacucugaagaggccaaacugaauagagaggaaauugauggggugaaacuugaguccacgcggaucuaucaaauccuggcuauuuacagcaccgucgccuccucucucgugcugguugugagccugggcgcgaucuccuuuuggaugugcucuaacggaagccuccagugccgcauuuguaucuga

SEQ ID NO: 187722 - RNA, 1701 nt, Artificial Sequence
  derived and/or modified sequence opt5 from hemagglutinin__InfluenzaA__ADG21045
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgagcaggaagggagaaugaauuacuauuggacgcugguugagcccggagauaagauuacauucgaagcuaccggcaaccugguggugccucgguacgccuuugcgauggagcgcaacgccgggucuggaaucauuaucuccgacacacccguccaugauugcaauaccaccugucaaacaccuaaaggcgcuaucaacacgagccuccccuuccagaauauucacucuaucaccauuggcaagugcccgaaguaugugaaaagcacaaagcugagacuugccaccgggcugcggaacguuccuuccauccagucucgcggacucuuuggcgcuauugccggguucaucgaaggaggcuggacagggaugguggacggaugguacggcuaucaucaccagaaugagcaaggcagcggguacgccgcugaccugaaauccacccagaacgcgaucgaugagauuacgaauaaggucaacagcgugaucgagaaaaugaauacacaguuuaccgccguuggaaaggaguucaaccaccuugaaaagagaauugagaaucugaacaaaaagguggacgauggcuuccucgacaucuggaccuacaaugcugaacugcugguccuccuggagaacgagcggacacuugauuaucaugacucuaaugugaaaaaccuguacgaaaagguccgcucccagcucaaaaacaaugccaaggagauugggaacggauguuuugaguucuaucacaagugcgauaauaccuguauggaaagcgugaaaaacggcacauacgacuaucccaaguacucugaagaggccaaacugaauagagaggaaaucgaugggguuaaacuugaguccacgcggaucuaucaaauucuggcuaucuacagcaccguggccuccucucucguccuggugguuagccugggcgcgauuuccuuuuggaugugcucuaacggaagccuccagugccgcaucuguauuuga

SEQ ID NO: 187723 - RNA, 1701 nt, Artificial Sequence; identical to SEQ ID NO: 187722
  derived and/or modified sequence opt5 from hemagglutinin__InfluenzaA__ADG21046

SEQ ID NO: 187724 - RNA, 1701 nt, Artificial Sequence; identical to SEQ ID NO: 186857
  derived and/or modified sequence opt5 from hemagglutinin__InfluenzaA__ADG21048

SEQ ID NO: 187725 - RNA, 1701 nt, Artificial Sequence
  derived and/or modified sequence opt5 from hemagglutinin__InfluenzaA__ADG21049
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcaaucaggaggggagaaugaacuacuauuggacccugguugaacccggagauaagauuacguucgaggccacaggcaaccugguggugccucgguacgcguuugccauggaacgcaaugcugggucuggaaucauuaucuccgacacccccguccaugauugcaacacaaccugucaaaccagcaaaggcgccaucaauacaucucucccuuuccagaacauucaccccaucacgauuggcaagugcccgaaguaugugaaaagcaccaagcugagacuugcuacagggcugcggaauaucccuuccauucagucucgcggacucuuuggcgccaucgccggguucaucgagggaggcuggaccgggaugguugacggaugguacggcuaucaucaccagaacgaacaaggcagcggguacgcugcggaccugaaauccacacagaaugccauugaugagaucaccaacaaggugaauagcgucauugagaaaaugaacacgcaguuuacagcugugggaaaggaguucaaucaccuugagaagagaaucgaaaaccugaauaaaaagguugacgauggcuuccucgacauuuggaccuacaacgccgagcugcuggugcuccuggaaaaugagcggacccuugauuaucaugacucuaacgucaaaaaccuguacgagaaggugcgcucccagcucaaaaauaacgccaaggaaaucgggaauggauguuuugaguucuaucacaagugcgauaacacauguauggaaagcgucaaaaauggcaccuacgacuaucccaaguacucugaggaagcuaaacugaacagagaggagaucgauggggugaaacuugaauccacacggauuuaucaaauccuggccauuuacagcacgguugcguccucucucgugcuggucgugagccugggcgcuaucuccuuuuggaugugcucuaauggaagccuccagugccgcauuuguaucuga

SEQ ID NO: 187726 - RNA, 1701 nt, Artificial Sequence; identical to SEQ ID NO: 186046
  derived and/or modified sequence opt5 from hemagglutinin__InfluenzaA__ADG21122

SEQ ID NO: 187727 - RNA, 1701 nt, Artificial Sequence; identical to SEQ ID NO: 186857
  derived and/or modified sequence opt5 from hemagglutinin__InfluenzaA__ADG21123

SEQ ID NO: 187728 - RNA, 1701 nt, Artificial Sequence; identical to SEQ ID NO: 185693
  derived and/or modified sequence opt5 from hemagglutinin__InfluenzaA__ADG21124

SEQ ID NO: 187729 - RNA, 1701 nt, Artificial Sequence
  derived and/or modified sequence opt5 from hemagglutinin__InfluenzaA__ADG21125
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaaaugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgggagcagcuuuccagcgucucuuccuucaagcgcuuugaaaucuuccccaagaccagcucuuggccuaaucacgauuccaacaaaggagugacagccgcuuguccccaugccggcgccaagagcuuuuauaaaaaucugaucuggcucguuaagaaaggcaacucuuacccuaagcuguccaagagcuauauuaaugacaaagggaaggaggugcuuguccuguggggaauccaccaccccuccaccucugccgaucaacagagccucuaccagaacgcugacgccuacguguucgugggcacauccagauauagcaaaaaguuuaaaccugaaauugcuauccggccgaagguccgcgaucaggaggggagaaugaauuacuauuggacccugguugagcccggagacaaaauuacguucgaagccacaggcaaccugguggugccucgguacgcguuugccauggagcgcaacgcugggucuggaaucauuaucuccgauacccccguccaugacugcaauacaaccugucaaaccccuaagggcgccaucaacacaagccuccccuuccagaauauucacccgaucacgauuggcaagugcccuaaauaugugaagucuaccaaacugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaucugaaaagcacacagaacgccaucgacgaaauuaccaauaaagucaacuccgugaucgagaagaugaauacgcaguuuacagcuguuggaaaggaguucaaccaccuugaaaagagaauugagaaucugaacaagaaaguggaugacggcuuccucgauaucuggaccuacaaugccgaacugcugguccuccuggagaacgaacggacccuugacuaucaugauagcaaugugaagaaccuguacgagaaaguccgcucucagcucaagaacaaugccaaggagauugggaacggauguuuugaguucuaucacaaaugcgacaauacauguauggaguccgugaagaacggcaccuacgauuauccuaaauacagcgaagaggcuaagcugaauagagaagagaucgacgggguuaaacuugagucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 187730 - RNA, 1701 nt, Artificial Sequence; identical to SEQ ID NO: 185680
  derived and/or modified sequence opt5 from hemagglutinin__InfluenzaA__ADG21126

SEQ ID NO: 187731 - RNA, 1701 nt, Artificial Sequence; identical to SEQ ID NO: 185680
  derived and/or modified sequence opt5 from hemagglutinin__InfluenzaA__ADG21127

SEQ ID NO: 187732 - RNA, 1701 nt, Artificial Sequence; identical to SEQ ID NO: 185680
  derived and/or modified sequence opt5 from hemagglutinin__InfluenzaA__ADG21128

SEQ ID NO: 187733 - RNA, 1701 nt, Artificial Sequence; identical to SEQ ID NO: 185680
  derived and/or modified sequence opt5 from hemagglutinin__InfluenzaA__ADG21129

SEQ ID NO: 187734 - RNA, 1701 nt, Artificial Sequence; identical to SEQ ID NO: 185693
  derived and/or modified sequence opt5 from hemagglutinin__InfluenzaA__ADG21130

SEQ ID NO: 187735 - RNA, 1701 nt, Artificial Sequence; identical to SEQ ID NO: 185680
  derived and/or modified sequence opt5 from hemagglutinin__InfluenzaA__ADG21131

SEQ ID NO: 187736 - RNA, 1701 nt, Artificial Sequence; identical to SEQ ID NO: 185680
  derived and/or modified sequence opt5 from hemagglutinin__InfluenzaA__ADG21132

SEQ ID NO: 187737 - RNA, 1701 nt, Artificial Sequence; identical to SEQ ID NO: 185680
  derived and/or modified sequence opt5 from hemagglutinin__InfluenzaA__ADG21133

SEQ ID NO: 187738 - RNA, 1701 nt, Artificial Sequence; identical to SEQ ID NO: 185680
  derived and/or modified sequence opt5 from hemagglutinin__InfluenzaA__ADG21134

SEQ ID NO: 187739 - RNA, 1701 nt, Artificial Sequence; identical to SEQ ID NO: 185680
  derived and/or modified sequence opt5 from hemagglutinin__InfluenzaA__ADG21135

SEQ ID NO: 187740 - RNA, 1701 nt, Artificial Sequence; identical to SEQ ID NO: 185680
  derived and/or modified sequence opt5 from hemagglutinin__InfluenzaA__ADG21136

SEQ ID NO: 187741 - RNA, 1701 nt, Artificial Sequence; identical to SEQ ID NO: 185680
  derived and/or modified sequence opt5 from hemagglutinin__InfluenzaA__ADG21137

SEQ ID NO: 187742 - RNA, 1701 nt, Artificial Sequence; identical to SEQ ID NO: 185680
  derived and/or modified sequence opt5 from hemagglutinin__InfluenzaA__ADG21138

SEQ ID NO: 187743 - RNA, 1701 nt, Artificial Sequence; identical to SEQ ID NO: 185680
  derived and/or modified sequence opt5 from hemagglutinin__InfluenzaA__ADG21139

SEQ ID NO: 187744 - RNA, 1701 nt, Artificial Sequence
  derived and/or modified sequence opt5 from hemagglutinin__InfluenzaA__ADG21140
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuaugcuguggggaauccaccaccccuccaccucugccgaucaacagagccucuaccagaacgcugacgccuacgucuucgugggcuccagcagauauucuaagaaauuuaagccugagauugcuauccggccgaaagugcgcgaucaggaggggagaaugaauuacuauuggacacuggucgaacccggagacaagauuaccuucgaggccacgggcaaccugguugugccucgguacgcguuugccauggaacgcaacgcuggguccggaaucauuaucagcgauacacccgugcaugacugcaauaccacaugucaaaccccuaaaggcgccaucaacaccucucuccccuuccagaauauucacccgaucacaauuggcaagugcccuaaguaugucaaaagcacgaagcugagacuugcuaccgggcugcggaacgugcccuccauccagucucgcggacucuuuggcgccauugccggguucaucgagggaggcuggacagggaugguugacggaugguacggcuaucaucaccagaaugaacaaggcagcggguacgcugcggaucugaaauccacccagaacgccaucgacgagauuacaaauaaggugaacagcgucaucgagaaaaugaauacccaguuuacggcugugggaaaggaguucaaccaccuugagaagagaauugaaaaucugaacaaaaagguugaugacggcuuccucgauaucuggacauacaaugccgagcugcuggugcuccuggaaaacgagcggacccuugacuaucaugauucuaaugucaaaaaccuguacgagaaggugcgcucccagcucaaaaacaaugccaaggaaauugggaacggauguuuugaguucuaucacaagugcgacaauaccuguauggaaagcgucaaaaacggcacauacgauuauccuaaguacucugaggaagcuaaacugaauagagaggagaucgacggggugaaacuugaauccacccggaucuaucaaauucuggccaucuacagcacaguugcguccucucucgugcuggucgugagccugggcgcuauuuccuuuuggaugugcucuaacggaagccuccagugccgcaucuguauuuga

SEQ ID NO: 187745 - RNA, 1701 nt, Artificial Sequence; identical to SEQ ID NO: 185680
  derived and/or modified sequence opt5 from hemagglutinin__InfluenzaA__ADG21141

SEQ ID NO: 187746 - RNA, 1701 nt, Artificial Sequence
  derived and/or modified sequence opt5 from hemagglutinin__InfluenzaA__ADG21142
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgaaaagagcuuuuauaagaaucugaucuggcucguuaaaaagggcaacucuuacccuaaacuguccaagagcuauauuaaugacaaggggaaagaggugcuuguccuguggggaauccaccaccccuccaccucugcggaucaacagagccucuaccagaacgccgacgcuuacguguucgugggcuccagcagauauucuaagaaauuuaagccugagauugccauccggccgaaaguccgcgaucaggaagggagaaugaauuacuauuggacacugguugagcccggagacaagauuaccuucgaagcuacgggcaaccugguggugccucgguacgccuuugcgauggagcgcaacgccggguccggaaucauuaucagcgauacacccguccaugacugcaauaccacaugucaaaccccuaaaggcgcuaucaacaccucucuccccuuccagaauauucacccgaucacaauuggcaagugcccuaaguaugugaaaagcacgaagcugagacuugccaccgggcugcggaacguucccuccauccagucucgcggacucuuuggcgcuauugccggguucaucgaaggaggcuggacagggaugguggacggaugguacggcuaucaucaccagaaugagcaaggcagcggguacgccgcugaucugaaauccacccagaacgcgaucgacgagauuacaaauaaggucaacagcgugaucgagaaaaugaauacccaguuuacggccguuggaaaggaguucaaccaccuugaaaagagaauugagaaucugaacaaaaagguggaugacggcuuccucgauaucuggacauacaaugcugaacugcugguccuccuggagaacgagcggacccuugacuaucaugauucuaaugugaaaaaccuguacgaaaagguccgcucccagcucaaaaacaaugccaaggagauugggaacggauguuuugaguucuaucacaagugcgacaauaccuguauggaaagcgugaaaaacggcacauacgauuauccuaaguacucugaagaggccaaacugaauagagaggaaaucgacgggguuaaacuugaguccacccggaucuaucaaauucuggcuaucuacagcacaguggccuccucucucguccuggugguuagccugggcgcgauuuccuuuuggaugugcucuaacggaagccuccagugccgcaucuguauuuga

SEQ ID NO: 187747 - RNA, 1701 nt, Artificial Sequence; identical to SEQ ID NO: 185680
  derived and/or modified sequence opt5 from hemagglutinin__InfluenzaA__ADG21143

SEQ ID NO: 187748 - RNA, 1701 nt, Artificial Sequence; identical to SEQ ID NO: 185680
  derived and/or modified sequence opt5 from hemagglutinin__InfluenzaA__ADG21144

SEQ ID NO: 187749 - RNA, 1701 nt, Artificial Sequence
  derived and/or modified sequence opt5 from hemagglutinin__InfluenzaA__ADG21145
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccauuagcuauaucaaugacaaggggaaggaagugcuuguccuguggggcauucaccaccccuccaccucugccgaucaacagagccucuaccagaacgcugacgccuacguguucgugggauccagcagauauucuaaaaaguuuaaaccugagaucgcuauucggccgaagguccgcgaucaggaggggagaaugaauuacuauuggacacugguugaacccggagacaaaaucaccuucgaggccacgggcaaccugguggugccucgguacgcguuugccauggaacgcaacgcuggguccggaauuaucaucagcgauacacccguccaugacugcaauaccacaugucaaaccccuaagggcgccauuaacaccucucuccccuuccagaauauccacccgauuacaaucggcaaaugcccuaaguauguuaagagcacgaaacugagacuugcuaccgggcugcggaacgugcccuccauucagucucgcggacucuuuggcgccaucgccggguucaucgagggaggcuggacagggaugguggacggaugguacggcuaucaucaccagaaugaacaaggcagcggguacgcugcggaucugaaguccacccagaacgccauugacgagaucacaaauaaagucaacagcgugauugagaagaugaauacccaguuuacggcuguuggaaaagaguucaaccaccuugagaagagaaucgaaaaucugaacaagaaaguggaugacggcuuccucgauauuuggacauacaaugccgagcugcugguccuccuggaaaacgagcggacccuugacuaucaugauucuaaugugaagaaccuguacgagaaaguccgcucccagcucaagaacaaugccaaagaaaucgggaacggauguuuugaguucuaucacaagugcgacaauaccuguauggaaagcgugaagaacggcacauacgauuauccuaaauacucugaggaagcuaagcugaauagagaggagaucgacgggguuaaacuugaauccacccggauuuaucaaauccuggccauuuacagcacaguggcguccucucucguccuggugguuagccugggcgcuaucuccuuuuggaugugcucuaacggaagccuccagugccgcauuuguaucuga

SEQ ID NO: 187750 - RNA, 1701 nt, Artificial Sequence; identical to SEQ ID NO: 185680
  derived and/or modified sequence opt5 from hemagglutinin__InfluenzaA__ADG21146

SEQ ID NO: 187751 - RNA, 1701 nt, Artificial Sequence; identical to SEQ ID NO: 185680
  derived and/or modified sequence opt5 from hemagglutinin__InfluenzaA__ADG21147

SEQ ID NO: 187752 - RNA, 1701 nt, Artificial Sequence; identical to SEQ ID NO: 185693
  derived and/or modified sequence opt5 from hemagglutinin__InfluenzaA__ADG21148

SEQ ID NO: 187753 - RNA, 1701 nt, Artificial Sequence; identical to SEQ ID NO: 186794
  derived and/or modified sequence opt5 from hemagglutinin__InfluenzaA__ADG21149

SEQ ID NO: 187754 - RNA, 1701 nt, Artificial Sequence; identical to SEQ ID NO: 186857
  derived and/or modified sequence opt5 from hemagglutinin__InfluenzaA__ADG21150

SEQ ID NO: 187755 - RNA, 1701 nt, Artificial Sequence; identical to SEQ ID NO: 185680
  derived and/or modified sequence opt5 from hemagglutinin__InfluenzaA__ADG21151

SEQ ID NO: 187756 - RNA, 1701 nt, Artificial Sequence; identical to SEQ ID NO: 185680
  derived and/or modified sequence opt5 from hemagglutinin__InfluenzaA__ADG21152

SEQ ID NO: 187757 - RNA, 1701 nt, Artificial Sequence; identical to SEQ ID NO: 185693
  derived and/or modified sequence opt5 from hemagglutinin__InfluenzaA__ADG21153

SEQ ID NO: 187758 - RNA, 1701 nt, Artificial Sequence; identical to SEQ ID NO: 185680
  derived and/or modified sequence opt5 from hemagglutinin__InfluenzaA__ADG21154

SEQ ID NO: 187759 - RNA, 1701 nt, Artificial Sequence; identical to SEQ ID NO: 185680
  derived and/or modified sequence opt5 from hemagglutinin__InfluenzaA__ADG21155

SEQ ID NO: 187760 - RNA, 1701 nt, Artificial Sequence; identical to SEQ ID NO: 186857
  derived and/or modified sequence opt5 from hemagglutinin__InfluenzaA__ADG21156

SEQ ID NO: 187761 - RNA, 1701 nt, Artificial Sequence; identical to SEQ ID NO: 186865
  derived and/or modified sequence opt5 from hemagglutinin__InfluenzaA__ADG21158

SEQ ID NO: 187762 - RNA, 1701 nt, Artificial Sequence
  derived and/or modified sequence opt5 from hemagglutinin__InfluenzaA__ADG21159
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggaucuaucaaauucuggccaucuacuccacgguggcgagcucccucguccugcuggugucucucggcgcuauuagcuuuuggaugugcuccaacggaucucugcagugccgcaucuguauuuga

SEQ ID NO: 187763 - RNA, 1701 nt, Artificial Sequence; identical to SEQ ID NO: 186865
  derived and/or modified sequence opt5 from hemagglutinin__InfluenzaA__ADG21160

SEQ ID NO: 187764 - RNA, 1701 nt, Artificial Sequence
  derived and/or modified sequence opt5 from hemagglutinin__InfluenzaA__ADG21161
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaaggaaaacagcuacccuaaacuguccaagagcuauauuaaugacaagggcaaagaggugcuuguccugugggggauccaccaccccuccaccucugccgaucaacagagccucuaccagaacgcugacgccuacguguucgugggaacauccagauauagcaagaaauuuaagccugagauugcuauccggccgaaaguccgcgaucaggaaggcagaaugaauuacuauuggacccugguugagcccggggacaagauuacguucgaagccacaggaaaccugguggugccucgguacgcguuugccauggagcgcaacgcuggcucugggaucauuaucuccgauacccccguccaugacugcaauacaaccugucaaaccccuaaaggagccaucaacacaagccuccccuuccagaauauucacccgaucacgauuggcaagugcccuaaguaugugaaaucuaccaagcugagacuugcuacaggccugcggaacguucccagcauccagucccgcgggcucuuuggagccauugccggcuucaucgaagggggauggaccggcaugguggacgggugguacggauaucaucaccagaaugagcaaggcucuggcuacgcugcggaucugaaaagcacacagaacgccaucgacgagauuaccaauaaggucaacuccgugaucgaaaagaugaauacgcaguuuacagcuguugggaaggaguucaaccaccuugaaaagagaauugagaaucugaacaaaaagguggaugacggauuccucgauaucuggaccuacaaugccgaacugcugguccuccuggagaacgagcggacccuugacuaucauaauagcaacgugaaaaaccuguacgaaaagguccgcucucagcucaaaaauaacgccaaggagauuggcaauggguguuuugaguucuaucacaagugcgauaacacauguauggaguccgugaaaaauggaaccuacgacuauccuaaguacagcgaagaggcuaaacugaacagagaggaaaucgauggcguuaaacuugagucuacacggaucuaucaaauucuggccaucuacuccacgguggcgagcucccucguccuggugguuucucugggggcuauuagcuuuuggaugugcuccaauggcucucuccagugccgcaucuguauuuga

SEQ ID NO: 187765 - RNA, 1701 nt, Artificial Sequence
  derived and/or modified sequence opt5 from hemagglutinin__InfluenzaA__ADG21163
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaaugugcacccgauuacgaucggcaagugcccuaaguauguuaaaucuaccaagcugagacuugcuacagggcugcggaacgugcccagcauucagucccgcggacucuuuggcgccaucgccggguucauugagggaggcuggaccgggauggucgacggaugguacggcuaucaucaccagaaugaacaaggcucuggguacgcugcggaucugaaaagcacacagaacgccaucgacgagaucaccaauaaggugaacuccguuauugagaaaaugaauacgcaguuuacagcugugggaaaggaguucaaccaccuugagaagagaaucgaaaaucugaacaaaaaggucgaugacggcuuccucgauguguggaccuacaaugccgagcugcugguccuccuggaaaacgagcggacccuugacuaucaugauagcaaugugaaaaaccuguacgagaagguucgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacggggucaaacuugaaucuacacggauuuaucaaauccuggccaucuacuccacgguggcgagcucccucguucugguggucucucugggcgcuauuagcuuuuggaugugcuccaacggaucucuccagugccgcaucuguauuuga

SEQ ID NO: 187766 - RNA, 1701 nt, Artificial Sequence
  derived and/or modified sequence opt5 from hemagglutinin__InfluenzaA__ADG21165
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaaucgcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaggaacugcgggagcagcuuuccagcgugucuuccuucaagcgcuuugaaaucuuccccaagaccaauagcuggccuaaccacgauucuaauaaaggagucacagccgcuuguccccaugccggcgcgaaguccuuuuauaaaaaccugauuuggcucgugaagaaaggcaauagcuacccuaagcugucuaaguccuauaucaacgacaaagggaaggagguucuugugcuguggggcauucaccaccccagcaccuccgccgaucaacagucucucuaccagaaugcugacgccuacgucuucgugggaacaagcaaauauuccaagaaauuuaagccugaaaucgcuauuagaccgaaagugcgggaucaggaggggcgcaugaacuacuauuggacccuggucgagcccggagacaagaucacguucgaagccacaggcaaccugguugugccuagauacgcguuugccauggagcggaaugcugggagcggaauuaucaucucugauacccccgugcaugacugcaacacaaccugucaaaccccuaagggcgccauuaauacaucccuccccuuccagaacauccacccgauuacgaucggcaaaugcccuaaguaugucaaaagcaccaagcugcgccuugcuacagggcugagaaaugugcccucuauucagagccggggacucuuuggcgccaucgccggguucaucgaaggaggcuggaccgggaugguugacggaugguacggcuaucaucaccagaacgagcaaggcuccggguacgcugcggaucugaaaucuacacagaaugccauugacggaaucaccaacaaggugaauagcgucauugaaaagaugaacacgcaguuuacagcugugggcaaagaguucaaucaccuugagaagcgcaucgaaaaccugaauaaaaagguugaugacggguuccucgauauuuggaccuacaacgccgagcugcuggugcuccuggaaaaugagagaacccuugacuaucaugauuccaacgucaaaaaccuguacgaaaaggugcggagccagcucaagaauaacgccaaagagaucggaaauggcuguuuugaguucuaucacaagugcgacaacacauguauggaaucugucaaaaaugggaccuacgauuauccuaaguacuccgaggaagcuaaacugaaccgcgaggaaaucgacggcgugaaacuugagagcacaagaauuuaucaaauccuggccauuuacucuacgguugcguccagccucgugcuggucgugucccugggagcuaucucuuuuuggaugugcagcaauggcucccuccagugccggauuuguaucuga

SEQ ID NO: 187767 - RNA, 1701 nt, Artificial Sequence; identical to SEQ ID NO: 185680
  derived and/or modified sequence opt5 from hemagglutinin__InfluenzaA__ADG21166

SEQ ID NO: 187768 - RNA, 1701 nt, Artificial Sequence
  derived and/or modified sequence opt5 from hemagglutinin__InfluenzaA__ADG21168
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaaguucuauauuaaugacaaggggaaagaagugcuuguccuguggggaauccaccaccccagcaccuccgccgaucaacagucucucuaccagaacgcugacgccuacguguuugugggcagcuccagauauagcaagaaauucaagccugagauugcuauccggccgaaaguccgcgaucaggaggggagaaugaauuacuauuggacacugguugaacccggagacaagauuaccuuugaggccacgggcaaccugguggugccucgguacgcguucgccauggaacgcaacgcugggucuggaaucauuaucuccgauacacccguccaugacugcaauaccacaugucaaaccccuaaaggcgccaucaacaccagccuccccuuucagaauauucacccgaucacaauuggcaagugcccuaaguaugugaaaucuacgaagcugagacuugcuaccgggcugcggaacguucccagcauccagucccgcggacucuucggcgccauugccggguuuaucgagggaggcuggacagggaugguggacggaugguacggcuaucaucaccagaaugaacaaggcucuggguacgcugcggaucugaaaagcacccagaacgccaucgacgagauuacaaauaaggucaacuccgugaucgagaaaaugaauacccaguucacggcuguuggaaaggaguucaaccaccuugagaagagaauugaaaaucugaacaaaaagguggaugacggcuuucucgauaucuggacauacaaugccgagcugcugguccuccuggaaaacgagcggacccuugacuaucaugauagcaaugugaaaaaccuguacgagaagguccgcucucagcucaaaaacaaugccaaggaaauugggaacggauguuucgaguuuuaucacaagugcgacaauaccuguauggaauccgugaaaaacggcacauacgauuauccuaaguacagcgaggaagcuaaacugaauagagaggagaucgacgggguuaaacuugaaucuacccggaucuaucaaauucuggccaucuacuccacaguggcgagcucccucguccuggugguuucucugggcgcuauuagcuucuggaugugcuccaacggaucucuccagugccgcaucuguauuuga

SEQ ID NO: 187769 - RNA, 1701 nt, Artificial Sequence; identical to SEQ ID NO: 187722
  derived and/or modified sequence opt5 from hemagglutinin__InfluenzaA__ADG21169

SEQ ID NO: 187770 - RNA, 1701 nt, Artificial Sequence; identical to SEQ ID NO: 185680
  derived and/or modified sequence opt5 from hemagglutinin__InfluenzaA__ADG21170

SEQ ID NO: 187771 - RNA, 1701 nt, Artificial Sequence; identical to SEQ ID NO: 185680
  derived and/or modified sequence opt5 from hemagglutinin__InfluenzaA__ADG21173

SEQ ID NO: 187772 - RNA, 1701 nt, Artificial Sequence; identical to SEQ ID NO: 185693
  derived and/or modified sequence opt5 from hemagglutinin__InfluenzaA__ADG21174

SEQ ID NO: 187773 - RNA, 1701 nt, Artificial Sequence; identical to SEQ ID NO: 185693
  derived and/or modified sequence opt5 from hemagglutinin__InfluenzaA__ADG21175

SEQ ID NO: 187774 - RNA, 1701 nt, Artificial Sequence; identical to SEQ ID NO: 185680
  derived and/or modified sequence opt5 from hemagglutinin__InfluenzaA__ADG21176

SEQ ID NO: 187775 - RNA, 1701 nt, Artificial Sequence; identical to SEQ ID NO: 185680
  derived and/or modified sequence opt5 from hemagglutinin__InfluenzaA__ADG21177

SEQ ID NO: 187776 - RNA, 1701 nt, Artificial Sequence; identical to SEQ ID NO: 185680
  derived and/or modified sequence opt5 from hemagglutinin__InfluenzaA__ADG21178

SEQ ID NO: 187777 - RNA, 1701 nt, Artificial Sequence; identical to SEQ ID NO: 186046
  derived and/or modified sequence opt5 from hemagglutinin__InfluenzaA__ADG21179

SEQ ID NO: 187778 - RNA, 1701 nt, Artificial Sequence; identical to SEQ ID NO: 185680
  derived and/or modified sequence opt5 from hemagglutinin__InfluenzaA__ADG21180

SEQ ID NO: 187779 - RNA, 1701 nt, Artificial Sequence; identical to SEQ ID NO: 185680
  derived and/or modified sequence opt5 from hemagglutinin__InfluenzaA__ADG21181

SEQ ID NO: 187780 - RNA, 1701 nt, Artificial Sequence; identical to SEQ ID NO: 185680
  derived and/or modified sequence opt5 from hemagglutinin__InfluenzaA__ADG21182

SEQ ID NO: 187781 - RNA, 1701 nt, Artificial Sequence; identical to SEQ ID NO: 185680
  derived and/or modified sequence opt5 from hemagglutinin__InfluenzaA__ADG21183

SEQ ID NO: 187782 - RNA, 1701 nt, Artificial Sequence; identical to SEQ ID NO: 186857
  derived and/or modified sequence opt5 from hemagglutinin__InfluenzaA__ADG21184

SEQ ID NO: 187783 - RNA, 1701 nt, Artificial Sequence
  derived and/or modified sequence opt5 from hemagglutinin__InfluenzaA__ADG21185
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguuaagcccggagacaaaauuacguucgaagccacaggcaaccugguggugccucgguacgcguuugccauggagcgcaacgcugggucuggaaucauuaucuccgauacccccguccaugacugcaauacaaccugucaaaccccuaagggcgccaucaacacaagccuccccuuccagaauauucacccgaucacgauuggcagaugcccuaaguaugugaaaucuaccaagcugcggcuugcuacagggcugcgcaacguucccagcauccaguccagaggacucuuuggcgccauugccggguucaucgaaggaggcuggaccgggaugguggacggaugguacggcuaucaucaccagaaugagcaaggcucuggguacgcugcggaucugaaaagcacacagaacgccaucgacgaaauuaccaauaaggucaacuccgugaucgagaaaaugaauacgcaguuuacagcuguuggaaaggaguucaaccaccuugaaaagcggauugagaaucugaacaaaaagguggaugacggcuuccucgauaucuggaccuacaaugccgaacugcugguccuccuggagaacgaacgcacccuugacuaucaugauagcaaugugaaaaaccuguacgagaaggucagaucucagcucaaaaacaaugccaaggagauugggaacggauguuuugaguucuaucacaagugcgacaauacauguauggaguccgugaaaaacggcaccuacgauuauccuaaguacagcgaagaggcuaaacugaaucgggaagagaucgacgggguuaaacuugagucuacacgcaucuaucaaauucuggccaucuacuccacgguggcgagcucccucguccuggugguuucucugggcgcuauuagcuuuuggaugugcuccaacggaucucuccagugcagaaucuguauuuga

SEQ ID NO: 187784 - RNA, 1701 nt, Artificial Sequence; identical to SEQ ID NO: 187039
  derived and/or modified sequence opt5 from hemagglutinin__InfluenzaA__ADG21188

SEQ ID NO: 187785 - RNA, 1707 nt, Artificial Sequence
  derived and/or modified sequence opt5 from hemagglutinin__InfluenzaA__ADG21402
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucugugaucuggacggagugaaaccccuuauccugagagauugcagcguugcgggcuggcuccuggggaacccuaugugugacgaguuccugaaugugccggaaugguccuauaucgucgagaagauuaaccccgcuaaugaucucugcuacccuggaaacuuuaaugacuaugaggaacugaagcaucuucugucucggaucaaccacuucgagaaaauucagaucauucccaagagcuccuggucugaucaugaagccagcuccggcgugagcucugccuguccuuaccaggggcgcuccagcuuuuucagaaauguuguguggcucaucaaaaaggacaacgcuuaucccaccauuaaacggucuuacaauaacacaaaucaagaggaucugcuuguccuguggggaauccaccacccuaacgacgccgcugagcagacccgccucuaucagaacccgacaaccuacaucuccgugggcacgagcacccugaaucagagacuggugcccaagauugccacacggucuaaggucaacggccaauccgggcgcauggaauuuuucuggaccauccucaaaagcaaugaugcgauuaacuuugaguccaauggaaacuucaucgccccugaaaaugcuuacaagauuguuaaaaagggcgacucuacaaucaugaaaagcgagcuggaauaugggaacugcaauaccaagugucagacgcccaucggagccauuaacuccagcaugccuuuucauaauauccacccccuuacaauuggcgagugcccgaaauacgugaagucuaacagacugauccucgcuaccgggcugcgcaauuccccucagggagagcggagacggaagaaacgcggccuuuucggcgccauugcgggguuuaucgaaggaggcuggcaggggaugguggacggaugguauggcuaccaucacagcaacgagcaagggucuggauaugccgcugauaaggaaagcacacagaaagccaucgacggcgucaccaauaaggugaacuccauuaucgauaaaaugaacacccaguucgaggcuguuggcagagaauuuaauaaccuggagcggcgcauugagaaucucaacaagaagauggaagacggguuccuggauguguggacauacaaugccgagcugcucguccugauggaaaacgagagaacgcuugacuuccacgauucuaaugugaaaaaccuguaugacaagguucggcuccaacugagagauaaugccaaagaacuuggaaacggcuguuuugaguucuaccaucgcugcgacaaugaguguauggaaagcgugcggaacgggaccuacgauuauccccaguacuccgaggaagcuagacugaagcgcgaggagaucagcggagucaaacucgaaucuauuggcacauaucagauccuguccauuuacagcaccguggcgucuucccuggcccucgcuaucauggucgccgggcuguuucuuuggaugugcagcaauggcucccugcagugccggaucuguauuuga

SEQ ID NO: 187786 - RNA, 1704 nt, Artificial Sequence
  derived and/or modified sequence opt5 from hemagglutinin__InfluenzaA__ADG21414
auggagaagaucgugcugcuccuggccauugucagcaucguuaaauccgaccagauuugcaucggcuaccacgcuaacaauucuaccgaacauguggauacaauuauggagaagaacgugacggucacccacgcccaagacauccuugaaaagacacauaaugggaaacuguguaaccucgauggagugaaaccccugauccuuagagacugcagcguugcgggcuggcugcucgggaauccuaugugugaugaguuccugaacgugccggaaugguccuauauugucgagaagaucaaucccgcuaacgaccugugcuacccuggaaauuuuaacgauuaugaggaacucaagcaucugcuuucucggauuaaucacuucgagaaaauccagauuauccccaagaacagcugguccgaccacgaagccucuggcgugagcuccgccuguccuuaccaggggcgcagcuccuuuuucagaaauguuguguggcugaccaaaaagaacaaugcuuaucccacaauuaaaaagucuuacaacaacaccaaucaggaggaucuccugguccuuuggggaauccaccauccuaacgacggcgccgagcaaacacggcuguaucagaauccgaccacguacaucagcgugggcaccucuacacucaaccagcgccuggugcccaagauugcuaccagauccaaagucaaugggcagagcggacggauggaauuuuucuggacaauccugaagucuaacgaugccauuaauuuugaguccaacggcaauuucaucgcgccugaaaacgccuacaaaauuguuaagaaaggggacagcaccaucaugaaguccgagcucgaauauggaaauugcaacacgaaaugucaaacacccaucggcgcuauuaauucuagcaugccuuuucacaacauccauccccugaccauuggggagugcccgaaguacgugaaguccaaucgccuugugcuggccacaggacucagaaacagcccucagggcgagcggcgccggaaaaagagaggccuguucggggcuaucgccggauuuauugaaggcggguggcagggaauggucgauggcugguauggguaccaccacucuaacgagcagggauccggcuaugcggccgacaaagaaagcacccaaaaggcuaucgacggcgugaccaauaaaguuaacucuaucauugauaagaugaauacacaguucgaggccguggggcgcgaauuuaacaaucuugagagacggaucgagaaccugaauaagaaaauggaagacggauuccucgaugucuggacguacaacgcugagcugcuggugcucauggaaaaugagcgcacccuggacuuccaugauagcaacguuaagaaucuuuaugacaaagugagacugcagcuccgggauaacgccaaggaacugggcaauggguguuuugaguucuaccacagaugcgacaacgaguguauggaauccguccgcaauggaacauacgauuauccccaauacucugaggaagcccggcuuaaaagagaggagauuagcggcgugaagcuggaauccaucgggaccuaucagauucucagcaucuacucuacagucgcuuccagccuggcgcuggccauuaugguggcuggccucuuucuguggaugugcucuaacggaucccuucagugccgcaucuguaucuga

SEQ ID NO: 187787 - RNA, 1704 nt, Artificial Sequence
  derived and/or modified sequence opt5 from hemagglutinin__InfluenzaA__ADG21416
auggagaagaucgugcugcuccuggccauugucagcaucguuaaauccgaccagauuugcaucggcuaccacgcuaacaauucuaccgaacaaguggauacaauuauggagaagaacgugacggucacccaugcccaggacauccuugaaaagacacacaaugggaaacuguguaaccucgauggagugaaaccccugauccuuagagacugcagcguugcgggcuggcugcucgggaauccuaugugugaugaguuccugaacgugccggaaugguccuauauugucgagaagaucaaucccgcuaacgaccugugcuacccuggaaauuuuaacgauuaugaggaacucaagcaucugcuuucucggauuaaucacuucgagaaaauccagauuauccccaagaacagcugguccgaccaugaagccucuggcgugagcuccgccuguccuuaccaggggcgcagcuccuuuuucagaaauguuguguggcugaccaaaaagaacaaugcuuaucccacaauuaaaaagucuuacaacaacaccaaucaagaggaucuccugguccuuuggggaauccaccacccuaacgacgccgcugagcagacaggccuguaucagaauccgaccacguacaucagcgugggcaccucuacacucaaccagcggcuggugcccaagauugccacccgcuccaaagucaaugggcaaagcggaagaauggaauuuuucuggacaauccugaagucuaacgauguuauuaauuuugaguccaacggcaauuucaucgcgccugaaaacgccuacaaaauugugaagaaaggggacagcaccaucaugaaguccgagcucgaauauggaaauugcaacacgaaaugucagacacccaucggcgcuauuaauucuagcaugccuuuucauaacauccacccccugaccauuggggagugcccgaaguacgugaaguccaaucggcuuguccuggccacaggacuccgcaacagcccucagggcgagagacggcgcaaaaagagaggccuguucggggcuaucgccggauuuauugaaggcggguggcagggaaugguggauggcugguauggguaccaucacucuaacgagcaaggauccggcuaugcggccgacaaagaaagcacccagaaggcuaucgacggcguuaccaauaaagugaacucuaucauugauaagaugaauacacaguucgaggccgucgggcgggaauuuaacaaucuugagcgcagaaucgagaaccugaauaagaaaauggaagacggauuccucgauguguggacguacaacgcugagcugcugguucucauggaaaaugagcggacccuggacuuccacgauagcaacgugaagaaucuuuaugacaaaguccgccugcaacucagagauaacgccaaggaacugggcaauggguguuuugaguucuaccaucggugcgacaacgaguguauggaauccgugagaaauggaacauacgauuauccccaguacucugaggaagcccgccuuaaacgggaggagauuagcggcgucaagcuggaauccaucgggaccuaucagauucucagcaucuacucuacaguggcuuccagccuggcgcuggccauuaugguugcuggccucuuucuguggaugugcucuaacggaucccuucagugcagaaucuguaucuga

SEQ ID NO: 187788 - RNA, 1704 nt, Artificial Sequence
  derived and/or modified sequence opt5 from hemagglutinin__InfluenzaA__ADG21420
auggagaagaucgugcugcuccuggccauugucagcaucguuaaauccgaccagauuugcaucggcuaccacgcuaacaauucuaccgaacaaguggauacaauuauggagaagaacgugacggucacccaugcccaggacauccuugaaaagacacacaaugggaaacuguguaaccucgauggagugaaaccccugauccuuagagacugcagcguugcgggcuggcugcucgggaauccuaugugugaugaguuccugaacgugccggaaugguccuauauugucgagaagaucaaucccgcuaacgaccugugcuacccuggaaauuuuaacgauuaugaggaacucaagcaucugcuuucucggauuaaucacuucgagaaaauccagauuauccccaagaacagcugguccgaccaugaagccucuggcgugagcuccgccuguccuuaccaggggcgcagcuccuuuuucagaaauguuguguggcugaccaaaaagaacaaugcuuaucccacaauuaaaaagucuuacaacaacaccaaucaagaggaucuccugguccuuuggggaauccaccacccuaacgacgccgcugagcagacacggcuguaucagaauccgaccacguacaucagcgugggcaccucuacacucaaccagcgccuggugcccaagauugccaccagauccaaagucaauggccaaagcgggcggauggaauuuuucuggacaauccugaagucuaacgaugcgauuaauuuugaguccaacggaaauuucaucgccccugaaaacgcuuacaaaauuguuaagaaaggcgacagcaccaucaugaaguccgagcucgaauaugggaauugcaacacgaaaugucagacacccaucggagccauuaauucuagcaugccuuuucauaacauccacccccugaccauuggcgagugcccgaaguacgugaaguccaaucgccuugugcuggcuacagggcucagaaacagcccucagggagagcggcgccggaaaaagagaggccuguucggcgccaucgcgggguuuauugaaggaggcuggcaggggauggucgauggaugguauggcuaccaucacucuaacgagcaaggguccggauaugccgcugacaaagaaagcacccagaaggccaucgacggcgugaccaauaaaguuaacucuaucauugauaagaugaauacacaguucgaggcugugggccgcgaauuuaacaaucuugagagacggaucgagaaccugaauaagaaaauggaagacggguuccucgaugucuggacguacaacgccgagcugcuggugcucauggaaaaugagcgcacccuggacuuccacgauagcaacguuaagaaucuuuaugacaaagugagacugcaacuccgggauaacgccaaggaacugggaaauggcuguuuugaguucuaccauagaugcgacaacgaguguauggaauccguccgcaaugggacauacgauuauccccaguacucugaggaagcucggcuuaaaagagaggagauuagcggagugaagcuggaauccaucggcaccuaucagauucucagcaucuacucuacagucgcguccagccuggcccuggcuauuaugguggccgggcucuuucuguggaugugcucuaacggcucccuucagugccgcaucuguaucuga

SEQ ID NO: 187789 - RNA, 1704 nt, Artificial Sequence
  derived and/or modified sequence opt5 from hemagglutinin__InfluenzaA__ADG21422
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucuguaaccuggauggagugaaaccccuuauccugagagacugcagcguugcgggcuggcuccuggggaauccuaugugugaugaguuccugaacgugccggaaugguccuauaucgucgagaagauuaaucccaccaacgaccucugcuacccuggaaauuuuaacgauuaugaggaacugaagcaucuucugucucggaucaaucacuucgagaaaauucagaucauucccaagaacagcugguccgaccaugaggcuucuggcgugagcuccgccuguccuuaccaggggcgcagcuccuuuuucagaaauguuguguggcucaccaaaaagaacaaugccuaucccacaaucaaacggucuuacaacaacacaaaucaagaagaucugcuuguccuguggggcauucaccacccuaacgacgcugccgagcagacccgccucuaucagaauccgacgaccuacaucagcgugggaacaucuacccugaaccagagacuggugcccaagaucgcuacacgguccaaggucaauggccaaagcgggcgcauggaauuuuucuggaccauucucaaaucuaacgaugccaucaauuuugaguccaacggaaauuucauugcgccugaaaacgccuacaagaucguuaaaaagggcgacagcacgauuaugaaauccgagcuggaauaugggaauugcaacacaaagugucagacccccaucggagcuaucaauucuagcaugccuuuucauaacauucacccccuuacaaucggcgagugcccgaaauacgugaaguccaauagacuggugcucgccaccgggcugcggaacagcccucagggagagcgcagacggaagaaacgcggccuuuucggcgcuauugccggguuuaucgaaggaggcuggcaggggauggucgauggaugguauggcuaccaucacucuaacgagcaaggguccggauaugcggccgacaaggaaagcacccagaaagcuauugacggcgugacaaauaagguuaacucuaucaucgauaaaaugaauacgcaguucgaggccgugggcagagaauuuaacaaucuggagcggcgcauugagaaccucaauaagaagauggaagacggguuccuggaugucuggaccuacaacgcugagcugcucgugcugauggaaaaugagagaacacuugacuuccacgauagcaacguuaaaaaucuguaugacaaggugcggcuccaacugagagauaacgccaaagaacuuggaaauggcuguuuugaguucuaccaucgcugcgacaacgaguguauggaauccguccggaaugggaccuacgauuauccccaguacucugaggaagccagaagcaagcgcgaggagaucuccggagugaaacuggaaagcauuggcacauaucagauccucucuauuuacuccaccgucgcuagcucucuggcgcuggccaucaugguggcugggcucuuucuguggaugugcuccaacggcagccuucagugccggauuuguaucuga

SEQ ID NO: 187790 - RNA, 1704 nt, Artificial Sequence
  derived and/or modified sequence opt5 from hemagglutinin__InfluenzaA__ADG21425
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucuguaaccuggauggagugaaaccccuuauccugagagacugcagcguugcgggcuggcuccuggggaauccuaugugugaugaguuccugaacgugccggaaugguccuauaucgucgagaagauuaaucccgcuaacgaccucugcuacccuggaaauuuuaacgauuaugaggaacugaagcaucuucugucucggaucaaucacuucgagaaaauucagaucauucccaagaacagcugguccgaccauggcgccucuggggugagcuccgccuguccuuaccagggacgcagcuccuuuuucagaaauguuguguggcucaccaaaaagaacaaugcuuaucccacaaucaaaaagucuuacaacaacaccaaucaagaagaucugcuuguccuguggggcauucaccacccuaacgacgccgaggagcagacacggcucuaucagaauccgaccacguacaucagcgugggcaccucuacacugaaccagcgccuggugcccaagaucgcuaccagauccaaagucaaugggcaaagcggacggauggaauuuuucuggacaauucucaagucuaacgaugccaucaauuuugaguccaacggcaauuucauugcgccugaaaacgccuacaaaaucguuaagaaaggggacagcaccauuaugaaguccgagcuggaauaugauaauugcaacacgaaaugucagacacccaucggagcuaucaauucuagcaugccuuuucauaacauucacccccuuaccaucggcgagugcccgaaguacgugaaguccaauaaacuggugcucgccacagggcugcgcaacagcccucagggagagaagagacggaaaaagcgcggccuuuucggcgcuauugccggguuuaucgaaggaggcuggcaggggauggucgacggaugguauggcuaccaucacucuaacgagcaaggguccggauaugcggccgacaaagaaagcacccagaaggcuauugauggcgugaccaauaagguuaacucuaucaucgacaaaaugaauacacaguucgaggccgugggcagagaauuuaacgcucuggagcggcgcauugagaaucucaacaagaaaauggaagauggguuccuggacgucuggacguacaaugccgagcugcucgugcugauggaaaacgagagaacccuugauuuccacgacagcaauguuaagaaccuguaugauaaagugcggcuccaacugcgcgacaaugccaaggaacuuggaaacggcuguuuugaguucuaccauagaugcgauaaugaguguauggaauccguccggaacgggacauacgacuauccccaguacucugaggaagcuagacugaagcgcgaggagaucagcggagugaaacucgaauccauuggcaccuaucagauccugagcauuuacucuacagucgcguccagccuggcccucgcuaucaugguggccgggcugucucuuuggaugugcuccaauggcagccugcagugccggauuuguaucuga

SEQ ID NO: 187791 - RNA, 1704 nt, Artificial Sequence
  derived and/or modified sequence opt5 from hemagglutinin__InfluenzaA__ADG21429
auggagaagaucgugcugcuccuggccauugucagcaucguuaaauccgaccagauuugcaucggcuaccacgcuaacaauucuaccgaacaaguggauacaauuauggagaagaacgugacggucacccaugcccaggacauccuugagaaaacacacaaugggaagcuguguaaccucgauggaguggagccccugauccuuagagacugcagcguugcgggcuggcugcucgggaauccuaugugugaugaauuucugaacgugccggagugguccuauauugucgagaaaaucaaucccgcuaacgaccugugcuacccuggaaauuuuaacgauuaugaagaacucaagcaucugcuuucucggauuaaucacuucgaaaagauccagauuauccccaaaaacagcugguccgaccaugaggccucuggcgugagcuccgccuguccuuaccaggggcgcagcucuuucuucagaaauguuguguggcugaccaagaaaaacaaugcuuaucccacaauuaagaaauccuacaacaacaccaaucaagaggaucuccugguccuuuggggaauccaccacccuaacgacgccgcugaacagacacggcuguaucagaauccgaccacguacaucagcgugggcaccucuacacucaaccagcgccuggugcccaagauugccaccagauccaaggucaauggccaaagcgggcggauggaguuuuucuggacaauccugaaaucuaacgauguuauuaauuuugaauccaacggaaauuucaucgcgccugagaacgccuacaagauugugaaaaagggcgacagcaccaucaugaaauccgaacucgaguaugggaauugcaacacgaagugucagacacccaucggagcuauuaauucuagcaugccuuuucauaacauccacccccugaccauuggcgagugcccgaaauacgugaaguccgaucgccuuguccuggccacagggcucagaaauagcccucagggagaacggcgcagaaagaaacggggccuguucggcgcuaucgccggguuuauugagggaggcuggcaggggaugguggacggaugguauggcuaccaucacucuaacgaacaaggguccggauaugcggccgacaaggagagcacccagaaagcuaucgauggcguuaccaacaaggucaauucuaucauugacaaaaugaacacacaguucgaagccgugggccgcgaguuuaauaaccuugagagacggaucgaaaaucugaacaagaagauggaggauggguuccucgacguguggacguacaaugcugaacugcugguucucauggagaacgaacgcacccuggauuuccacgacagcaaugugaaaaaccuuuaugauaaggucagacugcaacuccgggacaaugccaaagagcugggaaacggcuguuuugaguucuaccauagaugcgauaaugaauguauggaguccgugcgcaacgggacauacgacuauccccaguacucugaagaggcccggcuuaagagagaggaaauuagcggagucaaacuggaguccaucggcaccuaucagauucucagcaucuacucuacaguggcuuccagccuggcgcuggccauuaugguugcugggcuccugcuuuggaugugcucuaauggcucccugcagugccgcaucuguaucuga

SEQ ID NO: 187792 - RNA, 1704 nt, Artificial Sequence
  derived and/or modified sequence opt5 from hemagglutinin__InfluenzaA__ADG21437
auggagaagaucgugcugcuccuggccauugucagcaucguuaaauccgaccagauuugcaucggcuaccacgcuaacaauucuaccgaacaaguggauacaauuauggagaagaacgugacggucacccaugcccaggacauccuugaaaagacacacaaugggaaacuguguaaccucgauggagugaaaccccugauccuuagagacugcagcguugcgggcuggcugcucgggaauccuaugugugaugaguuccugaacgugccggaaugguccuauauugucgagaagaucaaucccgcuaacgaccugugcuacccuggaaauuuuaacgauuaugaggaacucaagcaucugcuuucucggauuaaucacuucgagaaaauccagauuauccccaagaacagcugguccgaccaugaagccucuggcgugagcuccgccuguccuuaccaggggcgcagcuccuuuuucagaaauguuguguggcugacccagaaaaacaaugcuuaucccacaauuaagaaaucuuacaacaacaccaaucaagaggaucuccugguccuuuggggaauccaccacccuaacgacgccgcugagcagacacggcuguaucagaauccgaccacguacaucagcgugggcaccucuacacucaaccaacgccuggugcccaagauugccaccagauccaaggucaauggccagagcgggcggauggaauuuuucuggacaauccugaaaucuaacgauguuauuaauuuugaguccaacggaaauuucaucgcgccugaaaacgccuacaagauugugaaaaagggcgacagcaccaucaugaaauccgagcucgaauaugggaauugcaacacgaagugucagacacccaucggagcuauuaauucuagcaugccuuuucauaacauccacccccugaccauuggcgagugcccgaaauacgugaaguccaaucgccuuguccuggccacagggcucagaaacagcccucagggagagcggcgcagaaagaaacggggccuguucggcgcuaucgccggguuuauugaaggaggcuggcaagggaugguggauggaugguauggcuaccaucacucuaacgagcagggguccggauaugcggccgacaaggaaagcacccagaaagcuaucgacggcguuaccaauaaggugaacucuaucauugauaaaaugaauacacaauucgaggccgucggccgcgaauuuaacaaucuugagagacggaucgagaaccugaauaagaagauggaagacggguuccucgauguguggacguacaacgcugagcugcugguucucauggaaaaugagcgcacccuggacuuccacgauagcaacgugaaaaaucuuuaugacaaggucagacugcagcuccgggauaacgccaaagaacugggaaauggcuguuuugaguucuaccauagaugcgacaacgaguguauggaauccgugcgcaaugggacauacgauuauccccaguacucugaggaagcccggcuuaagagagaggagauuagcggagucaaacuggaauccaucggcaccuaucagauucucagcaucuacucuacaguggcuuccagccuggcgcuggccauuaugguugcugggcucuuucuguggaugugcucuaacggcucccuucaaugccgcaucuguaucuga

SEQ ID NO: 187793 - RNA, 1704 nt, Artificial Sequence
  derived and/or modified sequence opt5 from hemagglutinin__InfluenzaA__ADG21439
auggagaagaucgugcugcuccuggccauugucagcaucguuaaauccgaccagauuugcaucggcuaccacgcuaacaauucuaccgaacaaguggauacaauuauggagaagaacgugacggucacccaugcccaggacauccuugaaaagacacacaaugggaaacuguguaaccucgauggagugaaaccccugauccuuagagacugcagcguugcgggcuggcugcucgggaauccuaugugugaugaguuccugaacgugccggaaugguccuauauugucgagaagaucaaucccgcuaacgaccugugcuacccuggaaauuuuaacgauuaugaggaacucaagcaucugcuuucucggauuaaucacuucgagaaaauccagauuauccccaagggcagcugguccgaccaugaagccucuggggugagcuccgccuguccuuaccagggacgcagcuccuuuuucagaaacguuguguggcugaccaaaaagaauaacgcuuaucccacaauuaaaaagucuuacaauaacaccaaccaagaggaucuccugguccuuuggggcauccaccacccuaaugacgccgcugagcagacacggcuguaucagaacccgaccacguacaucagcgugggcaccucuacacucaaucagcgccuggugccccaaauugccaccagauccaaggucaacgggcagagcggacggauggaauuuuucuggacaauccugaaaucuaaugaugcgauuaacuuugaguccaauggcaacuucaucgccccugaaaaugcuuacaagauuguuaaaaagggggacagcaccaucaugaaauccgagcucgaauauggaaacugcaauacgaagugucagacacccaucggcgccauuaacucuagcaugccuuuucauaauauccacccccugaccauuggggagugcccgaaauacgugaaguccaaccgccuugugcuggcuacaggacucagaaauagcccucagggcgagcggcgcagaaagaaacggggccuguucggggccaucgcgggauuuauugaaggcggguggcaaggaauggucgauggcugguauggguaccaucacucuaacgagcagggauccggcuaugccgcugacaaggaaagcacccagaaagccaucgacggcgugaccaacaagguuaauucuaucauugauaaaaugaacacacaauucgaggcuguggggcgcgaauuuaauaaccuugagagacggaucgagaaucugaacaagaagauggaagacggauuccucgaugucuggacguacaaugccgagcugcuggugcucauggaaaacgagcgcacccuggacuuccacgauagcaauguuaaaaaccuuuaugacaaggugagacugcagcuccgggauaaugccaaagaacugggcaacggguguuuugaguucuaccauagaugcgacaaugaguguauggaauccguccgcaacggaacauacgauuauccccaguacucugaggaagcucggcuuaagagagaggagauuagcggcgugaaacuggaauccaucgggaccuaucagauucucagcaucuacucuacagucgcguccagccuggcccuggcuauuaugguggccggccucuuucuguggaugugcucuaauggaucccuucaaugccgcaucuguaucuga

SEQ ID NO: 187794 - RNA, 1704 nt, Artificial Sequence
  derived and/or modified sequence opt5 from hemagglutinin__InfluenzaA__ADG21441
auggagaagaucgugcugcuccuggccauugucagcaucguuaaauccgaccagauuugcaucggcuaccacgcuaacaauucuaccgaacaaguggauacaauuauggagaagaacgugacggucacccaugcccaggacauccuugaaaagacacacaaugggaagcuguguaaccucgauggagugaaaccccugauccuuagagacugcagcguugcgggcuggcugcucgggaauccuaugugugaugaguuccugaacgugccggaaugguccuauauugucgagaagaucaaucccucuaacgaccugugcuacccuggaaauuuuaacgauuaugaggaacucaagcaucugcuuagccggauuaaucacuucgagaaaauccagauuauccccaagaacuccuggucugaccaugaagcuagcggcguguccagcgccuguccuuaccaggggcgcagcuccuuuuucagaaauguuguguggcugaccaaaaagaacaaugccuaucccacaauuaaaaagagcuacaacaacaccaaucaagaggaucuccugguccuuuggggaauccaccacccuaacgacgaggcugaacagacaucucuguaucagaauccgaccacguacaucuccgugggcaccagcacacucaaccagcggcuggugcccaagauugccacccgcucuaaagucaauggccaauccgggagaauggaguuuuucuggacaauccugaagucuaacgaugcuauuaauuuugaauccaacggaaauuucaucgccccugagaacgcguacaaaauuguuaagaaaggcgacucuaccaucaugaaaagcgaacucgaguaugggaauugcaacacgaaaugucagacacccaucggagccauuaauuccagcaugccuuuucauaacauccacccccugaccauuggcgagugcccgaaguacgugaagucuaaucggcuugugcuggcuacagggcuccgcaacuccccucagggagaaagacggcgcaaaaagagaggccuguucggcgccaucgcuggguuuauugagggaggcuggcaggggauggucgauggaugguauggcuaccaucacagcaacgaacaagggucuggauaugccgcggacaaagagagcacccagaaggccaucgacggcgugaccaauaaaguuaacuccaucauugauaagaugaauacacaguucgaagcugugggccgggaguuuaacaaucuugagcgcagaaucgaaaaccugaauaagaaaauggaggacggguuccucgaugucuggacguacaacgccgaacugcuggugcucauggagaaugaacggacccuggacuuccacgauucuaacguuaagaaucuuuaugacaaagugcgccugcaacucagagauaacgcuaaggagcugggaaauggcuguuuugaguucuaccaucggugcgacaacgaauguauggagagcgucagaaaugggacauacgauuauccccaguacuccgaagaggcccgccuuaaacgggaggaaauuagcggagugaagcuggagucuaucggcaccuaucagauucucuccaucuacagcacagucgccucuucccuggcucuggcgauuaugguggccgggcucuuucuguggaugugcagcaacggcucccuucagugcagaaucuguaucuga

SEQ ID NO: 187795 - RNA, 1704 nt, Artificial Sequence
  derived and/or modified sequence opt5 from hemagglutinin__InfluenzaA__ADG21443
auggagaagaucgugcugcuccuggccauugucagcaucguuaaauccgaccagauuugcaucggcuaccacgcuaacaauucuaccgaacaaguggauacaauuauggagaagaacgugacggucacccaugcccaggacauccuugaaaagacacacaaugggaaacuguguaaccucgauggagugaaaccccugauccuuagagacugcagcguugcgggcuggcugcucgggaauccuaugugugaugaguuccugaacgugccggaaugguccuauauugucgagaagaucaaucccaccaacgaccugugcuacccuggaaauuuuaacgauuaugaggaacucaagcaucugcuuucucggauuaaucacuucgagaaaauccagauuauccccaagaacagcugguccgaccaugaggcuucuggcgugagcuccgccuguccuuaccaggggcgcagcuccuuuuucagaaauguuguguggcugaccaaaaagaacaaugccuaucccacaauuaaaaagucuuacaacaacacaaaucaagaagaucuccugguccuuuggggaauccaccacccuaacgacgcugccgagcagacccggcuguaucagaauccgacgaccuacaucagcgugggcacaucuacccucaaccagcgccuggugcccaagauugcuacaagauccaaagucaauggccaaagcgggcggauggaauuuuucuggaccauccugaagucuaacgaugccauuaauuuugaguccaacggaaauuucaucgcgccugaaaacgccuacaaaauuguuaagaaaggcgacagcacgaucaugaaguccgagcucgaauaugggaauugcaacacaaaaugucagacccccaucggagcuauuaauucuagcaugccuuuucauaacauccacccccugacaauuggcgagugcccgaaguacgugaaguccaaucgccuugugcuggccaccgggcucagaaacagcccucagggagagcggcgccggaaaaagagaggccuguucggcgcuaucgccggguuuauugaaggaggcuggcaggggauggucgauggaugguauggcuaccaucacucuaacgagcaaggguccggauaugcggccgacaaagaaagcacccagaaggcuaucgacggcgugacaaauaaaguuaacucuaucauugauaagaugaauacgcaguucgaggccgugggccgcgaauuuaacaaucuugagagacggaucgagaaccugaauaagaaaauggaagacggguuccucgaugucuggaccuacaacgcugagcugcuggugcucauggaaaaugagcgcacacuggacuuccacgauagcaacguuaagaaucuuuaugacaaagugagacugcaacuccgggauaacgccaaggaacugggaaauggcuguuuugaguucuaccauagaugcgacaacgaguguauggaauccguccgcaaugggaccuacgauuauccccaguacucugaggaagcccggcuuaaaagagaggagauuagcggagugaagcuggaauccaucggcacauaucagauucucagcaucuacucuaccgucgcuuccagccuggcgcuggccauuaugguggcugggcucuuucuguggaugugcucuaacggcucccuucagugccgcaucuguaucuga

SEQ ID NO: 187796 - RNA, 1704 nt, Artificial Sequence
  derived and/or modified sequence opt5 from hemagglutinin__InfluenzaA__ADG21445
auggagaagaucgugcugcuccuggccauugucagcaucguuaaauccgaccagauuugcaucggcuaccacgcuaacaauucuaccgaacaaguggauacaauuauggagaagaacgugacggucacccaugcccaggacauccuugaaaagacacacaaugggaagcuguguaaccucgauggagugaaaccccugauccuuagagacugcagcguugcgggcuggcugcucgggaauccuaugugugaugaguuccugaacgugccggaaugguccuauauugucgagaagaucaaucccucuaacgaccugugcuacccuggaaauuuuaacgauuaugaggaacucaagcaucugcuuagccggauuaaucacuucgagaaaauccagauuauccccaagaacuccuggucugaccaugaagcuagcggcguguccagcgccuguccuuaccaggggagaucuuccuuuuucagaaauguuguguggcugaccaaaaagaacaaugccuaucccacaauuaaaaagagcuacaacaacaccaaucaagaggaucuccugguccuuuggggaauccaccacccuaacgacgaggcugaacagacacggcuguaucagaauccgaccacguacaucucugugggcaccuccacacucaaccagcgccuggugcccaagauugccaccagaagcaaagucaauggccaaucugggcggauggaguuuuucuggacaauccugaaguccaacgaugcuauuaauuuugaaagcaacggaaauuucaucgccccugagaacgcguacaaaauuguuaagaaaggcgacuccaccaucaugaagucugaacucgaguaugggaauugcaacacgaaaugucagacacccaucggagccauuaauagcuccaugccuuuucauaacauccacccccugaccauuggcgagugcccgaaguacgugaaaagcaaucgccuugugcuggcuacagggcucagaaacucuccucagggagaacggcgccgcaaaaagcggggccuguucggcgccaucgcuggguuuauugagggaggcuggcaggggauggucgauggaugguauggcuaccaucacuccaacgaacaagggagcggauaugccgcggacaaagagucuacccagaaggccaucgacggcgugaccaauaaaguuaacagcaucauugauaagaugaauacacaguucgaagcugugggccgcgaguuuaacaaucuugagagacggaucgaaaaccugaauaagaaaauggaggacggguuccucgaugucuggacguacaacgccgaacugcuggugcucauggagaaugaacgcacccuggacuuccacgauuccaacguuaagaaucuuuaugacaaagugagacugcaacuccgggauaacgcuaaggagcugggaaauggcuguuuugaguucuaccauagaugcgacaacgaauguauggagucuguccgcaaugggacauacgauuauccccaguacagcgaagaggcccggcuuaaaagagaggaaauuuccggagugaagcuggagagcaucggcaccuaucagauucucucuaucuacuccacagucgccagcucucuggcucuggcgauuaugguggccgggcucuuucuguggaugugcuccaacggcagccuucagugccgcaucuguaucuga

SEQ ID NO: 187797 - RNA, 1701 nt, Artificial Sequence; identical to SEQ ID NO: 185935
  derived and/or modified sequence opt5 from hemagglutinin__InfluenzaA__ADG21912

SEQ ID NO: 187798 - RNA, 1701 nt, Artificial Sequence; identical to SEQ ID NO: 185693
  derived and/or modified sequence opt5 from hemagglutinin__InfluenzaA__ADG21913

SEQ ID NO: 187799 - RNA, 1701 nt, Artificial Sequence
  derived and/or modified sequence opt5 from hemagglutinin__InfluenzaA__ADG21914
augaaggccaucauugugguccugcucuacaccuucgcuacagccaacgcggacacgcugugcaucggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggaacauccagauauagcaagaaauuuaagccugagaucgcuauucggccgaaaguccgcgaucaggaggggagaaugaauuacuauuggacccucguugaacccggagacaagaucacguucgaggccacaggcaaccugguggugccucgguacgcguuugccauggaacgcaacgcugggucuggaauuaucaucuccgauacccccguccaugacugcaauacaaccugucaaaccccuaaaggcgccauuaacacaagccugcccuuccagaauauccacccgauuacgaucggcaagugcccuaaguaugugaaaucuaccaagcucagacuggcuacagggcuucggaacguucccagcauucagucccgcggacuguuuggcgccaucgccggguucaucgagggaggcuggaccgggaugguggacggaugguacggcuaucaucaccagaaugaacaaggcucuggguacgcugcggaucucaaaagcacacagaacgccauugacgagaucaccaauaaggucaacuccgugauugagaaaaugaauacgcaguuuacagcuguuggaaaggaguucaaccaccuggagaagagaaucgaaaaucuuaacaaaaagguggaugacggcuuccuggauauuuggaccuacaaugccgagcuccugguccugcucgaaaacgagcggacccuggacuaucaugauagcaaugugaaaaaccuuuacgagaagguccgcucucagcugaaaaacaaugccaaggaaaucgggaacggauguuuugaguucuaucacaagugcgacaauacauguauggaauccgugaaaaacggcaccuacgauuauccuaaguacagcgaggaagcuaaacucaauagagaggagaucgacgggguuaagcuggaaucuacacggauuuaucaaauccuugccauuuacuccacgguggcgagcucccugguccucgugguuucucugggcgcuaucagcuuuuggaugugcuccaacggaucucugcagugccgcauuuguaucuga

SEQ ID NO: 187800 - RNA, 1701 nt, Artificial Sequence
  derived and/or modified sequence opt5 from hemagglutinin__InfluenzaA__ADG21915
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaacauccucgaggauaaacacaaugggaagcuguguaaacuuagaggaguugcgccccugcaucucggcaagugcaacauugccggguggauccugggaaauccugaaugugagucucugagcacagcuuccucuuggagcuacauuguggaaaccuccucuagcgacaacggcacgugcuauccgggggauuuuaucgacuacgaggagcuccgggaacagcuguccagcgucucuuccuucgagcgcuuugaaaucuuccccaaaaccagcucuuggccuaaucacgauuccaacaagggagugacagccgcuuguccccaugccggcgccaagagcuuuuauaaaaaucuuauuuggcugguuaagaaaggcaacucuuacccuaagcucuccaaaagcuauaucaaugacaaggggaaggaggugcugguccuuuggggcauucaccaccccuccaccucugccgaucaacagagccuguaccagaacgcugacgccuacguguucgugggauccagcagauauucuaaaaaguuuaaaccugagaucgcuauucggccgaagguccgcgaucaggaagggagaaugaauuacuauuggacacucguugagcccggagacaaaaucaccuucgaagccacgggcaaccugguggugccucgguacgcguuugccauugagcgcaacgcuggguccggaaucaucauuagcgauacacccguccaugacugcaauaccacaugucaaaccccuaagggcgccaucaacaccucucugcccuuccacaauauucauccgaucacaauuggcaaaugcccuaaguauguuaagagcacgaaacucagacuggcuaccgggcuucggaacgugcccuccauccagucucgcggacuguuuggcgccaucgccggguucauugaaggaggcuggacagggaugguggacggaugguacggcuaucaccaccagaaugagcagggcagcggguacgcugcggaucucaaguccacccaaaacgccaucgacgagauuacaaauaaagucaacagcgugaucgaaaagaugaauacccaguuuacggcuguuggaaaagaguucaaccaucuggaaaagagaauugagaaucuuaacaagaaaguggaugacggcuuccuggauaucuggacauacaaugccgaacuccugguccugcucgagaacgagcggacccuggacuaucacgauucuaaugugaagaaccuuuacgaaaaaguccgcucccagcugaagaacaaugccaaagagaucgggaacggauguuuugaguucuaucauaagugcgacaauaccuguauggaaagcgugaagaacggcacauacgauuauccuaaauacucugaagaggcuaagcucaauagagaggaaauugacgggguuaaacuggaguccacccggaucuaucagauucuugccaucuacagcacaguggcguccucucugguccucgugguuagccugggcgcuauuuccuuuuggaugugcucuaacggaagccugcaaugccgcaucuguauuuga

SEQ ID NO: 187801 - RNA, 1701 nt, Artificial Sequence; identical to SEQ ID NO: 185935
  derived and/or modified sequence opt5 from hemagglutinin__InfluenzaA__ADG21916

SEQ ID NO: 187802 - RNA, 1701 nt, Artificial Sequence; identical to SEQ ID NO: 185693
  derived and/or modified sequence opt5 from hemagglutinin__InfluenzaA__ADG21917

SEQ ID NO: 187803 - RNA, 1701 nt, Artificial Sequence; identical to SEQ ID NO: 187193
  derived and/or modified sequence opt5 from hemagglutinin__InfluenzaA__ADG21918

SEQ ID NO: 187804 - RNA, 1701 nt, Artificial Sequence
  derived and/or modified sequence opt5 from hemagglutinin__InfluenzaA__ADG21919
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguuacaccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacgagauuacgaauaaggucaacuccgugaucgagaaaaugaauacacaguuuaccgccguuggaaaggaguucaaccaccuugagaagagaauugaaaaucugaacaaaaagaucgaugacggcuuccucgauauuuggaccuacaaugcugagcugcuggugcuccuggaaaacgagcggacacuugacuaucaugauagcaaugucaaaaaccuguacgagaaggugcgcucucagcucaaaaacaaugccaaggaaaucgggaacggauguuuugaguucuaucacaagugcgacaauaccuguauggaauccgucaaaaacggcacauacgauuauccuaaguacagcgaggaagccaaacugaauagagaggagaucgacggggugaaacuugaaucuacgcggauuuaucaaauccuggcuauuuacuccaccguugccagcucccucgugcuggucgugucucugggcgcgaucagcuuuuggaugugcuccaacggaucucuccagugccgcauuuguaucuga

SEQ ID NO: 187805 - RNA, 1701 nt, Artificial Sequence; identical to SEQ ID NO: 185935
  derived and/or modified sequence opt5 from hemagglutinin__InfluenzaA__ADG21921

SEQ ID NO: 187806 - RNA, 1701 nt, Artificial Sequence; identical to SEQ ID NO: 185693
  derived and/or modified sequence opt5 from hemagglutinin__InfluenzaA__ADG21922

SEQ ID NO: 187807 - RNA, 1701 nt, Artificial Sequence
  derived and/or modified sequence opt5 from hemagglutinin__InfluenzaA__ADG21923
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgccaaccuccuggaagauaagcacaaugggaaacuuuguaagcugagaggaguggcuccccuccaucugggcaaaugcaacaucgccggguggauucugggaaauccugagugugaaucucucagcacagccuccucuuggagcuacaucguugagaccuccucuagcgacaacggcacgugcuauccgggggauuuuauugacuacgaagaacugcgggagcagcuuuccagcgugucuuccuucgaacgcuuugagaucuuccccaagaccagcucuuggccuaaucacgauuccaacaagggagucacagcugccuguccccaugcgggcgccaagagcuuuuauaaaaaucugaucuggcucgugaaaaagggcaacucuuacccuaaacuguccaagagcuauauuaaugacaaggggaaagaaguucuugugcuguggggaauccaccaccccuccaccucugcugaucaacagagccucuaccagaacgccgacgcuuacgucuucgugggcuccagcaaguauucuaaaaaguuuaaaccugagauugccaucagaccgaaggugcgggaucaggaggggcgcaugaauuacuauuggacacuggucgaacccggagacaaaauuaccuucgaggcgacgggcaaccugguugugccuagauacgccuuugcuauggaacggaacgccggguccggaaucauuaucagcgauacacccgugcaugacugcaauaccacaugucaaaccccuaagggcgcuaucaacaccucucuccccuuccacaauauucauccgaucacaauuggcaagugcccuaaauaugucaagagcacgaaacugcgccuugccaccgggcugagaaacgugcccuccauccagucucggggacucuuuggcgccauugcuggguucaucgagggaggcuggacagggaugguugacggaugguacggcuaucaccaccagaaugaacagggcagcggguacgcggccgaucugaaguccacccaaaacgcuaucgacgagauuacaaauaaagugaacagcgucaucgagaagaugaauacccaguuuacggccgugggaaaggaguucaaccaucuugagaaacgcauugaaaaucugaacaagaaaguugaugacggcuuccucgauaucuggacauacaaugccgagcugcuggugcuccuggaaaacgagagaacccuugacuaucacgauucuaaugucaagaaccuguacgagaaagugcggucccagcucaagaacaaugcuaaggaaauugggaacggauguuuugaguucuaucauaaaugcgacaauaccuguauggaaagcgucaagaacggcacauacgauuauccuaaauacucugaggaagccaagcugaaucgcgaggagaucgacggggugaaacuugaauccaccagaaucuaucagauucuggcgaucuacagcacaguugcuuccucucucgugcuggucgugagccugggcgccauuuccuuuuggaugugcucuaacggaagccuccaaugccggaucuguauuuga

SEQ ID NO: 187808 - RNA, 1701 nt, Artificial Sequence
  derived and/or modified sequence opt5 from hemagglutinin__InfluenzaA__ADG21924
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggagaauaaacacaacgggaaacuuuguaagcugagaggaguugcgccccuccaucugggcaagugcaauaucgccggguggauucugggaaacccugaaugugagucucucagcacagcuuccucuuggagcuacaucguggaaaccuccucuagcgauaauggcacgugcuauccgggggacuuuauugauuacgaggagcugcgggaacagcuuuccagcgucucuuccuucgagcgcuuugaaaucuuccccaaaaccagcucuuggccuaaccacgacuccaauaagggagugacagccgcuuguccccaugccggcgccaagagcuuuuauaaaaaccugaucuggcucguuaagaaaggcaauucuuacccuaagcuguccaaaagcuauauuaacgauaaggggaaggaggugcuuguccuguggggaauccaccaccccuccaccucugccgaccaacagagccucuaccagaaugcugaugccuacguguucgugggcuccagcagauauucuaaaaaguuuaaaccugagauugcuauccggccgaagguccgcgaccaggaagggagaaugaacuacuauuggacacugguugagcccggagauaaaauuaccuucgaagccacgggcaaccugguggugccucgguacgcguuugccauggagcgcaaugcuggguccggaaucauuaucagcgacacacccguccaugauugcaacaccacaugucaaaccccuaagggcgccaucaauaccucucuccccuuccacaacauucauccgaucacaauuggcaaaugcccuaaguauguuaagagcacgaaacugagacuugcuaccgggcugcggaaugugcccuccauccagucucgcggacucuuuggcgccauugccggguucaucgaaggaggcuggacagggaugguggacggaugguacggcuaucaccaccagaacgagcagggcagcggguacgcugcggaccugaaguccacccaaaaugccaucgaugagauuacaaacaaagucaauagcgugaucgaaaagaugaacacccaguuuacggcuguuggaaaagaguucaaucaucuugaaaagagaauugagaaccugaauaagaaaguggacgauggcuuccucgacaucuggacauacaacgccgaacugcugguccuccuggagaaugagcggacccuugauuaucacgacucuaacgugaagaaccuguacgaaaaaguccgcucccagcucaagaauaacgccaaagagauugggaauggauguuuugaguucuaucauaagugcgauaacaccuguauggaaagcgugaagaauggcacauacgacuauccuaaauacucugaagaggcuaagcugaacagagaggaaaucgaugggguuaaacuugaguccacccggaucuaucagauucuggccaucuacagcacaguggcguccucucucguccuggugguuagccugggcgcuauuuccuuuuggaugugcucuaauggaagccuccaaugccgcaucuguauuuga

SEQ ID NO: 187809 - RNA, 1701 nt, Artificial Sequence
  derived and/or modified sequence opt5 from hemagglutinin__InfluenzaA__ADG21925
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcgaugcugggucuggaaucauuaucuccgacacccccguccaugacugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggauggaugguacggcuaucaucaccagaacgaacaaggcucuggguacgcugcggaccugaaaagcacacagaaugccaucgaugagauuaccaacaaggucaauuccgugaucgagaaaaugaacacgcaguuuacagcuguuggaaaggaguucaaucaccuugagaagagaauugaaaaccugaauaaaaagaucgacgauggcuuccucgacauuuggaccuacaacgccgagcugcuggugcuccuggaaaaugagcggacccuugauuaucaugacagcaacgucaaaaaucuguacgagaaggugcgcucucagcucaaaaacaacgccaaggaaaucgggaauggauguuuugaguucuaucacaagugcgauaacacauguauggaauccgucaaaaauggcaccuacgacuauccuaaguacagcgaggaagcuaaacugaacagagaggagaucgauggggugaaacuugaaucuacacggauuuaucaaauccuggccauuuacuccacgguugcgagcucccucgugcuggucgugucucugggcgcuaucagcuuuuggaugugcuccaauggaucucuccagugccgcauuuguaucuga

SEQ ID NO: 187810 - RNA, 1701 nt, Artificial Sequence
  derived and/or modified sequence opt5 from hemagglutinin__InfluenzaA__ADG21926
augaaggccauccuggugguccuccuguacaccuucgcuacagccaacgcggacacgcuuugcauuggcuaucacgcuaauaacagcaccgauacaguugacaccauccuggagaagaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccaagagcuauaucaaugacaaggggaaagaaguucuugugcuguggggcauucaccaccccuccaccucugccgaucaacagagccucuaccagaacgcugacgccuacgucuucgugggaacauccagauauagcaagaaauuuaagccugagaucgcuauucggccgaaagugcgcgaucaggaggggagaaugaauuacuauuggacccuggucgaacccggagacaagaucacguucgaggccacaggcaaccugguugugccucgguacgcguuugccauggaacgcaacgcugggucuggaauuaucaucuccgauacccccgugcaugacugcaauacaaccugucaaaccccuaaaggcgccauuaacacaagccuccccuuccagaauauccacccgauuacgaucggcaagugcccuaaguaugucaaaucuaccaagcugagacuugcuacagggcugcggaacgugcccagcauucagucccgcggacucuuuggcgccaucgccggguucaucgagggaggcuggaccgggaugguugacggaugguacggcuaucaucaccagaaugaacaaggcucuggguacgcugcggaucugaaaagcacacagaacgccauugacgagaucaccaauaaggugaacuccgucauugagaaaaugaauacgcaguuuacagcugugggaaaggaguucaaccaccuugagaagagaaucgaaaaucugaacaaaaagguugaugacggcuuccucgauauuuggaccuacaaugccgagcugcuggugcuccuggaaaacgagcggaaucuugacuaucaugauagcaacgucaaaaaccuguacgagaaggugcgcucucagcucaaaaauaacgccaaggaaaucgggaauggauguuuugaguucuaucacaagugcgacaacaccuguauggaauccgucaaaaauggcacauacgauuauccuaaguacagcgaggaagcuaaacugaacagagaggagaucgacggggugaaacuugaaucuacccggauuuaucaaauccuggccauuuacuccacaguugcgagcucccucgugcuggucgugucucugggcgcuaucagcuuuuggaugugcuccaauggaucucuccagugccgcauuuguaucuga

SEQ ID NO: 187811 - RNA, 1701 nt, Artificial Sequence; identical to SEQ ID NO: 185935
  derived and/or modified sequence opt5 from hemagglutinin__InfluenzaA__ADG21927

SEQ ID NO: 187812 - RNA, 1701 nt, Artificial Sequence
  derived and/or modified sequence opt5 from hemagglutinin__InfluenzaA__ADG21928
augaaggccacccuggugguccuccuguacacauucgcuacggccaacgcggacacccuuugcaucggcuaucacgcuaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacguccucuagcgacaacggaaccugcuauccgggggauuuuaucgacuacgaagaacugcgggagcagcuuuccagcgucucuuccuucgaacgcuuugagauuuuccccaagacaagcucuuggccuaaucacgauuccaacaagggagugaccgccgcuuguccccaugccggcgcgaaaucuuuuuauaagaaucugaucuggcucguuaaaaagggcaacagcuacccuaaacuguccaagagcuauaucaaugacaaggggaaagaagugcuuguccuguggggcauucaccaccccuccacaucugccgaucaacagagccucuaccagaacgcugacgccuacguguucgugggcaccuccagauauagcaagaaauuuaagccugagaucgcuauucggccgcgcgucagagaucaggaggggcggaugaauuacuauuggacgcugguugaacccggagacaaaaucacauucgaggccaccggcaaccugguggugccucgcuacgcguuugccauggaaagagaugcugggucuggaauuaucauuuccgacacacccguccaugacugcaacaccaccugucaaacaccuaagggcgccaucaauacgagccuccccuuccagaacauccacccgauuaccaucggcaaaugcccuaaguaugugaagucuacaaaacugcggcuugcuaccgggcugcgcaauguucccagcauucaguccagaggacucuuuggcgccaucgccggguucauugagggaggcuggacagggaugguggauggaugguacggcuaucaucaccagaacgaacaaggcucuggguacgcugcggaccuuaagagcacccagaaugccaucgaugagaucacgaacaaagucaauuccgugauugagaagaugaacacacaguuuaccgcuguuggaaaagaguucaaucaccuggagaagcggaucgaaaaccugaauaagaaaauugacgauggcuuccucgacaucuggaccuacaacgccgagcugcuggugcuccuggaaaaugagcgcacacuugauuaucaugacagcaacgucaagaaucuguacgagaaagugagaucucagcucaagaacaacgccaaagaaauugggaauggauguuuugaguucuaucacaagugcgauaacaccuguauggaauccgucaagaauggcacauacgacuauccuaaauacagcgaggaagcuaagcugaaccgggaggagaucgauggggugaaacuugaaucuacgcgcaucuaucaaauucuggccaucuacuccaccguugcgagcucccucgugcuggucgugucucugggcgcuauuagcuuuuggaugugcuccaauggaucucuccagugcagaaucuguauuuga

SEQ ID NO: 187813 - RNA, 1701 nt, Artificial Sequence; identical to SEQ ID NO: 187809
  derived and/or modified sequence opt5 from hemagglutinin__InfluenzaA__ADG21930

SEQ ID NO: 187814 - RNA, 1701 nt, Artificial Sequence; identical to SEQ ID NO: 185935
  derived and/or modified sequence opt5 from hemagglutinin__InfluenzaA__ADG21931

SEQ ID NO: 187815 - RNA, 1701 nt, Artificial Sequence; identical to SEQ ID NO: 185935
  derived and/or modified sequence opt5 from hemagglutinin__InfluenzaA__ADG21932

SEQ ID NO: 187816 - RNA, 1701 nt, Artificial Sequence; identical to SEQ ID NO: 185935
  derived and/or modified sequence opt5 from hemagglutinin__InfluenzaA__ADG21933

SEQ ID NO: 187817 - RNA, 1701 nt, Artificial Sequence; identical to SEQ ID NO: 187809
  derived and/or modified sequence opt5 from hemagglutinin__InfluenzaA__ADG21934

SEQ ID NO: 187818 - RNA, 1701 nt, Artificial Sequence
  derived and/or modified sequence opt5 from hemagglutinin__InfluenzaA__ADG21935
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaaacugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagagccucuaccagaacgcugacgccuacguguucgugggcuccagcagauauucuaaaaaguuuaaaccugagauugcuauccggccgaagguccgcgaucaggaagggagaaugaauuacuauuggacacugguugagcccggagacaaaauuaccuucgaagccacgggcaaccugguggugccucgguacgcguuugccauggagcgcaacgcuggguccggaaucauuaucagcgauacacccguccaugacugcaauaccaacugucaaacaccuaauggcgccaucaacaccucucuccccuuccacaauauucauccgaucaccauuggcaagugcccuaaauauguuaagagcacaaagcugagacuugcuacggggcugcggaacgugcccuccauccagucucgcggacucuuuggcgccauugccggguucaucgaaggaggcuggaccgggaugguggacggaugguacggcuaucaccaccagaaugagcagggcagcggguacgcugcggaucugaaauccacacaaaacgccaucgacgagauuaccaauaaggucaacagcgugaucgaaaagaugaauacacaguuuaccgcuguuggaaaggaguucaaccaucuugaaaagagaauugagaaucugaacaagaagguggaugacggcuuccucgauaucuggacguacaaugccgaacugcugguccuccuggagaacgagcggacacuugacuaucacgauucuaacgugaaaaaucuguacgaaaagguccgcucccagcucaaaaacaaugccaaggagauugggaacggauguuuugaguucuaucauaaaugcgacaauaccuguauggaaagcgugaagaacggcaccuacgauuauccuaaguacucugaagaggcuaaacugaauagagaggaaaucgacgggguuaaacuugaguccacacggaucuaucagauucuggccaucuacagcaccguggcguccucucucguccuggugguuagccugggcgcuauuuccuuuuggaugugcucuaacggaagccuccaaugccgcaucuguauuuga

SEQ ID NO: 187819 - RNA, 1701 nt, Artificial Sequence; identical to SEQ ID NO: 185935
  derived and/or modified sequence opt5 from hemagglutinin__InfluenzaA__ADG21936

SEQ ID NO: 187820 - RNA, 1701 nt, Artificial Sequence; identical to SEQ ID NO: 185935
  derived and/or modified sequence opt5 from hemagglutinin__InfluenzaA__ADG21937

SEQ ID NO: 187821 - RNA, 1701 nt, Artificial Sequence
  derived and/or modified sequence opt5 from hemagglutinin__InfluenzaA__ADG21938
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagagccucuaccagaacgcugacgccuacguguucgugggcuccagcagauauucuaaaaaguuuaaaccugagauugcuauccggccgaagguccgcgaucaggaagggagaaugaauuacuauuggacacugguugagcccggagacaaaauuaccuucgaagccacgggcaaccugguggugccucgguacgcguuugccauggagcgcaacgcuggguccggaaucauuaucagcgauacacccguccaugacugcaauaccacaugucaaaccccuaagggcgccaucaacaccucucuccccuuccacaauauucauccgaucacaauuggcaaaugcccuaaguauguuaagagcacgaaacugagacuugcuaccgggcugcggaacgugcccuccauccagucucgcggacucuuuggcgccauugccggguucaucgaaggaggcuggacagggaugguggacggaugguacggcuaucaccaccagaaugagcagggcagcggguacgcugcggaucugaaguccacccaaaacgccaucgacgagauuacaaauaaagucaacagcgugaucgaaaagaugaauacccaguuuacggcuguuggaaaagaguucaaccaucuugaaaagagaauugagaaucugaacaagaaaguggaugacggcuuccucgauaucuggacauacaaugccgaacugcugguccuccuggagaacgagcggaaucuugacuaucacgauucuaacgugaagaaccuguacgaaaaaguccgcucccagcucaagaauaacgccaaagagauugggaauggauguuuugaguucuaucauaagugcgacaacaccuguauggaaagcgugaagaauggcaccuacgauuauccuaaauacucugaagaggcuaagcugaacagagaggaaaucgacgggguuaaacuugaguccacacggaucuaucagauucuggccaucuacagcaccguggcguccucucucguccuggugguuagccugggcgcuauuuccuuuuggaugugcucuaauggaagccuccaaugccgcaucuguauuuga

SEQ ID NO: 187822 - RNA, 1701 nt, Artificial Sequence; identical to SEQ ID NO: 185935
  derived and/or modified sequence opt5 from hemagglutinin__InfluenzaA__ADG21939

SEQ ID NO: 187823 - RNA, 1701 nt, Artificial Sequence; identical to SEQ ID NO: 185935
  derived and/or modified sequence opt5 from hemagglutinin__InfluenzaA__ADG21940

SEQ ID NO: 187824 - RNA, 1701 nt, Artificial Sequence
  derived and/or modified sequence opt5 from hemagglutinin__InfluenzaA__ADG21941
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagagccucuaccagaacgcugacgccuacguguucgugggcuccagcagauauucuaaaaaguuuaaaccugagauugcuauccggccgaagguccgcgaucaggaagggagaaugaauuacuauuggacacugguugagcccggagacaaaauuaccuucgaagccacgggcaaccugguggugccucgguacgcguuugccauggagcgcaacgcuggguccggaaucauuaucagcgauacacccguccaugacugcaauaccacaugucaaaccccuaagggcgccaucaacaccucucuccccuuccacaauauucauccgaucacaauuggcaaaugcccuaaguauguuaagagcacgaaacugagacuugcuaccgggcugcggaacgugcccuccauccagucucgcggacucuuuggcgccauugccggguucaucgaaggaggcuggacagggaugguggacggaugguacggcuaucaccaccagaaugagcagggcagcggguacgcugcggaucugaaguccacccaaaacgccaucgacgagauuacaaauaaagucaacagcgugaucgaaaagaugaauacccaguuuacggcuguuggaaaagaguucaaccaucuugaaaagagaauugagaaucugaacaagaaaaucgaugacggcuuccucgauauuuggacauacaaugccgaacugcuggugcuccuggagaacgagcggacccuugacuaucacgauucuaaugucaagaaccuguacgaaaaagugcgcucccagcucaagaacaaugccaaagagaucgggaacggauguuuugaguucuaucauaagugcgacaauaccuguauggaaagcgucaagaacggcacauacgauuauccuaaauacucugaagaggcuaagcugaauagagaggaaaucgacggggugaaacuugaguccacccggauuuaucagauccuggccauuuacagcacaguugcguccucucucgugcuggucgugagccugggcgcuaucuccuuuuggaugugcucuaacggaagccuccaaugccgcauuuguaucuga

SEQ ID NO: 187825 - RNA, 1701 nt, Artificial Sequence
  derived and/or modified sequence opt5 from hemagglutinin__InfluenzaA__ADG21943
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccaacuccuggucuuacaucguggagaccagcuccucugacaauggcacgugcuauccgggggauuuuauugacuacgaagaacugcgggagcagcuuagcuccgucagcucuuucgaacgcuuugagaucuuccccaagaccuccagcuggccuaaccacgauucuaauaagggagugacagccgcuuguccccaugccggcgcgaaauccuuuuauaagaaccugaucuggcucguuaaaaagggcaauagcuacccuaaacugucuaaguccuauauuaacgacaaggggaaagaagugcuuguccuguggggaauccaccaccccagcaccuccgccgaucaacagucucucuaccagaaugcugacgccuacguguucgugggcacaagcagauauuccaagaaauuuaagccugagauugcuauccggccgaaaguccgcgaucaggaggggagaaugaacuacuauuggacccugguugaacccggagacaagauuacguucgaggccacaggcaaccugguggugccucgguacgcguuugccauggaacgcgaugcugggagcggaaucauuaucucugacacccccguccaugacugcaauacaaccugucaaaccccuaaaggcgccaucaacacaucccuccccuuccagaauauucacccgaucacgauuggcaagugcccuaaguaugugaaaagcaccaagcugagacuugcuacagggcugcggaacguucccucuauccagagccgcggacucuuuggcgccauugccggguucaucgagggaggcuggaccgggaugguggauggaugguacggcuaucaucaccagaaugaacaaggcuccggguacgcugcggaccugaaaucuacacagaacgccaucgaugagauuaccaauaaggucaacagcgugaucgagaaaaugaauacgcaguuuacagcuguuggaaaggaguucaaccaccuugagaagagaauugaaaaucugaacaaaaagaucgacgauggcuuccucgacauuuggaccuacaaugccgagcugcuggugcuccuggaaaacgagcggacccuugauuaucaugacuccaaugucaaaaaccuguacgagaaggugcgcagccagcucaaaaacaaugccaaggaaaucgggaacggauguuuugaguucuaucacaagugcgauaauacauguauggaaucugucaaaaacggcaccuacgacuauccuaaguacuccgaggaagcuaaacugaauagagaggagaucgauggggugaaacuugaaagcacacggauuuaucaaauccuggccauuuacucuacgguugcguccagccucgugcuggucgugucccugggcgcuaucucuuuuuggaugugcagcaacggaucccuccagugccgcauuuguaucuga

SEQ ID NO: 187826 - RNA, 1701 nt, Artificial Sequence
  derived and/or modified sequence opt5 from hemagglutinin__InfluenzaA__ADG21944
auggaggccauccugauugugcuccuguacaccuucgcuacagccaacgcggacacgcuuugcaucggcuaucacgcuaauaacagcaccgauacagucgacaccguucuggaaaagaaugugacagugacccauuccgucaaccuccuggaggauaaacacaaugggaaacuuuguaagcugagaggaguggcgccccuccaucugggcaagugcaacauugccggguggauccugggaaauccugaaugugagucucucagcacagcuuccucuuggagcuacauuguugaaaccuccucuagcgacaacggcacgugcuauccgggggauuuuaucgacuacgaggagcugcgggaacagcuuuccagcgugucuuccuucgagcgcuuugaaaucuuccccaaaaccagcucuuggccuaaucacgauuccaacaagggagucacagccgcuuguccccaugccggcgccaagagcuuuuauaaaaaucugauuuggcucgugaagaaaggcaacucuuacccuaagcuguccaaaagcuauaucaaugacaaggggaaggagguucuugugcuguggggcauucaccaccccuccaccucugccgaucaacagagccucuaccagaacgcugacgccuacgucuucgugggauccagcagauauucuaaaaaguuuaaaccugagaucgcuauucggccgaaggugcgcgaucaggaagggagaaugaauuacuauuggacacuggucgagcccggagacaaaaucaccuucgaagccacgggcaaccugguugugccucgguacgcguuugccauggagcgcaacgcuggguccggaauuaucaucagcgauacacccgugcaugacugcaauaccacaugucaaaccccuaagggcgccauuaacaccucucuccccuuccacaauauccauccgauuacaaucggcaaaugcccuaaguaugucaagagcacgaaacugagacuugcuaccgggcugcggaacgugcccuccauucagucucgcggacucuuuggcgccaucgccggguucaucgaaggaggcuggacagggaugguugacggaugguacggcuaucaccaccagaaugagcagggcagcggguacgcugcggaucugaaguccacccaaaacgccauugacgagaucacaaauaaagugaacagcgucauugaaaagaugaauacccaguuuacggcugugggaaaagaguucaaccaucuugaaaagagaaucgagaaucugaacaagaaaguugaugacggcuuccucgauauuuggacauacaaugccgaacugcuggugcuccuggagaacgagcggacccuugacuaucacgauucuaaugucaagaaccuguacgaaaaagugcgcucccagcucaagaacaaugccaaagagaucgggaacggauguuuugaguucuaucauaagugcgacaauaccuguauggaaagcgucaagaacggcacauacgauuauccuaaauacucugaagaggcuaagcugaauagagaggaaaucgacggggugaaacuugaguccacccggauuuaucagauccuggccauuuacagcacaguugcguccucucucgugcuggucgugagccugggcgcuaucuccuuuuggaugugcucuaacggaagccuccaaugccgcauuuguaucuga

SEQ ID NO: 187827 - RNA, 1701 nt, Artificial Sequence; identical to SEQ ID NO: 185935
  derived and/or modified sequence opt5 from hemagglutinin__InfluenzaA__ADG21945

SEQ ID NO: 187828 - RNA, 1701 nt, Artificial Sequence; identical to SEQ ID NO: 185935
  derived and/or modified sequence opt5 from hemagglutinin__InfluenzaA__ADG21946

SEQ ID NO: 187829 - RNA, 1701 nt, Artificial Sequence; identical to SEQ ID NO: 185935
  derived and/or modified sequence opt5 from hemagglutinin__InfluenzaA__ADG21947

SEQ ID NO: 187830 - RNA, 1701 nt, Artificial Sequence
  derived and/or modified sequence opt5 from hemagglutinin__InfluenzaA__ADG21948
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagagccucuaccagaacgcugacgccuacguguucgugggcuccagcagauauucuaaaaaguuuaaaccugagauugcuauccggccgaagguccgcgaucaggaagggagaaugaauuacuauuggacacugguugagcccggagacaaaauuaccuucgaagccacgggcaaccugguggugccucgguacgcguuugccauggagcgcaacgcuggguccggaaucauuaucagcgauacacccguccaugacugcaauaccacaugucaaaccccuaagggcgccaucaacaccucucuccccuuccacaauauucauccgaucacaauuggcaaaugcccuaaguauguuaagagcacgaaacugagacuugcuaccgggcugcggaacgugcccuccauccagucucgcggacucuuuggcgccauugccggguucaucgaaggaggcuggacagggaugguggacggaugguacggcuaucaccaccagaaugagcagggcagcggguacgcugcggaucugaaguccacccaaaacgccaucgacgagauuacaaauaaagucaacagcgugaucgaaaagaugaauacccaguuuacggcuguuggaaaagaguucaaccaucuugaaaagagaauugagaaucugaacaagaaaguggaugacggcuuccucgauaucuggacauacaaugccgaacugcugguccuccuggagaacgagcggacccuugaccaccaugauucuaaugugaagaaccuguaugaaaaaguccgcucccagcucaagaacaaugccaaagagauugggaacggauguuuugaguucuaccacaagugcgacaauaccuguauggaaagcgugaagaacggcacauaugauuacccuaaauauucugaagaggcuaagcugaauagagaggaaaucgacgggguuaaacuugaguccacccggaucuaccagauucuggccaucuauagcacaguggcguccucucucguccuggugguuagccugggcgcuauuuccuuuuggaugugcucuaacggaagccuccaaugccgcaucuguauuuga

SEQ ID NO: 187831 - RNA, 1701 nt, Artificial Sequence
  derived and/or modified sequence opt5 from hemagglutinin__InfluenzaA__ADG27794
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggacguaucaaauccuggccauuuacuccaccguggcgagcucccucguccuggugguuucucugggcgcuaucagcuuuuggaugugcuccaacggaucucuccagugccgcauuuguaucuga

SEQ ID NO: 187832 - RNA, 1701 nt, Artificial Sequence; identical to SEQ ID NO: 185680
  derived and/or modified sequence opt5 from hemagglutinin__InfluenzaA__ADG27948

SEQ ID NO: 187833 - RNA, 1701 nt, Artificial Sequence; identical to SEQ ID NO: 185680
  derived and/or modified sequence opt5 from hemagglutinin__InfluenzaA__ADG27966

SEQ ID NO: 187834 - RNA, 1701 nt, Artificial Sequence
  derived and/or modified sequence opt5 from hemagglutinin__InfluenzaA__ADG27974
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucuccccuuccagaauauucacccgaucacaauuggcaagugcccuaaguaugugaaaagcacgaagcugagacuugcuaccgggcugcggaacguucccuccauccagucucgcggacucuuuggcgccauugccggguucaucgagggaggcuggacagggaugguggacggaugguacggcuaucaucaccagaaugaacaaggcagcggguacgcugcggaucugaaauccacccagaacgccaucgacgagauuacaaauaaggucaacagcgugaucgagaaaaugaauacccaguuuacggcuguuggaaaggaguucaaccaccuugagaagagaauugaaaaucugaacaaaaagguggaugacggcuuccucgauaucuggacauacaaugccgagcugcugguccuccuggaaaacgagcggacccuugacuaucaugauucuaaugugaaaaaccuguacgagaagguccgcucccagcucaaaaacaaugccaaggaaauugggaacggauguuuugaguucuaucacaagugcgacaauaccuguauggaaagcgugaaaaacggcacauacgauuauccuaaguacucugaggaagcuaaacugaauagagaggagaucgacgggguuaaacuugaauccacccggaucuaucaaauucuggccaucuacagcacaguggcguccucucucauucuggucgugagccugggcgcuaucuccuuuuggaugugcucuaacggaagccuccagugccgcauuuguaucuga

SEQ ID NO: 187835 - RNA, 1701 nt, Artificial Sequence
  derived and/or modified sequence opt5 from hemagglutinin__InfluenzaA__ADG27982
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucuccccuuccagaauauucacccgaucacaauuggcaagugcccuaaguaugugaaaagcacgaagcugagacuugcuaccgggcugcggaacguucccuccauccagucucgcggacucuuuggcgccauugccggguucaucgagggaggcuggacagggaugguggacggaugguacggcuaucaucaccagaaugaacaaggcagcggguacgcugcggaucugaaauccacccagaacgccaucgacgagauuacaaauaaggucaacagcgugaucgagaaaaugaauacccaguuuacggcuguuggaaaggaguucaaccaccuugagaagagaauugaaaaucugaacaaaaagguggaugacggcuuccucgauaucuggacauacaaugccgagcugcugguccuccuggaaaacgagcggacccuugacuaucaugauucuaaugugaaaaagcuguacgagaaaguccgcucccagcucaagaacaacgccaaggaaauugggaauggauguuuugaguucuaucacaaaugcgacaacaccuguauggaaagcgugaagaauggcacauacgauuauccuaaauacucugaggaagcuaagcugaacagagaggagaucgacgggguuaaacuugaauccacccggaucuaucaaauucuggccaucuacagcacaguggcguccucucucguccuggugguuagccugggcgcuauuuccuuuuggaugugcucuaauggaagccuccagugccgcaucuguauuuga

SEQ ID NO: 187836 - RNA, 1701 nt, Artificial Sequence; identical to SEQ ID NO: 185680
  derived and/or modified sequence opt5 from hemagglutinin__InfluenzaA__ADG27988

SEQ ID NO: 187837 - RNA, 1701 nt, Artificial Sequence; identical to SEQ ID NO: 185680
  derived and/or modified sequence opt5 from hemagglutinin__InfluenzaA__ADG27997

SEQ ID NO: 187838 - RNA, 1701 nt, Artificial Sequence; identical to SEQ ID NO: 185680
  derived and/or modified sequence opt5 from hemagglutinin__InfluenzaA__ADG28011

SEQ ID NO: 187839 - RNA, 1701 nt, Artificial Sequence; identical to SEQ ID NO: 187245
  derived and/or modified sequence opt5 from hemagglutinin__InfluenzaA__ADG42093

SEQ ID NO: 187840 - RNA, 1701 nt, Artificial Sequence; identical to SEQ ID NO: 186857
  derived and/or modified sequence opt5 from hemagglutinin__InfluenzaA__ADG42103

SEQ ID NO: 187841 - RNA, 1701 nt, Artificial Sequence; identical to SEQ ID NO: 186046
  derived and/or modified sequence opt5 from hemagglutinin__InfluenzaA__ADG42113

SEQ ID NO: 187842 - RNA, 1701 nt, Artificial Sequence; identical to SEQ ID NO: 187245
  derived and/or modified sequence opt5 from hemagglutinin__InfluenzaA__ADG42123

SEQ ID NO: 187843 - RNA, 1701 nt, Artificial Sequence
  derived and/or modified sequence opt5 from hemagglutinin__InfluenzaA__ADG42133
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuugucccuaugccggcgcgaaauccuuuuacaagaaucugaucuggcucguuaaaaagggcaacucuuauccuaaacuguccaagagcuacauuaaugacaaggggaaagaagugcuuguccuguggggaauccaucaccccuccaccucugccgaucaacagagccucuaccagaacgcugacgccuauguguucgugggcacauccagauacagcaagaaauuuaagccugagauugcuauccggccgaaaguccgcgaucaggaggggagaaugaauuauuacuggacccugguugaacccggagacaagauuacguucgaggccacaggcaaccugguggugccucgguaugcguuugccauggaacgcaacgcugggucuggaaucauuaucuccgauacccccguccacgacugcaauacaaccugucaaaccccuaaaggcgccaucaacacaagccuccccuuccagaauauucauccgaucacgauuggcaagugcccuaaguacgugaaaucuaccaagcugagacuuguuacagggcugcggaacgugcccagcauccagucccgcggacucuuuggcgcuauugccggguucaucgagggaggcuggaccgggauggucgacggaugguauggcuaccaccaucagaaugaacaaggcucuggguacgccgcugaucugaaaagcacacagcacgcgaucgacgagauuaccaacaaggugaauagcguuaucgagaaaaugaacacgcaguuuacagccgugggaaaggaguucaaucaccuugagaagagaauugaaaaccugaauaaaaaggucgaugacggcuuccucgauaucuggaccuauaacgcugagcugcuggugcuccuggaaaaugagcggacccuugacuaccaugauagcaacgucaaaaaucuguaugagaaggugcgcucucagcucaaaaacaacgccaaggaaauugggaauggauguuuugaguucuaccacaagugcgacaacacauguauggaauccguuaaaaauggcaccuaugauuacccuaaguauagcgaggaagccaaacugaacagagaggagaucgacggggugaaacuugaaucuacacggaucuaccaaauucuggcuaucuacuccacggucgccagcucccucgugcugguugugucucugggcgcgauuagcuuuuggaugugcuccaauggaucucuccagugccgcaucuguauuuga

SEQ ID NO: 187844 - RNA, 1701 nt, Artificial Sequence
  derived and/or modified sequence opt5 from hemagglutinin__InfluenzaA__ADG42143
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaaaugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggauccagcagauauucuaagaaauuuaagccugagaucgcuauucggccgaaaguccgcgaucaggaggggagaaugaauuacuauuggacacucguugaacccggagacaagaucaccuucgaggccacgggcaaccugguggugccucgguacgcguuugccauggaaaagaacgcuggguccggaauuaucaucagcgauacacccguccaugacugcaauaccacaugucaaaccccuaagggcgccauuaacaccucucugcccuuccagaauauccacccgauuacaaucggcaagugcccuaaauauguuaagagcacgaaacuccgccuggcuaccgggcuuagaaacgugcccuccauucagucucggggacuguuuggcgccaucgccggguucaucgagggaggcuggacagggaugguggacggaugguacggcuaucaucaccagaaugaacaaggcagcggguacgcugcggaucucaaguccacccagaacgccauugacgagaucacaaauaaagucaacagcgugauugagaagaugaauacccaguuuacggcuguuggaaaggaguucaaccaccuggagaaacgcaucgaaaaucuuaacaagaaaguggaugacggcuuccuggauauuuggacauacaaugccgagcuccugguccugcucgaaaacgagagaacccuggacuaucaugauucuaaugugaagaaccuuuacgagaaaguccggucccagcugaagaacaaugccaaggaaguggggaacggauguuuugaguucuaucacaaaugcgacaauaccuguauggaaagcguuaagaacggcacauacgauuauccuaaauacucugaggaagcuaagcucaaucgcgaggagaucgacggggugaaacuggaauccaccagaaucuaucaaauucuugccaucuacagcacagcggcuuccucucugguccucgugguuagccugggcgccauuuccuuuuggaugugcucuaacggaagccugcagugccggaucuguauuuga

SEQ ID NO: 187845 - RNA, 1701 nt, Artificial Sequence
  derived and/or modified sequence opt5 from hemagglutinin__InfluenzaA__ADG42153
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggaaucacagccgcuuguccccaugccggcgcgaaaucuuuuuauaagaaucugauuuggcucgugaaaaagggcaacagcuacccuaaacuguccaagagcuauaucaaugacaaggggaaagaaguucuugugcuguggggcauucaccaccccuccaccucugccgaucaacagagccucuaccagaacgcugacgccuacgucuucgugggaacauccagauauagcaagaaauuuaagccugagaucgcuauucggccgaaagugcgcgaucaggaggggagaaugaauuacuauuggacccuggucgaacccggagacaagaucacguucgaggccacaggcaaccugguugugccucgguacgcguuugccauggaacgcaacgcugggucuggaauuaucaucuccgauacccccgugcucgacugcaauacaaccugucaaaccccuaaaggcgccauuaacacaagccugcccuuccagaauauccauccgauuacgaucggcaagugcccuaaguaugucaaaucuaccaaacuuagacuggcuacagggcuccggaacgugcccagcauucagucccgcggacuguuuggcgccaucgccggguucaucgagggaggcuggaccgggaugguugacggaugguacggcuaucaccaucagaaugaacaaggcucuggguacgcugcggaucuuaagagcacacagaacgccauugacgagaucaccaauaaggugaacuccgucauugagaaaaugaauacgcaguuuacagcugugggaaaggaguucaaccaccuggagaagagaaucgaaaaucucaacaaaaagguugaugacggcuuccuggauauuuggaccuacaaugccgagcugcucgugcugcuugaaaacgagcggacccuggacuaucacgauagcaaugucaaaaaccucuacgagaaggugcgcucucagcugaaaaacaaugccaaggaaaucgggaacggauguuuugaguucuaucauaagugcgacaauacauguauggaauccgucaaaaacggcaccuacgauuauccuaaguacagcgaggaagcuaaacuuaauagagaggagaucgacggggugaagcuggaaucuacacggauuuaucaaauccucgccauuuacuccacgguugcgagcucccuggugcuggucgugucucucggcgcuaucagcuuuuggaugugcuccaacggaucucugcagugccgcauuuguaucuga

SEQ ID NO: 187846 - RNA, 1701 nt, Artificial Sequence; identical to SEQ ID NO: 185693
  derived and/or modified sequence opt5 from hemagglutinin__InfluenzaA__ADG42193

SEQ ID NO: 187847 - RNA, 1701 nt, Artificial Sequence; identical to SEQ ID NO: 185693
  derived and/or modified sequence opt5 from hemagglutinin__InfluenzaA__ADG42213

SEQ ID NO: 187848 - RNA, 1701 nt, Artificial Sequence; identical to SEQ ID NO: 185693
  derived and/or modified sequence opt5 from hemagglutinin__InfluenzaA__ADG42233

SEQ ID NO: 187849 - RNA, 1701 nt, Artificial Sequence
  derived and/or modified sequence opt5 from hemagglutinin__InfluenzaA__ADG42243
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccucgacugcaauacaaccugucaaaccccuaaaggcgccaucaacacaagccugcccuuccagaauauucauccgaucacgauuggcaagugcccuaaguaugugaaaucuaccaaacuuagacuggcuacagggcuccggaacguucccagcauccagucccgcggacuguuuggcgccauugccggguucaucgagggaggcuggaccgggaugguggacggaugguacggcuaucaccaucagaaugaacaaggcucuggguacgcugcggaucuuaagagcacacagcacgccaucgacgagauuaccaacaaggucaauuccgugaucgagaaaaugaacacgcaguuuacagcuguuggaaaggaguucaaucaccuggagaagagaauugaaaaccucaauaaaaagguggaugacggcuuccuggauaucuggaccuacaacgccgagcugcucguccugcuugaaaaugagcggacccuggacuaucaugauagcaacgugaaaaaucucuacgagaagguccgcucucagcugaaaaacaacgccaaggaaauugggaauggauguuuugaguucuaucacaagugcgacaacacauguauggaauccgugaaaaauggcaccuacgauuauccuaaguacagcgaggaagcuaaacuuaacagagaggagaucgacgggguuaagcuggaaucuacacggaucuaucaaauucucgccaucuacuccacgguggcgagcucccugguccuggugguuucucucggcgcuauuagcuuuuggaugugcuccaauggaucucugcagugccgcaucuguauuuga

SEQ ID NO: 187850 - RNA, 1701 nt, Artificial Sequence; identical to SEQ ID NO: 187113
  derived and/or modified sequence opt5 from hemagglutinin__InfluenzaA__ADG42253

SEQ ID NO: 187851 - RNA, 1701 nt, Artificial Sequence; identical to SEQ ID NO: 185693
  derived and/or modified sequence opt5 from hemagglutinin__InfluenzaA__ADG42263

SEQ ID NO: 187852 - RNA, 1701 nt, Artificial Sequence; identical to SEQ ID NO: 186794
  derived and/or modified sequence opt5 from hemagglutinin__InfluenzaA__ADG42273

SEQ ID NO: 187853 - RNA, 1701 nt, Artificial Sequence; identical to SEQ ID NO: 186794
  derived and/or modified sequence opt5 from hemagglutinin__InfluenzaA__ADG42283

SEQ ID NO: 187854 - RNA, 1701 nt, Artificial Sequence; identical to SEQ ID NO: 187376
  derived and/or modified sequence opt5 from hemagglutinin__InfluenzaA__ADG42293

SEQ ID NO: 187855 - RNA, 1701 nt, Artificial Sequence
  derived and/or modified sequence opt5 from hemagglutinin__InfluenzaA__ADG42303
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugaaaggaguugcgccccuccaucugggcaagugcaacaucgccggguggauucugggaaauccugagugugaaucucucagcacagcuuccucuuggagcuacaucguggagaccuccucuagcgacaacggcacgugcuauccgggggauuuuauugacuacgaagaacugagagagcagcuuuccagcgucucuuccuucgaacgguuugagaucuuccccaagaccagcucuuggccuaaucacgauuccaacaaaggagugacagccgcuuguccccaugccggcgccaagagcuuuuauaaaaaucugaucuggcucguuaagaaaggcaacucuuacccuaagcuguccaagagcuauauuaaugacaaagggaaggaagugcuuguccuguggggaauccaccaccccuccaccucugccgaucaacagagccucuaccagaacgcugacgccuacguguucgugggcacaucccgcuauagcaaaaaguuuaaaccugagauugcuaucagaccgaagguccgggaucaggaggggcgcaugaauuacuauuggacccugguugaacccggagacaaaauuacguucgaggccacaggcaaccugguggugccuagauacgcguuugccauggaacggaacgcugggucuggaaucgucauuuccgauacccccgugcaugacugcaauacaaccugucaaaccccuaagggcgccaucaacacaagccuccccuuccagaauauccacccgauuacgaucggcaagugcccuaaauauguuaagucuaccaaacugcgccuugcuacagggcugagaaacgugcccagcauucagucccggggacucuuuggcgccaucgccggguucauugagggaggcuggaccgggauggucgacggaugguacggcuaucaucaccagaaugaacaaggcucuggguacgcugcggaucuuaagagcacacagaacgccaucgacgagaucaccaauaaagugaacuccguuauugagaagaugaauacgcaguuuacagcugugggaaaggaguucaaccaccuggagaaacgcaucgaaaaucugaacaagaaagucgaugacggcuuccucgauauuuggaccuacaaugccgagcugcuggugcuccuggaaaacgagagaacccuugacuaucaugauagcaaugucaagaaccuguacgagaaagugcggucucagcucaagaacaaugccaaggaaaucgggaacggauguuuugaguucuaucacaaaugcgacaauacauguauggaauccguuaagaacggcaccuacgauuauccuaaauacagcgaggaagcuaagcugaaucgcgaggagauugacggggugaaacuugaaucuacaagaaucuaucaaauccuggccauuuacuccacggucgcgagcucccucgugcugguugugucucugggcgcuaucagcuuuuggaugugcuccaacggaucucuccagugccggauuuguaucuga

SEQ ID NO: 187856 - RNA, 1701 nt, Artificial Sequence; identical to SEQ ID NO: 187403
  derived and/or modified sequence opt5 from hemagglutinin__InfluenzaA__ADG42313

SEQ ID NO: 187857 - RNA, 1701 nt, Artificial Sequence
  derived and/or modified sequence opt5 from hemagglutinin__InfluenzaA__ADG42323
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagauguuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauaucaaugacaaggggaaagaagugcuuguccuguggggcauucaccaccccuccaccucugccgaucaacagagccucuaccagaacgcugacgccuacguguucgugggaacauccagauauagcaagaaauuuaagccugagaucgcuauucggccgaaaguccgcgaucaggaggggagaaugaauuacuauuggacccugguugaacccggagacaagaucacguucgaggccacaggcaaccugguggugccucgguacgcguuugccauggaacgcaacgcugggucuggaauuaucauuuccgauacccccguccaugacugcaauacaaccugucaaaccccuaaaggcgccaucaacacaagccuccccuuccagaauauccacccgauuacgaucggcaagugcccuaaguaugugaaaucuaccaagcugagacuugcuacagggcugcggaacguucccagcauucagucccgcggacucuuuggcgccaucgccggguucauugagggaggcuggaccgggaugguggacggaugguacggcuaucaucaccagaaugaacaaggcucuggguacgcugcggaucugaaaagcacacagaacgccaucgacgagaucaccaauaaggucaacuccgugauugagaaaaugaauacgcaguuuacagcuguuggaaaggaguucaaccaccuugagaagagaaucgaaaaucugaacaaaaagguggaugacggcuuccucgauauuuggaccuacaaugccgagcugcugguccuccuggaaaacgagcggacccuugacuaucaugauagcaaugugaaaaaccuguacgagaagguccgcucucagcucaaaaacaaugccaaggaaguggggaacggauguuuugaguucuaucacaagugcgacaauacauguauggaauccguuaaaaacggcaccuacgauuauccuaaguacagcgaggaagcuaaacugaauagagaggagaucgacggggugaaacuugaaucuacacggauuuaucaaauccuggccaucuacuccacggucgcgagcucccucgugcugguugugucucugggcgcuauuagcuuuuggaugugcuccaacggaucucuccagugccgcaucuguauuuga

SEQ ID NO: 187858 - RNA, 1701 nt, Artificial Sequence
  derived and/or modified sequence opt5 from hemagglutinin__InfluenzaA__ADG42333
augaaggccauccuggugguccuccuguacacccuugcuacagccaacgcggacacgcugugcauuggcuaucacgcuaauaacagcaccgauacaguugacaccgugcucgagaaaaaugugacagucacccauuccgugaaccugcuugaagauaagcacaaugggaaacuguguaagcucagaggaaucgcuccccugcaucugggcaaaugcaacauugccggguggauccucggaaauccugagugugaaucucugagcacagccuccucuuggagcuacauuguugagaccuccucuagcgacaacggcacgugcuauccgggggauuucaucgacuacgaggaacuucgggagcagcuguccagcgugucuuccuuugaacgcuucgagaucuuucccaagaccagcucuuggccuaaucacgauuccaacaagggagucacagccgcuuguccccaugccggcgcgaaaucuuucuauaagaaucucauuuggcuggugaaaaagggcaacagcuacccuaaacuuuccaagagcuauaucaaugacaaggggaaagaaguucuggugcucuggggcauucaccaccccuccaccucugccgaucaacagagccuguaccagaacgcugacgccuacgucuuugugggaacauccagauauagcaagaaauucaagccugagaucgcuauucggccgaaagugcgcgaucaggaggggagaaugaauuacuauuggacccuggucgaacccggagacaagaucacguuugaggccacaggcaaccucguugugccucgguacgcguucgccauggaacgcaacgcugggucuggaauuaucaucuccgaugcccccgugcaugacugcaauaccacaugucaaaccccuaaaggcgcuauuaacaccagccugcccuuucagaauauccacccgauuacaaucggcaagugcccuaaguaugucaaaucuacgaaacuuagacuggccaccgggcuccggaacgugcccagcauucagucccgcggacuguucggcgccaucgcuggguuuaucgagggaggcuggacagggaugguugacggaugguacggcuaucaucaccagaaugaacaaggcucuggguacgcggccgaucuuaagagcacccagaacgcuauugacgagaucacaaauaaggugaacuccgucauugagaaaaugaauacccaguucacggccgugggaaaggaauuuaaccaccuggagaagagaaucgaaaaucucaacaaaaagguugaugacggcuuccuggauauuuggacauacaaugccgagcugcucgugcugcuugaaaacgagcggacccuggacuaucaugauagcaaugucaaaaaccucuacgagaaggugcgcucucagcugaaaaacaaugcuaaggaaaucgggaacggauguuucgaguuuuaucacaagugcgacaauaccuguauggaauccgucaaaaacggcacauacgauuauccuaaguacagcgaggaagccaaacuuaauagagaggagaucgacggggugaagcuggaaucuacccggauuuaucaaauccucgcgauuuacuccacaguugcuagcucccuggugcuggucgugucucucggcgccaucagcuucuggaugugcuccaacggaucucugcagugccgcauuuguaucuga

SEQ ID NO: 187859 - RNA, 1701 nt, Artificial Sequence
  derived and/or modified sequence opt5 from hemagglutinin__InfluenzaA__ADG42343
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaaucuaacgcuggguccggaaucauuaucagcgauacccccguccaugacugcaauacaaccugucaaaccccuaaaggcgccaucaacacaucucuccccuuccagaauauucacccgaucacgauuggcaagugcccuaaguaugugaaaagcaccaagcugcgccuugcuacagggcugagaaacguucccuccauccagucucggggacucuuuggcgccauugccggguucaucgagggaggcuggaccgggaugguggacggaugguacggcuaucaucaccagaaugaacaaggcagcggguacgcugcggaucugaaauccacacagcacgccaucgacgagauuaccaacaaggucaauagcgugaucgagaaaaugaacacgcaguuuacagcuguuggaaaggaguucaaucaucuugagaagcgcauugaaaaccugaauaaaaagguggaugacggcuuccucgauaucuggaccuacaacgccgagcugcugguccuccuggaaaaugagagaacccuugacuaucacgauucuaacgugaaaaaucuguacgagaagguccggucccagcucaaaaacaacgccaaggaaauugggaauggauguuuugaguucuaucauaagugcgacaacacauguauggaaagcgugaaaaauggcaccuacgauuauccuaaguacucugaggaagcuaaacugaaccgcgaggagaucgacgggguuaaacuugaauccacaagaaucuaucaaauucuggccaucuacagcacgguggcguccucucucguccuggugguuagccugggcgcuauuuccuuuuggaugugcucuaauggaagccuccagugccggaucuguauuuga

SEQ ID NO: 187860 - RNA, 1701 nt, Artificial Sequence
  derived and/or modified sequence opt5 from hemagglutinin__InfluenzaA__ADG42363
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaaucgcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccaagagcuauaucaaugacaaggggaaagaaguucuugugcuguggggcauucaccaccccuccaccucugccgaucaacagagccucuaccagaacgcugacgccuacgucuucgugggaacauccagauauagcaagaaauuuaagccugagaucgcuauucggccgaaagugcgcgaucaggaggggagaaugaauuacuauuggacccuggucgaacccggagacaagaucacguucgaggccacaggcaaccugguugugccucgguacgcguuugccauggaacgcaacgcugggucuggaauuaucaucuccgauacccccgugcaugacugcaauacaaccugucaaaccccuaaaggcgccauuaacacaagccuccccuuccagaauauccacccgauuacgaucggcaagugcccuaaguaugucaaaucuaccaagcugagacuugcuacagggcugcggaacgugcccagcauucagucccgcggacucuuuggcgccaucgccggguucaucgagggaggcuggaccgggaugguugacggaugguacggcuaucaucaccagaaugaacaaggcucuggguacgcugcggaucugaaaagcacacagaacgccauugacgagaucaccaauaaggugaacuccgucauugagaaaaugaauacgcaguuuacagcugugggaaaggaguucaaccaccuugagaagagaaucgaaaaucugaacaaaaagguugaugacggcuuccucgauauuuggaccuacaaugccgagcugcuggugcuccuggaaaacgagcggacccuugacuaucaugauagcaaugucaaaaaccuguacgagaaggugcgcucucagcucaaaaacaaugccaaggaaaucgggaacggauguuuugaguucuaucacaagugcgacaauacauguauggaauccgucaaaaacggcaccuacgauuauccuaaguacagcgaggaagcuaaacugaauagagaggagaucgacggggugaaacuugaaucuacacggauuuaucaaauccuggccauuuacuccacgguugcgagcucccucgugcuggucgugucucugggcgcuaucagcuuuuggaugugcuccaacggaucucuccagugccgcauuuguaucuga

SEQ ID NO: 187861 - RNA, 1701 nt, Artificial Sequence
  derived and/or modified sequence opt5 from hemagglutinin__InfluenzaA__ADG42373
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcaaccagcucaaaaauaacgccaaggaaauugggaauggauguuuugaguucuaucacaagugcgacaacacauguauggaaucugugaaaaauggcaccuacgauuauccuaaguacuccgaggaagcuaaacugaacagagaggagaucgacgggguuaaacuugaaagcacacggaucuaucaaauucuggccaucuacucuacgguggcguccagccucguccuggugguuucccugggcgcuauuucuuuuuggaugugcagcaauggaucccuccagugccgcaucuguauuuga

SEQ ID NO: 187862 - RNA, 1701 nt, Artificial Sequence
  derived and/or modified sequence opt5 from hemagglutinin__InfluenzaA__ADG42393
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugagaaacuuuguaagcugagagggguugcuccccuccaucugggaaaaugcaacaucgccggcuggauucuggggaauccugaaugugagucucucagcacagccuccucuuggagcuacaucguggaaaccuccucuagcgacaacggaacgugcuauccgggcgauuuuauugacuacgaggagcugcgggaacagcuuuccagcgucucuuccuucgagcgcuuugaaaucuuccccaagaccagcucuuggccuaaucacgauuccaacaagggggugacagccgcuuguccccaugccggagcgaaaucuuuuuauaagaaucugaucuggcucguuaaaaagggcaacagcuacccuaaacuguccaagagcuauauuaaugacaagggcaaagaggugcuuguccugugggggauccaccaccccuccaccucugccgaucaacagagccucuaccagaacgcugacgccuacguguucgugggaacauccagauauagcaagaaauuuaagccugagauugcuauccggccgaaaguccgcgaacaggagggcagaaugaauuacuauuggacccugguugaacccggggauaagauuacguucgaggccacaggaaaccugguggugccucgguacgcguuugccauggaacgcaacgcuggcucugggaucauuaucuccgacacccccguccaugauugcaauacaaccugucaaaccccuaaaggagccaucaacacaagccuccccuuccagaauauucacccgaucacgauuggcaagugcccuaaguaugugaaaucuaccaagcugagacuugcuacaggccugcggaacguucccagcauccagucccgcgggcucuuuggagccauugccggcuucaucgaagggggauggaccggcaugguggacgggugguacggauaucaucaccagaaugagcaaggcucuggcuacgcugcggaccugaaaagcacacagaacgccaucgaugaaauuaccaauaaggucaacuccgugaucgagaaaaugaauacgcaguuuacagcuguugggaaggaguucaaccaccuugagaagagaauugaaaaucugaacaaaaagguggacgauggauuccucgacaucuggaccuacaaugccgagcugcugguccuccuggagaacgaacggacccuugauuaucaugacagcaaugugaaaaaccuguacgagaagguccgcucucagcucaaaaacaaugccaaggaaauuggcaacggguguuuugaguucuaucacaagugcgauaauacauguauggaauccgugaaaaacggaaccuacgacuauccuaaguacagcgaggaggcuaaacugaauagagaagagaucgauggcguuaaacuugaaucuacacggaucuaucaaauucuggccaucuacuccacgguggcgagcucccucguccugcuggugucucucggggcuauuagcuuuuggaugugcuccaacggcucucugcagugccgcaucuguauuuga

SEQ ID NO: 187863 - RNA, 1701 nt, Artificial Sequence; identical to SEQ ID NO: 186857
  derived and/or modified sequence opt5 from hemagglutinin__InfluenzaA__ADG42403

SEQ ID NO: 187864 - RNA, 1701 nt, Artificial Sequence; identical to SEQ ID NO: 187113
  derived and/or modified sequence opt5 from hemagglutinin__InfluenzaA__ADG42413

SEQ ID NO: 187865 - RNA, 1701 nt, Artificial Sequence; identical to SEQ ID NO: 187860
  derived and/or modified sequence opt5 from hemagglutinin__InfluenzaA__ADG42423

SEQ ID NO: 187866 - RNA, 1701 nt, Artificial Sequence; identical to SEQ ID NO: 187113
  derived and/or modified sequence opt5 from hemagglutinin__InfluenzaA__ADG42443

SEQ ID NO: 187867 - RNA, 1701 nt, Artificial Sequence
  derived and/or modified sequence opt5 from hemagglutinin__InfluenzaA__ADG42453
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggaacauccagauauagcaagaaauuuaagccugagaucgcuauucggccgaaaguccgcgaucaggaggggagaaugaauuacuauuggacccucguugaacccggagacaagaucacguucgaggccacaggcaaccugguggugccucgguacgcguuugccauggaacgcaacgcugggucuggaauuaucaucuccgauacccccguccaugacugcaauacaaccugucaaaccccuaaaggcgccauuaacacaagccugcccuuccagaauauccacccgauuacgaucggcaagugcccuaaguaugugaaaucuaccaagcucagacuggcuacagggcuucggaacguucccagcauucagucccgcggacuguuuggcgccaucgccggguucaucgagggaggcuggaccgggaugguggacggaugguacggcuaucaucaccagaaugaacaaggcucuggguacgcugcggaucucaaaagcacacagaacgccauugacgagaucaccaauaaggucaacuccgugauugagaaaaugaauacgcaguuuacagcuguuggaaaggaguucaaccaccuggagaagagaguggaaaaucuuaacaaaaaggucgaugacggcuuccuggauaucuggaccuacaaugccgagcuccuggugcugcucgaaaacgagcggacccuggacuaucaugauagcaaugucaaaaaccuuuacgagaaggugcgcucucagcugaaaaacaaugccaaggaaauugggaacggauguuuugaguucuaucacaagugcgacaauacauguauggaauccguuaaaaacggcaccuacgauuauccuaaguacagcgaggaagcuaaacucaauagagaggagaucgacggggugaagcuggaaucuacacggaucuaucaaauucuugccaucuacuccacggucgcgagcucccuggugcucguugugucucugggcgcuauuagcuuuuggaugugcuccaacggaucucugcagugccgcaucuguauuuga

SEQ ID NO: 187868 - RNA, 1701 nt, Artificial Sequence; identical to SEQ ID NO: 186046
  derived and/or modified sequence opt5 from hemagglutinin__InfluenzaA__ADG42463

SEQ ID NO: 187869 - RNA, 1701 nt, Artificial Sequence; identical to SEQ ID NO: 185693
  derived and/or modified sequence opt5 from hemagglutinin__InfluenzaA__ADG42473

SEQ ID NO: 187870 - RNA, 1701 nt, Artificial Sequence; identical to SEQ ID NO: 187113
  derived and/or modified sequence opt5 from hemagglutinin__InfluenzaA__ADG42483

SEQ ID NO: 187871 - RNA, 1701 nt, Artificial Sequence; identical to SEQ ID NO: 187245
  derived and/or modified sequence opt5 from hemagglutinin__InfluenzaA__ADG42493

SEQ ID NO: 187872 - RNA, 1701 nt, Artificial Sequence; identical to SEQ ID NO: 187306
  derived and/or modified sequence opt5 from hemagglutinin__InfluenzaA__ADG42503

SEQ ID NO: 187873 - RNA, 1701 nt, Artificial Sequence; identical to SEQ ID NO: 186794
  derived and/or modified sequence opt5 from hemagglutinin__InfluenzaA__ADG42513

SEQ ID NO: 187874 - RNA, 1701 nt, Artificial Sequence
  derived and/or modified sequence opt5 from hemagglutinin__InfluenzaA__ADG42533
augaaggccauccuggugguccuccuguacaccuucgcuacagccaaagcggacacgcuuugcauuggcuaucacgcuaacaauagcaccgauacaguugacaccgugcuggagaagaacgugacagucacccauuccgugaaucuccuggaagauaaacacaacgggaagcuguguaaacugagaggaguugcgccccuccaucugggcaagugcaauaucgccggguggauucugggaaacccugagugugaaucucucagcacagcuuccucuuggagcuacaucguggagaccuccucuagcgacaauggcacgugcuauccgggggauuuuauugacuacgaagaacugcgggagcagcuuuccagcgucucuuccuucgaacgcuuugagaucuuccccaagaccagcucuuggccuaaccacgauuccaauaaaggagugacagccgcuuguccccaugccggcgccaagagcuuuuauaaaaaccugaucuggcucguuaagaaaggcaauucuuacccuaagcuguccaagagcuauauuaacgacaaagggaaggaagugcuuguccuguggggaauccaccaccccuccaccucugccgaucaacagagccucuaccagaaugcugacgccuacguguucgugggcacauccagauauagcaaaaaguuuaaaccugagauugcuauccggccgaagguccgcgaucaggaggggagaaugaacuacuauuggacccugguugaacccggagacaaaauuacguucgaggccacaggcaaucugguggugccucgguacgcguuugccauggaacgcaacgcugggucuggaaucauuaucuccgauacccccguccaugacugcaacacaaccugucaaaccccuaagggcgccaucaauacaagccuccccuuccagaacauucacccgaucacgauuggcaagugcccuaaauaugugaagucuaccaaacugagacuugcuacagggcugcggaauauccccagcauucagucccgcggacucuuuggcgccaucgccggguucaucgagggaggcuggaccgggaugguugacggaugguacggcuaucaucaccagaacgaacaaggcucuggguacgcugcggaucuuaagagcacacagaaugccauugacgagaucaccaacaaagucaauuccgugauugagaagaugaacacgcaguuuacagcugugggaaaggaguucaaucaccuugagaaaagaaucgaaaaccugaauaagaaaguugaugacggcuuccucgauauuuggaccuacaacgccgagcugcuggugcuccuggaaaaugagcggacccuugacuaucaugauagcaacgucaagaaucuguacgagaaagugcgcucucagcucaagaacaacgccaaggaaaucgggaauggauguuuugaguucuaucacaaaugcgacaacacauguauggaauccgucaagaauggcaccuacgauuauccuaaauacagcgaggaagcuaagcugaacagagaggagaucgacggggugaaacuugaaucuacacggauuuaucaaauccuggccauuuacuccacgguugcgagcucccucgugcuggucgugucucugggcgcuaucagcuuuuggaugugcuccaauggaucucuccagugccgcauuuguaucuga

SEQ ID NO: 187875 - RNA, 1701 nt, Artificial Sequence
  derived and/or modified sequence opt5 from hemagglutinin__InfluenzaA__ADG42553
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguagccaugccggcgcgaaaucuuuuuauaagaaucugaucuggcucguuaaaaagggcaacuccuaccccaaacugaauaagagcuauauuaacgacaaggggaaagaagugcuuguccuguggggaauccaccacccuuccaccucugccgaucaacagagccucuaccagaaugcugacgccuacguguucgugggcacauccagauauagcaagaaauuuaagcccgagauugcuauccggccuaaaguccgcgagcaggaagggagaaugaacuacuauuggacccugguugagccgggagauaagauuacguucgaagccacaggcaaccugguggugccccgguacgcguuugccauggagcgcaaugcugggucuggaaucauuaucuccgacaccccuguccaugauugcaacacaaccugucaaacccccaaaggcgccaucaauacaagccucccuuuccagaacauucaccccaucacgauuggcaagugcccgaaguaugugaaaucuaccaagcugagacuugcuacagggcugcggaauguuccuagcauccagucccgcggacucuuuggcgccauugccggguucaucgaaggaggcuggaccgggaugguggacggaugguacggcuaucaucaccagaacgagcaaggcucuggguacgcugcggaccugaaaagcacacagaaugccaucgaugagauuaccaacaaggucaauuccgugaucgaaaagaugaacacgcaguuuacagcuguuggaaaggaguucaaucaccuugaaaagagaauugagaaccugaauaaaaagguggacgauggcuuccucgacaucuggaccuacaacgccgaacugcugguccuccuggagaaugagcggacccuugauuaucaugacagcaacgugaaaaaccuguacgaaaagguccgcucucagcucaaaaauaacgccaaggagauugggaauggauguuuugaguucuaucacaagugcgauaacacauguauggaguccgugaaaaauggcaccuacgacuaucccaaguacagcgaagaggcuaaacugaacagagaggaaaucgaugggguuaaacuugagucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 187876 - RNA, 1701 nt, Artificial Sequence
  derived and/or modified sequence opt5 from hemagglutinin__InfluenzaA__ADG42573
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugauugaacccggagacaagaucacguucgaggccacaggcaaccugguugugccucgguacgcguuugccauggaacgcaacgcugggucuggaauuaucaucuccgauacccccgugcaugacugcaauacaaccugucaaaccccuaaaggcgccauuaacacaagccuccccuuccagaauauccacccgauuacgaucggcaagugcccuaaguaugucaaaucuaccaagcugagacuugcuacagggcugcggaacgugcccagcauucagucccgcggacucuuuggcgccaucgccggguucaucgagggaggcuggaccgggaugguugacggaugguacggcuaucaucaccagaaugaacaaggcucuggguacgcugcggaucugaaaagcacacagaacgccauugacgagaucaccaauaaggugaacuccgucauugagaaaaugaauacgcaguuuacagcugugggaaaggaguucaaccaccuugagaagagaaucgaaaaucugaacaaaaagguugaugacggcuuccucgauauuuggaccuacaaugccgagcugcuggugcuccuggaaaacgagcggacccuugacuaucaugauagcaaugucaaaaagcuguacgagaaagugcgcucucagcucaagaacaacgccaaggaaaucgggaauggauguuuugaguucuaucacaaaugcgacaacacauguauggaauccgucaagaauggcaccuacgauuauccuaaauacagcgaggaagcuaagcugaacagagaggagaucgacggggugaaacuugaaucuacacggauuuaucaaauccuggccauuuacuccacgguugcgagcucccucgugcuggucgugucucugggcgcuaucagcuuuuggaugugcuccaauggaucucuccagugccgcauuuguaucuga

SEQ ID NO: 187877 - RNA, 1701 nt, Artificial Sequence
  derived and/or modified sequence opt5 from hemagglutinin__InfluenzaA__ADG42583
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacuccuacguguucgugggcacaagcagauauucuaagaaauuuaagccugagauugccauccggccgaaaguccgcgaucaggaggggagaaugaauuacuauuggacccugguugaacccggagacaagauuacguucgaggcuacaggcaaccugguggugccucgguacgccuuugcgauggaacgcaacgccggguccggaaucauuaucagcgauacccccguccaugacugcaauacaaccugucaaaccccuaaaggcgcuaucaacacaucucuccccuuccagaauauucacccgaucacgauuggcaagugcccuaaguaugugaaaagcaccaagcugagacuugccacagggcugcggaacguucccuccauccagucucgcggacucuuuggcgcuauugccggguucaucgagggaggcuggaccgggaugguggacggaugguacggcuaucaucaccagaaugaacaaggcagcggguacgccgcugaucugaaauccacacagcacgcgaucgacgagauuaccaacaaggucaauagcgugaucgagaaaaugaacacgcaguuuacagccguuggaaaggaguucaaucaucuugagaagagaauugaaaaccugaauaaaaagguggaugacggcuuccucgauaucuggaccuacaacgcugagcugcugguccuccuggaaaaugagcggacccuugacuaucacgauucuaacgugaaaaaucuguacgagaagguccgcucccagcucaaaaacaacgccaaggaaauugggaauggauguuuugaguucuaucauaagugcgacaacacauguauggaaagcgugaaaaauggcaccuacgauuauccuaaguacucugaggaagccaaacugaacagagaggagaucgacgggguuaaacuugaauccacacggaucuaucaaauucuggcuaucuacagcacgguggccuccucucucguccuggugguuagccugggcgcgauuuccuuuuggaugugcucuaauggaagccuccagugccgcaucuguauuuga

SEQ ID NO: 187878 - RNA, 1701 nt, Artificial Sequence; identical to SEQ ID NO: 187290
  derived and/or modified sequence opt5 from hemagglutinin__InfluenzaA__ADG42593

SEQ ID NO: 187879 - RNA, 1701 nt, Artificial Sequence
  derived and/or modified sequence opt5 from hemagglutinin__InfluenzaA__ADG42603
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacugagaaaguccuauauuaaugacaaggggaaagaagugcuuguccuguggggaauccaccaccccagcaccuccgccgaucaacagucucucuaccagaacgcugacgccuacguguucgugggcacaagccgguauuccaagaaauuuaagccugagauugcuacccgcccgaaagucagagaucaggaggggcggaugaauuacuauuggacgcugguugaacccggagacaagaucacauucgaggccaccggcaaccugguggugccucgcuacgcguuugccauggaaagaaacgcugggagcggaauuaucauuucugauacacccguccaugacugcaauaccaccugucaaacaccuaaaggcuccaucaacacgagccuccccuuccagaauauccacccgauuaccaucggcaagugcccuaaguaugugaaaucuacaaagcugcggcuugccaccgggcugcgcaacguucccagcauucaguccagaggacucuuuggcgcuaucgccggguucauugagggaggcuggacagggaugguggacggaugguacggcuaucaucaccagaaugaacaaggcucuggguacgccgcugaucugaaaagcacccagcacgcgaucgacgagaucacgaacaaggucaauuccgugauugagaaaaugaacacacaguuuaccgccguuggaaaggaguucaaucaucuugagaagcggaucgaaaaccugaauaaaaagguggaugacggcuuccucgauauuuggaccuacaacgcugagcugcugguccuccuggaaaaugagcgcacacuugacuaucacgauagcaacgugaaaaaucuguacgagaaggucagaucucagcucaaaaacaacgccaaggaaaucgggaauggauguuuugaguucuaucauaagugcgacaacaccuguauggaauccgugaaaaauggcacauacgauuauccuaaguacagcgaggaagccaaacugaaccgggaggagauugacgggguuaaacuugaaucuacgcgcaucuaucaaauccuggcuauuuacuccaccguggccagcucccucguccuggugguuucucugggcgcgaucagcuuuuggaugugcuccaauggaucucuccagugcagaauuuguaucuga

SEQ ID NO: 187880 - RNA, 1701 nt, Artificial Sequence
  derived and/or modified sequence opt5 from hemagglutinin__InfluenzaA__ADG42613
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggaacauccagauauagcaagaaauuuaagccugagaucgcuauucggccgaaaguccgcgaucaggaggggagaaugaauuacuauuggacccucguugaacccggagacaagaucacguucgaggccacaggcaaccugguggugccucgguacgcguuugccauggaacgcaacgcugggucuggaauuaucaucuccgauacccccguccaugacugcaauacaaccugucaaaccccuaaaggcgccauuaacacaagccugcccuuccagaauauccacccgauuacgaucggcaagugcccuaaguaugugaaaucuaccaagcucagacuggcuacagggcuucggaacguucccagcauucagucccgcggacuguuuggcgccaucgccggguucaucgagggaggcuggaccgggaugguggacggaugguacggcuaucaucaccagaaugaacaaggcucuggguacgcugcggaucucaaaagcacacagaacgccauugacgagaucaccaauaaggucaacuccgugauugagaaaaugaauacgcaguuuacagcuguuggaaaggaguucaaccaccuggagaagagaaucgaaaaucuuaacaaaaagguggaugacggcuuccuggauauuuggaccuacaaugccgagcuccugguccugcucgaaaacgagcggacccuggacuaucaugauagcaaugugaaaaaccuuuacgagaagguccgcucucagcugaaaaacaaugccaaggaaaucgggaacggauguuuugaguucuaucacaagugcgacaauacauguauggaauccgugaaaaacggcaccuacgauuauccuaaguacagcgaggaagcuaaacucaauagagagaagaucgacgggguuaaacuggagucuacacggauuuaucaaauccuugccauuuacuccacgguggcgagcucccugguccucgugguuucucugggcgcuaucagcuuuuggaugugcuccaacggaucucugcagugccgcauuuguaucuga

SEQ ID NO: 187881 - RNA, 1701 nt, Artificial Sequence; identical to SEQ ID NO: 187320
  derived and/or modified sequence opt5 from hemagglutinin__InfluenzaA__ADG42623

SEQ ID NO: 187882 - RNA, 1701 nt, Artificial Sequence; identical to SEQ ID NO: 185693
  derived and/or modified sequence opt5 from hemagglutinin__InfluenzaA__ADG42633

SEQ ID NO: 187883 - RNA, 1701 nt, Artificial Sequence
  derived and/or modified sequence opt5 from hemagglutinin__InfluenzaA__ADG42643
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgccaaccuccuggaagauaagcacaaugggaaacuuuguaagcugagaggagccgcuccccuccaucugggcaaaugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgggagcagcuuuccagcguuucuuccuucgaacgcuuugagauguuccccaagaccagcucuuggccuaaucacgauuccaacaagggagugacagccgcguguccccaugccggcgcuaagagcuuuuauaagaaucugaucuggcucgucaaaaagggcaacucuuacccuaaacuguccaagagcuaugugaaugacaaggggaaagaaguucuugugcuguggggaauccaccaccccuccaccucugccgaucaacagagccucuaccagaacgcugacgccuacgucuucgugggcacauccagauauagcaagaaauuuaagccugagauugcgauccggccgaaagugcgcgaucaggaggggagaaugaauuacuauuggacccuggucgaacccggagacaagauuacguucgaggccacaggcaaccugguugugccucgguacgcuuuugccauggaacgcaacgcugggucuggaaucauuaucuccgauacccccgugcaugacugcaauacaaccugucaaaccccuaaaggcgccauuaacacaagccuccccuuccagaauauccacccgaucacgauuggcaagugcccuaaguaugucaaaucuaccaagcugagacuugccacagggcugcggaacgugcccagcauccagucccgcggacucuuuggcgcuauugcgggguucaucgagggaggcuggaccgggaugguugacggaugguacggcuaucaucaccagaaugaacaaggcucuggguacgccgcugaucugaaaagcacacagaacgccauugacgagaucaccaauaaggugaacuccgucaucgagaaaaugaauacgcaguuuacagccgugggaaaggaguucaaccaccuugagaagagaauugaaaaucugaacaaaaagguugaugacggcuuccucgauaucuggaccuacaaugcugagcugcuggugcuccuggaaaacgagcggacccuugacuaucaugauagcaaugucaaaaaccuguacgagaaggugcgcucucagcucaaaaacaaugccaaggaaauugggaacggauguuuugaguucuaucacaagugcgacaauacauguauggaauccgucaaaaacggcaccuacgauuauccuaaguacagcgaggaagcgaaacugaauagagaggagaucgacggggugaaacuugaaucuacacggauuuaucaaauccuggcuaucuacuccacgguugccagcucccucgugcuggucgugucucugggcgccauuagcuuuuggaugugcuccaacggaucucuccagugccgcaucuguauuuga

SEQ ID NO: 187884 - RNA, 1701 nt, Artificial Sequence
  derived and/or modified sequence opt5 from hemagglutinin__InfluenzaA__ADG42653
augaaggccauccuggugguccuccuguacaccagcgcuacagccaacgcggacacgcuuugcauuggcuaucacgcuaauaacuccaccgauacaguugacaccgugcuggagaagaaugugacagucacccauucugugaaccuccuggaagauaagcacaaugggaaacuuuguaagcugagaggaguugcuccccuccaucugggcaaaugcaacaucgccggguggauucugggaaauccugagugugaaagccucuccacagccucuagcugguccuacaucguggagaccucuagcuccgacaacggcacgugcuauccgggggauuucauugacuacgaggaacugcgggagcagcuuagcucugucuccagcuuugaacgcuucgagauguuucccaagaccucuuccuggccuaaucacgauagcaacaagggagugacagccgcuuguccccaugccggcgcgaaaucuuucuauaagaaucugaucuggcucguuaaaaagggcaacuccuacccuaaacugagcaaguccuauaucaaugacaaggggaaagaagugcuuguccuguggggcauucaccaccccucuaccagcgccgaucaacagucccucuaccagaacgcugacgccuacguguuugugggaacaagcagauauucuaagaaauucaagccugagaucgcuauucggccgaaaguccgcgaucaggaggggagaaugaauuacuauuggacccugguugaacccggagacaagaucacguuugaggccacaggcaaccugguggugccucgguacgcguucgccauggaacgcaacgcuggguccggaauuaucauuagcgauacccccguccaugacugcaauacaaccugucaaaccccuaaaggcgccaucaacacaucucuccccuuucagaauauccacccgauuacgaucggcaagugcccuaaguaugugaaaagcaccaagcugagacuugcuacagggcugcggaacguucccuccauucagucucgcggacucuucggcgccaucgccggguuuauugagggaggcuggaccgggaugguggacggaugguacggcuaucaucaccagaaugaacaaggcagcggguacgcugcggaucugaaauccacacagaacgccaucgacgagaucaccaauaaggucaacagcgugauugagaaaaugaauacgcaguucacagcuguuggaaaggaauuuaaccaccuugagaagagaaucgaaaaucugaacaaaaagguggaugacggcuuccucgauauuuggaccuacaaugccgagcugcugguccuccuggaaaacgagcggacccuugacuaucaugauucuaaugugaaaaaccuguacgagaagguccgcucccagcucaaaaacaaugccaaggaaaucgggaacggauguuucgaguuuuaucacaagugcgacaauacauguauggaaagcgugaaaaacggcaccuacgauuauccuaaguacucugaggaagcuaaacugaauagagaggagauugacgggguuaaacuugaauccacacggaucuaucaaauccuggccauuuacagcacgguggcguccucucucguccuggugguuagccugggcgcuaucuccuucuggaugugcucuaacggaagccuccagugccgcauuuguaucuga

SEQ ID NO: 187885 - RNA, 1701 nt, Artificial Sequence; identical to SEQ ID NO: 186857
  derived and/or modified sequence opt5 from hemagglutinin__InfluenzaA__ADG42663

SEQ ID NO: 187886 - RNA, 1701 nt, Artificial Sequence
  derived and/or modified sequence opt5 from hemagglutinin__InfluenzaA__ADG42673
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugaaaggaguugcuccccuccaucugggcaagugcaacaucgccggguggauucugggaaauccugagugugaaucucucagcacagccggcuccuggucuuacaucguggagaccagcuccucugacaacgggacgugcuauccgggagauuuuauugacuacgaagaacugagagagcagcuuagcuccgucagcucuuucgaacgguuugagaucuuccccaagaccuccagcuggccuaaucacgauucuaacaaaggcgugacagccgcuuguccccaugccggcgcgaaguccuuuuauaaaaaucugaucuggcucguuaagaaagggaacagcuacccuaagcugucuaaguccuauauuaaugacaaaggaaaggaagugcuuguccuguggggcauccaccaccccagcaccuccgccgaucaacagucucucuaccagaacgcugacgccuacguguucguggggacaagccgcuauuccaaaaaguuuaaaccugagauugcuaucagaccgaagguccgggaucaggagggacgcaugaauuacuauuggacccugguugaacccggcgacaaaauuacguucgaggccacagggaaccugguggugccuagauacgcguuugccauggaacggaacgcuggaagcggcaucauuaucucugauacccccguccaugacugcaauacaaccugucaaaccccuaagggcgccaucaacacaucccuccccuuccagaauauucacccgaucacgauugggaagugcccuaaauauguuaagagcaccaaacugcgccuugcuacaggacugagaaacgugcccucuauccagagccggggccucuuuggggccauugccggauucaucgagggcggguggaccggaaugguggacggcugguacggcuaucaucaccagaaugaacaaggguccggauacgcugcggaucugaagucuacacagaacgccaucgacggcauuaccaauaaagucaacagcgugaucgagaagaugaauacgcaguuuacagcuguugggaaggaguucaaccaccuugaaaaacgcauugagaaucugaacaagaaaguggaugacggauuccucgauaucuggaccuacaaugccgaacugcugguccuccuggagaacgaaagaacccuugacuaucaugauuccaaugugaagaaccuguacgagaaaguccggagccagcucaagaacaaugccaaggagauuggcaacggguguuuugaguucuaucacaaaugcgacaauacauguauggagucugugaagaacggcaccuacgauuauccuaaauacuccgaagaggcuaagcugaaucgcgaagagaucgacggaguuaaacuugagagcacaagaaucuaucaaauucuggccaucuacucuacgguggcguccagccucguccuggugguuucccugggcgcuauuucuuuuuggaugugcagcaacgggucccuccagugccggaucuguauuuga

SEQ ID NO: 187887 - RNA, 1701 nt, Artificial Sequence
  derived and/or modified sequence opt5 from hemagglutinin__InfluenzaA__ADG42683
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccggggaauuuuaucgauuacgaagaacuccgggagcagcuguccagcgucucuuccuucgaacgcuuugagaucuuccccaagaccagcucuuggccuaaccacgacuccaauaagggagugacagccgcuuguccccaugccggcgcgaaaucuuuuuauaagaaccuuauuuggcugguuaaaaagggcaauagcuacccuaaacucuccaagagcuauaucaacgauaaggggaaagaagugcugguccuuuggggcauucaccaccccuccaccucugccgaccaacagagccuguaccagaaugcugaugccuacguguucgugggaacauccagauauagcaagaaauuuaagccugagaucgcuauucggccgaaaguccgcgaccaggaggggagaaugaacuacuauuggacccucguugaacccggagauaagaucacguucgaggccacaggcaaccugguggugccucgguacgcguuugccauggaacgcaaugcugggucuggaauuaucaucuccgacacccccguccaugauugcaacacaaccugucaaaccccuaaaggcgccauuaauacaagccugcccuuccagaacauccacccgauuacgaucggcaagugcccuaaguaugugaaaucuaccaagcucagacuggcuacagggcuucggaauguucccagcauucagucccgcggacuguuuggcgccaucgccggguucaucgagggaggcuggaccgggaugguggacggaugguacggcuaucaucaccagaacgaacaaggcucuggguacgcugcggaccucaaaagcacacagaaugccauugaugagaucaccaacaaggucaauuccgugauugagaaaaugaacacgcaguuuacagcuguuggaaaggaguucaaucaccuggagaagagaaucgaaaaccuuaauaaaaagguggacgauggcuuccuggacauuuggaccuacaacgccgagcuccugguccugcucgaaaaugagcggacccuggauuaucaugacagcaacgugaaaaaccuuuacgagaagguccgcucucagcugaaaaauaacgccaaggaaaucgggaauggauguuuugaguucuaucacaagugcgauaacacauguauggaauccgugaaaaauggcaccuacgacuauccuaaguacagcgaggaagcuaaacucaacagagaggagaucgaugggguuaagcuggaaucuacacggauuuaucaaauccuugccauuuacuccacgguggcgagcucccugguccucgugguuucucugggcgcuaucagcuuuuggaugugcuccaauggaucucugcagugccgcauuuguaucuga

SEQ ID NO: 187888 - RNA, 1701 nt, Artificial Sequence; identical to SEQ ID NO: 186857
  derived and/or modified sequence opt5 from hemagglutinin__InfluenzaA__ADG42693

SEQ ID NO: 187889 - RNA, 1701 nt, Artificial Sequence; identical to SEQ ID NO: 187565
  derived and/or modified sequence opt5 from hemagglutinin__InfluenzaA__ADG42703

SEQ ID NO: 187890 - RNA, 1701 nt, Artificial Sequence
  derived and/or modified sequence opt5 from hemagglutinin__InfluenzaA__ADG42723
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauggcuauucggccgaaaguccgcgaucaggaggggagaaugaauuacuauuggacccugguugaacccggagacaagaucacguucgaggccacaggcaaccugguggugccucgguacgcguuugccauggaacgcaacgcugggucuggaauuaucauuuccgauacccccguccaugacugcaauacaaccugucaaaccccuaaaggcgccaucaacacaagccuccccuuccagaauauccacccgauuacgaucggcaagugcccuaaguaugugaaaucuaccaagcugagacuugcuacagggcugcggaacguucccagcauucagucccgcggacucuuuggcgccaucgccggguucauugagggaggcuggaccgggaugguggacggaugguacggcuaucaucaccagaaugaacaaggcucuggguacgcugcggaucugaaaagcacacagaacgccaucgacaagaucaccaauaaagucaacuccgugauugagaagaugaauacgcaguuuacagcuguuggaaaggaguucaaccaccuugagaaaagaaucgagaaucugaacaagaaaguggaugacggcuuccucgauauuuggaccuacaaugccgaacugcugguccuccuggagaacgaacggacccuugacuaucaugauagcaaugugaagaaccuguacgagaaaguccgcucucagcucaagaacaaugccaaggagaucgggaacggauguuuugaguucuaucacaaaugcgacaauacauguauggaauccgugaagaacggcaccuacgauuauccuaaauacagcgaagaggcuaagcugaauagagaagagauugacgggguuaaacuugagucuacacggaucuaucaaauccuggccauuuacuccacgguggcgagcucccucguccuggugguuucucugggcgcuaucagcuuuuggaugugcuccaacggaucucuccagugccgcauuuguaucuga

SEQ ID NO: 187891 - RNA, 1701 nt, Artificial Sequence; identical to SEQ ID NO: 187320
  derived and/or modified sequence opt5 from hemagglutinin__InfluenzaA__ADG42743

SEQ ID NO: 187892 - RNA, 1701 nt, Artificial Sequence
  derived and/or modified sequence opt5 from hemagglutinin__InfluenzaA__ADG42753
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucuacagaucaacagagccucuaccagaacgccgacgcuuacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacucuggguccggaaucauuaucagcgauacacccguccaugacugcaauaccaccugucaaacaccuaaaggcgccaucaacacgucucuccccuuccagaauauucacccgaucaccauuggcaagugcccuaaguaugugaaaagcacaaagcugagacuugcuaccgggcugcggaacguucccuccauccagucucgcggacucuuuggcgccauugcuggguucaucgagggaggcuggacagggaugguggacggaugguacggcuaucaucaccagaaugaacaaggcagcggguacgccgccgaucugaaauccacccagaacgcuaucgacgagauuacgaauaaggucaacagcgugaucgagaaaaugaauacacaguuuaccgcgguuggaaaggaguucaaccaccuugagaagagaauugaaaaucugaacaaaaagguggaugacggcuuccucgauaucuggaccuacaaugccgagcugcugguccuccuggaaaacgagcggacacuugacuaucaugauucuaaugugaaaaaccuguacgagaagguccgcucccagcucaaaaacaaugcuaaggaaauugggaacggauguuuugaguucuaucacaagugcgacaauaccuguauggaaagcgugaaaaacggcacauacgauuauccuaaguacucugaggaagccaaacugaauagagaggagaucgacgggguuaaacuugaauccacgcggaucuaucaaauucuggccaucuacagcaccguggcuuccucucucguccuggugguuagccugggcgccauuuccuuuuggaugugcucuaacggaagccuccagugccgcaucuguauuuga

SEQ ID NO: 187893 - RNA, 1701 nt, Artificial Sequence; identical to SEQ ID NO: 186857
  derived and/or modified sequence opt5 from hemagglutinin__InfluenzaA__ADG42763

SEQ ID NO: 187894 - RNA, 1701 nt, Artificial Sequence; identical to SEQ ID NO: 186857
  derived and/or modified sequence opt5 from hemagglutinin__InfluenzaA__ADG42773

SEQ ID NO: 187895 - RNA, 1701 nt, Artificial Sequence
  derived and/or modified sequence opt5 from hemagglutinin__InfluenzaA__ADG42783
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagauguuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauaucaaugacaaggggaaagaagugcuuguccuguggggcauucaccaccccuccaccucuacagaucaacagagccucuaccagaacgccgacgcuuacguguucgugggaaccuccagauauagcaagaaauuuaagccugagaucgccauucggccgaaaguccgcgaucaggaggggagaaugaauuacuauuggacgcugguugaacccggagacaagaucacauucgaggcuaccggcaaccugguggugccucgguacgccuuugcgauggaacgcaacgccgggucuggaauuaucauuuccgauacacccguccaugacugcaauaccaccugucaaacaccuaaaggcgcuaucaacacgagccuccccuuccagaauauccacccgauuaccaucggcaagugcccuaaguaugugaaaucuacaaagcugagacuugccaccgggcugcggaacguucccagcauucagucccgcggacucuuuggcgcuaucgccggguucauugagggaggcuggacagggaugguggacggaugguacggcuaucaucaccagaaugaacaaggcucuggguacgccgcugaucugaaaagcacccagaacgcgaucgacaagaucacgaauaaagucaacuccgugauugagaagaugaauacacaguuuaccgccguuggaaaggaguucaaccaccuugagaaaagaaucgagaaucugaacaagaaaguggaugacggcuuccucgauauuuggaccuacaaugcugaacugcugguccuccuggagaacgaacggacacuugacuaucaugauagcaaugugaagaaccuguacgagaaaguccgcucucagcucaagaacaaugccaaggagaucgggaacggauguuuugaguucuaucacaaaugcgacaauaccuguauggaauccgugaagaacggcacauacgauuauccuaaauacagcgaagaggccaagcugaauagagaagagauugacgggguuaaacuugagucuacgcggaucuaucaaauccuggcuauuuacuccaccguggccagcucccucguccuggugguuucucugggcgcgaucagcuuuuggaugugcuccaacggaucucuccagugccgcauuuguaucuga

SEQ ID NO: 187896 - RNA, 1701 nt, Artificial Sequence; identical to SEQ ID NO: 186857
  derived and/or modified sequence opt5 from hemagglutinin__InfluenzaA__ADG42793

SEQ ID NO: 187897 - RNA, 1701 nt, Artificial Sequence; identical to SEQ ID NO: 187895
  derived and/or modified sequence opt5 from hemagglutinin__InfluenzaA__ADG42803

SEQ ID NO: 187898 - RNA, 1701 nt, Artificial Sequence; identical to SEQ ID NO: 187245
  derived and/or modified sequence opt5 from hemagglutinin__InfluenzaA__ADG42813

SEQ ID NO: 187899 - RNA, 1701 nt, Artificial Sequence; identical to SEQ ID NO: 187388
  derived and/or modified sequence opt5 from hemagglutinin__InfluenzaA__ADG42823

SEQ ID NO: 187900 - RNA, 1701 nt, Artificial Sequence; identical to SEQ ID NO: 187290
  derived and/or modified sequence opt5 from hemagglutinin__InfluenzaA__ADG42833

SEQ ID NO: 187901 - RNA, 1701 nt, Artificial Sequence; identical to SEQ ID NO: 186857
  derived and/or modified sequence opt5 from hemagglutinin__InfluenzaA__ADG42843

SEQ ID NO: 187902 - RNA, 1701 nt, Artificial Sequence; identical to SEQ ID NO: 186857
  derived and/or modified sequence opt5 from hemagglutinin__InfluenzaA__ADG42853

SEQ ID NO: 187903 - RNA, 1701 nt, Artificial Sequence; identical to SEQ ID NO: 187411
  derived and/or modified sequence opt5 from hemagglutinin__InfluenzaA__ADG42863

SEQ ID NO: 187904 - RNA, 1701 nt, Artificial Sequence; identical to SEQ ID NO: 187431
  derived and/or modified sequence opt5 from hemagglutinin__InfluenzaA__ADG42883

SEQ ID NO: 187905 - RNA, 1701 nt, Artificial Sequence
  derived and/or modified sequence opt5 from hemagglutinin__InfluenzaA__ADG42893
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaaccugagacuugcuacagggcugcggaauguucccagcauccagucccgcggacucuuuggcgccauugccggguucaucgagggaggcuggaccgggaugguggacggaugguacggcuaucaucaccagaacgaacaaggcucuggguacgcugcggaucuuaagagcacacagaaugccaucgacgagauuaccaacaaagucaauuccgugaucgagaagaugaacacgcaguuuacagcuguuggaaaagaguucaaucaccuggagaagagaauugaaaaccugaauaagaaaguggaugacggcuuccucgauaucuggaccuacaacgccgagcugcugguccuccuggaaaaugagcggacccuugacuaucaugauagcaacgugaagaaccuguacgagaaaguccgcucucagcucaagaauaacgccaaagaaauugggaauggauguuuugaguucuaucacaagugcgacaacacauguauggaauccgugaagaauggcaccuacgauuauccuaaauacagcgaggaagcuaagcugaacagagaggagaucgacgggguuaaacuugaaucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 187906 - RNA, 1701 nt, Artificial Sequence; identical to SEQ ID NO: 185693
  derived and/or modified sequence opt5 from hemagglutinin__InfluenzaA__ADG42903

SEQ ID NO: 187907 - RNA, 1701 nt, Artificial Sequence; identical to SEQ ID NO: 186857
  derived and/or modified sequence opt5 from hemagglutinin__InfluenzaA__ADG42913

SEQ ID NO: 187908 - RNA, 1701 nt, Artificial Sequence; identical to SEQ ID NO: 187421
  derived and/or modified sequence opt5 from hemagglutinin__InfluenzaA__ADG42923

SEQ ID NO: 187909 - RNA, 1701 nt, Artificial Sequence
  derived and/or modified sequence opt5 from hemagglutinin__InfluenzaA__ADG57087
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggaucuaucaaauucuggccaucuacuccacgguggcgauuagccucguccuggugguuucccugggcgcuaucucuuuuuggaugugcagcaacggaucccuccgcugcagaauuuguaucuga

SEQ ID NO: 187910 - RNA, 1701 nt, Artificial Sequence; identical to SEQ ID NO: 185693
  derived and/or modified sequence opt5 from hemagglutinin__InfluenzaA__ADG57088

SEQ ID NO: 187911 - RNA, 1701 nt, Artificial Sequence
  derived and/or modified sequence opt5 from hemagglutinin__InfluenzaA__ADG57089
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaagcacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauucaguacgaggagcugcgggaacaacuuuccagcgucucuuccuucgagcgcuuugaaaucuuccccaaaaccagcucuuggccuaaucacgacuccaacaagggagugacagccgcuuguccccaugccggcgccaagagcuuuuauaaaaaucugaucuggcucguuaagaaaggcaacucuuacccuaagcuguccaaaagcuauauuaaugauaaggggaaggaggugcuuguccuguggggaauccaccaccccuccaccucugccgaccagcagagccucuaccagaacgcugaugccuacguguucgugggcuccagcagauauucuaaaaaguuuaaaccugagauugcuauccggccgaagguccgcgaccaagaagggagaaugaauuacuauuggacacugguugagcccggagauaaaauuaccuucgaagccacgggcaaccugguggugccucgguacgcguuugccauggagcgcaacgcuggguccggaaucauuaucagcgacacacccguccaugauugcaauaccacaugucagaccccuaagggcgccaucaacaccucucuccccuuccacaauauucauccgaucacaauuggcaaaugcccuaaguauguuaagagcacgaaacugagacuugcuaccgggcugcggaacgugcccuccauccagucucgcggacucuuuggcgccauugccggguucaucgaaggaggcuggacagggaugguggacggaugguacggcuaucaccaccagaaugagcaaggcagcggguacgcugcggaccugaaguccacccagaacgccaucgaugagauuacaaauaaagucaacagcgugaucgaaaagaugaauacccaguuuacggcuguuggaaaagaguucaaccaucuugaaaagagaauugagaaucugaacaagaaaguggacgauggcuuccucgacaucuggacauacaaugccgaacugcugguccuccuggagaacgagcggacccuugauuaucacgacucuaaugugaagaaccuguacgaaaaaguccgcucccagcucaagaacaaugccgaggaaauugggaacggauguuuugaguucuaucauaaaugcgauaauaccuguauggaaagcgugaagaacggcacauacgacuauccuaaguacucugaggaggcuaaacugaauagagaagagaucgaugggguuaaacuugaauccacccggaucuaucaaauucuggccaucuacagcacaguggcguccucucucguccuggugguuagccugggcgcuauuuccuuuuggaugugcucuaacggaagccuccagugccgcaucuguauuuga

SEQ ID NO: 187912 - RNA, 1701 nt, Artificial Sequence
  derived and/or modified sequence opt5 from hemagglutinin__InfluenzaA__ADG57090
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagcauuuaccagaacgcugacgccuacguguucgugggcacauccagauauagcaagaaauuuaagccugagaucgcuauucggccgaaaguccgcgaucaggaggggagaaugaauuacuauuggacccucguugaacccggagacaagaucacguucgaggccacaggcaaccugguggugccucgguacgcguuugccauggaacgcaacgcugggucuggaauuaucaucuccgauacccccguccaugacugcaauacaaccugucaaaccccuaaaggcgccauuaacacaagccugcccuuccagaauauccacccgauuacgaucggcaagugcccuaaguaugugaaaucuaccaagcucagacuggcuacagggcuucggaacguucccagcauucagucccgcggacuguuuggcgccaucgccggguucaucgagggaggcuggaccgggaugguggacggaugguacggcuaucaucaccagaaugaacaaggcucuggguacgcugcggaucucaaaagcacacagaacgccauugacgagaucaccaauaaggucaacuccgugauugagaaaaugaauacgcaguuuacagcuguuggaaaggaguucaaccaccuggagaagagaaucgaaaaucuuaacaaaaagguggaugacggcuuccuggauauuuggaccuacaaugcccagcuccugguccugcucgagaacgaacggacccuggacuaucaugauagcaaugugaaaaaccuuuacgagaagguccgcucucaacugaaaaacaaugccaaggagaucgggaacggauguuuugaguucuaucacaagugcgacaauacauguauggaauccgugaaaaacggcaccuacgauuauccuaaguacagcgaagaggcuaaacucaauagagaagagaucgacgggguuaagcuggagucuacacggauuuaucagauccuugccauuuacuccacgguggcgagcucccugguccucgugguuucucugggcgcuaucagcuuuuggaugugcuccaacggaucucugcagugccgcauuuguaucuga

SEQ ID NO: 187913 - RNA, 1701 nt, Artificial Sequence
  derived and/or modified sequence opt5 from hemagglutinin__InfluenzaA__ADG57091
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagagccucuaccagaacgcugacgccuacguguucgugggcuccagcagauauucuaaaaaguuuaaaccugagauugcuauccggccgaagguccgcgaucaggaagggagaaugaauuacuauuggacacugguugagcccggagacaaaauuaccuucgaagccacgggcaaccugguggugccucgguacgcguuugccauggagcgcaacgcuggguccggaaucauuaucagcgauacacccguccaugacugcaauaccacaugucaaaccccuaagggcgccaucaacaccucucuccccuuccacaauauucauccgaucacaauuggcaaaugcccuaaguauguuaagagcacgaaacugagacuugcuaccgggcugcggaacgugcccuccauccagucucgcggacucuuuggcgccauugccggguucaucgaaagaggauggacaggcaugguggacgggugguacggauaucaccaccagaaugagcagggcagcggcuacgcugcggaucugaaguccacccaaaacgccaucgacgagauuacaaauaaagucaacagcgugaucgaaaagaugaauacccaguuuacggcuguugggaaagaguucaaccaucuugaaaagcggauugagaaucugaacaagaaaguggaugacggauuccucgauaucuggacauacaaugccgaacugcugguccuccuggagaacgagcgcacccuugacuaucacgauucuaaugugaagaaccuguacgaaaaagucagaucccagcucaagaacaaugccaaagagauuggcaacggguguuuugaguucuaucauaagugcgacaauaccuguauggaaagcgugaagaacggaacauacgauuauccuaaauacucugaagaggcuaagcugaaucgggaggaaaucgacggcguuaaacuugaguccacccgcaucuaucagauucuggccaucuacagcacaguggcguccucucucguccuggugguuagccugggggcuauuuccuuuuggaugugcucuaacggcagccuccaaugcagaaucuguauuuga

SEQ ID NO: 187914 - RNA, 1701 nt, Artificial Sequence
  derived and/or modified sequence opt5 from hemagglutinin__InfluenzaA__ADG57092
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacugauuaaguccuauaucaaugacaaggggaaagaagugcuuguccuguggggcauucaccaccccagcaccuccgccgaucaacagucucucuaccagaacgcugacgccuacguguucgugggaacaagcagauauuccaagaaauuuaagccugagaucgcuauucggccgaaaguccgcgaucaggaggggagaaugaauuacuauuggacccugguugaacccggagacaagaucacguucgaggccacaggcaaccugguggugccucgguacgcguuugccauggaacgcaacgcugggagcggaauuaucaucucugauacccccguccaugacugcaauacaaccugucaaaccccuaaaggcgccauuaacacaucccuccccuuccagaauauccacccgauuacgaucggcaagugcccuaaguaugugaaaagcaccaagcugagacuugcuacagggcugcggaacguucccucuauucagagccgcggacucuuuggcgccaucgccggguucaucgagggaggcuggaccgggaugguggacggaugguacggcuaucaucaccagaaugaacaaggcuccggguacgcugcggaucugaaaucuacacagaacgccauugacgagaucaccaauaaggucaacagcgugauugagaaaaugaauacgcaguuuacagcuguuggaaaggaguucaaccaccuugagaagagaaucgaaaaucugaacaaaaagguggaugacggcuuccucgauauuuggaccuacaaugccgagcugcugguccuccuggaaaacgagcggacccuugacuaucaugauuccaaugugaaaaaccuguacgagaagguccgcagccagcucaaaaacaaugccaaggaaaucgggaacggauguuuugaguucuaucacaagugcgacaauacauguauggaaucugugaaaaacggcaccuacgauuauccuaaguacuccgaggaagcuaaacugaauagagaggagaucgacgggguuaaacuugaaagcacacggauuuaucaaauccuggccauuuacucuacgguggcguccagccucguccuggugguuucccugggcgcuaucucuuuuuggaugugcagcaacggaucccuccagugccgcauuuguaucuga

SEQ ID NO: 187915 - RNA, 1701 nt, Artificial Sequence
  derived and/or modified sequence opt5 from hemagglutinin__InfluenzaA__ADG57093
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggagauccuugugcuguggggcauucaccaccccuccaccucugccgaucaacagagccucuaccagaacgcugacgccuacgucuucgugugguccagcagauauucuaaaaaguuuaaaccugagaucgcuauucggccgaaggugcgcgaucaggaaggaagaaugaauuacuauuggacacuggucgagcccggggacaaaaucaccuucgaagccacgggaaaccugcucguuccucgguacgcguuugccauggagcgcaacgcuggcuccgggauuaucaucagcgauacacccgugcaugacugcaauaccacaugucaaaccccuaagggagccauuaacaccucucugcccuuccacaauauccauccgauuacaaucggcaaaugcccuaaguaugucaagagcacgaaacuuagacuggcuaccggccuccggaacgugcccuccauucagucucgcgggcuguuuggagccaucgccggcuucaucgaagggggauggacaggcaugguggacgggugguacggauaucaccaccagaaugagcagggcagcggcuacgcugcggaucuuaaguccacccaaaacgccauugacgagaucacaaauaaaguuaacagcgugauugaaaagaugaauacccaguuuacggcugucgggaaagaguucaaccaucuggaaaagagaaucgagaaucucaacaagaaaguggaugacggauuccuggauauuuggacauacaaugccgaacugcucguucugcuugagaacgagcggacccuggacuaucacgauucuaaugugaagaaccucuacgaaaaaguccgcucccagcugaagaacaaugccaaagagaucggcaacggguguuuugaguucuaucauaagugcgacaauaccuguauggaaagcgugaagaacggaacauacgauuauccuaaauacucugaagaggcuaaacuuaauagagaggaaaucgacggcgucaagcuggaguccacccggauuuaucagauccucgccauuuacagcacaguggcguccucucugguucugguggucagccucggggcuaucuccuuuuggaugugcucuaacggcagccugcaaugccgcauuuguaucuga

SEQ ID NO: 187916 - RNA, 1701 nt, Artificial Sequence
  derived and/or modified sequence opt5 from hemagglutinin__InfluenzaA__ADG57094
augaaggccauccuggugguccuccuguacaccuucgcuacagccaacgcggacacgcuuugcguuggcuaucacgcuaauaacagcaccgauacaguggacaccgugcuggagaagaaugucacagugacccauuccguuaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauugucgagaccuccucuagcgacaacggcacgugcuauccgggggauuuuaucgacuacgaagaacugcgggagcagcuuuccagcgugucuuccuucgaacgcuuugagauuuuccccaagaccagcucuuggccuaaucacgauuccaacaagggaguuacagccgcuuguccccaugccggcgcgaaaucuuuuuauaagaaucugaucuggcucgugaaaaagggcaacagcuacccuaaacuguccaagagcuauaucaaugacaaggggaaagaaguccuugugcuguggggcauucaccaccccuccaccucugccgaucaacagagccucuaccagaacgcugacgccuacguguucgucggaacauccagauauagcaagaaauuuaagccugagaucgcuauucggccgaaaguucgcgauagagaggggcggaugaauuacuauuggacccugguggaacccggagacaagaucacguucgaggccacaggcaaccugguggucccucgcuacgcguuugccauggaaagaaacgcugggucuggaauuaucauuuccgauacccccgugcaugacugcaauacaaccugucagaccccuaaaggcgccaucaacacaagccuccccuuccaaaauauccacccgauuacgaucggcaagugcccuaaguauguuaaaucuaccaagcugcggcuugcuacagggcugcgcaacgugcccagcauucaguccagaggacucuuuggcgccaucgccggguucauugagggaggcuggaccgggauggucgacggaugguacggcuaucaucaccagaaugaacagggcucuggguacgcugcggaucugaaaagcacacaaaacgccaucgacgagaucaccaauaaggugaacuccguuauugagaaaaugaauacgcaguuuacagcugugggaaaggaguucaaccaccuugagaagcggaucgaaaaucugaacaaaaaggucgaugacggcuuccucgauauuuggaccuacaaugccgagcugcuggugcuccuggaaaacgagcgcacccuugacuaucaugauagcaaugucaaaaaccuguacgagaaggugagaucucagcucaaaaacaaugccaaggaaaucgggaacggauguuuugaguucuaucacaagugcgacaauacauguauggaauccguuaaaaacggcaccuacgauuauccuaaguacagcgaggaagcuaaacugaaucgggaggagauugacggggugaaacuugaaucuacacgcaucuaucagauccuggccauuuacuccacggucgcgagcucccucgugcugguugugucucugggcgcuaucagcuuuuggaugugcuccaacggaucucuccaaugcagaauuuguaucuga

SEQ ID NO: 187917 - RNA, 1701 nt, Artificial Sequence; identical to SEQ ID NO: 185693
  derived and/or modified sequence opt5 from hemagglutinin__InfluenzaA__ADG57095

SEQ ID NO: 187918 - RNA, 1701 nt, Artificial Sequence
  derived and/or modified sequence opt5 from hemagglutinin__InfluenzaA__ADG57097
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagagccucuaccagaacgcugacgccuacguguucgugggcuccagcagauauucuaaaaaguuuaaaccugagauugcuauccggccgaagguccgcgggcaggaaggaagaaugaauuacuauuggacacugguugagcccggcgauaaaauuaccuucgaagccacggggaaccugguggugccucgguacgcguuugccauggagcgcaacgcuggauccggcaucauuaucagcgacacacccguccaugauugcaauaccacaugucaaaccccuaagggcgccaucaacaccucucuccccuuccacaauauucauccgaucacaauugggaaaugcccuaaguauguuaagagcacgaaacugagacuugcuaccggacugcggaacgugcccuccauccagucucgcggccucuuuggggccauugccggauucaucgaaggcggguggacaggaaugguggacggcugguacggcuaucaccaccagaaugagcaggggagcggauacgcugcggaccugaaguccacccaaaacgccaucgaugagauuacaaauaaagucaacagcgugaucgaaaagaugaauacccaguuuacggcuguuggcaaagaguucaaccaucuugaaaagagaauugagaaucugaacaagaaaguggacgauggguuccucgacaucuggacauacaaugccgaacugcugguccuccuggagaacgagcggacccuugauuaucacgacucuaaugugaagaaccuguacgaaaaaguccgcucccagcucaagaacaaugccaaagagauuggaaacggcuguuuugaguucuaucauaagugcgauaauaccuguauggaaagcgugaagaacgggacauacgacuauccuaaauacucugaagaggcuaagcugaauagagaggaaaucgauggcguuaaacuugaguccacccggaucuaucagauucuggccaucuacagcacaguggcguccucucucguccuggugguuagccugggagcuauuuccuuuuggaugugcucuaacggcagccuccaaugccgcaucuguauuuga

SEQ ID NO: 187919 - RNA, 1701 nt, Artificial Sequence; identical to SEQ ID NO: 186857
  derived and/or modified sequence opt5 from hemagglutinin__InfluenzaA__ADG57098

SEQ ID NO: 187920 - RNA, 1701 nt, Artificial Sequence
  derived and/or modified sequence opt5 from hemagglutinin__InfluenzaA__ADG57099
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuaccauuggacccugguugaacccggagacaagauuacguucgaggccacaggcaaccugguggugccucgguaugcguuugccauggaacgcaacgcugggucuggaaucauuaucaccgauacacccguccacgacugcaauaccaccugucaaacaccuaaaggcgccgugaacacgucccuccccuuccagaauauccauccgauuaccaucggcaagugcccuaaguacguuaaaagcacaaagcugagacuugcuaccgggcugcggaacgugcccucuauucagagccgcggacucuuuggcgccaucgccggguucauugagggaggcuggacagggauggucgacggaugguauggcuaccaccaccagaaugaacaaggcuccggguaugcugcggaucugaaaucuacccagaacgccaucgacaagaucacgaauaaagugaacagcguuauugagaagaugaauacacaguuuaccgcugugggaaaggaguucaaccaucuugagaaaagaaucgagaaucugaacaagaaagucgaugacggcuuccucgauauuuggaccuacaaugccgaacugcuggugcuccuggagaacgaacggacacuugacuaccacgauuccaaugucaagaaccuguaugagaaagugcgcagccagcucaagaacaaugccaaggagaucgggaacggauguuuugaguucuaccauaaaugcgacaauaccuguauggaaucuguuaagaacggcacauaugauuacccuaaauauuccgaagaggcuaagcugaauagagaagagauugacggggugaaacuugagagcacgcggaucuaccaaauccuggccauuuauucuaccgucgcguccagccucgugcugguugugucccugggcgcuaucucuuuuuggaugugcagcaacggaucccuccagugccgcauuuguaucuga

SEQ ID NO: 187921 - RNA, 1701 nt, Artificial Sequence
  derived and/or modified sequence opt5 from hemagglutinin__InfluenzaA__ADG57100
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacaagauuaccaauaaagucaacuccgugaucgagaagaugaauacgcaguuuacagcuggaggcaaggaguucaaccaccuugagaaaagaauugagaaucugaacaagaaaguugaugacggguuccucgauaucuggaccuacaaugccgaacugcuggugcuccuggagaacgaacggacccuugacuaucaugauagcaaugucaagaaccuguacgagaaagugcgcucucagcucaagaacaaugccaaggagauuggaaacggcuguuuugaguucuaucacaaaugcgacaauacauguauggaauccgucaagaacgggaccuacgauuauccuaaauacagcgaagaggcuaagcugaauagagaagagaucgacggcgugaaacuugagucuacacggaucuaucaaauucuggccaucuacuccacgguugcgagcucccucgugcuggucgugucucugggagcuauuagcuuuuggaugugcuccaacggcucucuccagugccgcaucuguauuuga

SEQ ID NO: 187922 - RNA, 1701 nt, Artificial Sequence; identical to SEQ ID NO: 185693
  derived and/or modified sequence opt5 from hemagglutinin__InfluenzaA__ADG58939

SEQ ID NO: 187923 - RNA, 1701 nt, Artificial Sequence; identical to SEQ ID NO: 185693
  derived and/or modified sequence opt5 from hemagglutinin__InfluenzaA__ADG58940

SEQ ID NO: 187924 - RNA, 1701 nt, Artificial Sequence
  derived and/or modified sequence opt5 from hemagglutinin__InfluenzaA__ADG58941
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacacauacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucacgaaaaugagcagggcucuggguacgccgcugaucugaaaagcacccaaaacgcgaucgacgagauuacgaauaaggucaacuccgugaucgaaaagaugaauacacaguuuaccgccguuggaaaggaguucaaccaccuugaaaagagaauugagaaucugaacaaaaagaucgaugacggcuuccucgauauuuggaccuacaaugcugaacugcuggugcuccuggagaacgagcggacacuugacuaucaugauagcaaugucaaaaaccuguacgaaaaggugcgcucucagcucaaaaacaaugccaaggagaucgggaacggauguuuugaguucuaucacaagugcgacaauaccuguauggaguccgucaaaaacggcacauacgauuauccuaaguacagcgaagaggccaaacugaauagagaggaaaucgacggggugaaacuugagucuacgcggauuuaucagauccuggcuauuuacuccaccguugccagcucccucgugcuggucgugucucugggcgcgaucagcuuuuggaugugcuccaacggaucucuccaaugccgcauuuguaucuga

SEQ ID NO: 187925 - RNA, 1701 nt, Artificial Sequence
  derived and/or modified sequence opt5 from hemagglutinin__InfluenzaA__ADG58942
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacacauacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucugcaucagaaugaacaaggcucuggguacgccgcugaucuuaaaagcacccagaacgcgaucgacgagauuacgaauaaggucaacuccgugaucgagaaaaugaauacacaguuuaccgccguuggaaaggaguucaaccaccuggagaagagaauugaaaaucucaacaaaaagaucgaugacggcuuccuggauauuuggaccuacaaugcugagcugcucgugcugcuugaaaacgagcggacacuggacuaucacgauagcaaugucaaaaaccucuacgagaaggugcgcucucagcugaaaaacaaugccaaggaaaucgggaacggauguuuugaguucuaucauaagugcgacaauaccuguauggaauccgucaaaaacggcacauacgauuauccuaaguacagcgaggaagccaaacuuaauagagaggagaucgacggggugaagcuggaaucuacgcggauuuaucaaauccucgcuauuuacuccaccguugccagcucccuggugcuggucgugucucucggcgcgaucagcuuuuggaugugcuccaacggaucucugcagugccgcauuuguaucuga

SEQ ID NO: 187926 - RNA, 1701 nt, Artificial Sequence; identical to SEQ ID NO: 185693
  derived and/or modified sequence opt5 from hemagglutinin__InfluenzaA__ADG58943

SEQ ID NO: 187927 - RNA, 1701 nt, Artificial Sequence
  derived and/or modified sequence opt5 from hemagglutinin__InfluenzaA__ADG58944
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugcucgugccucgguacgcguuugccauggaacgcaacgcugggucuggaaucauuaucuccgauacccccgugcaugacugcaauacaaccugucaaaccccuaaaggcgccaucaacacaagccugcccuuccagaauauucacccgaucacgauuggcaagugcccuaaguaugucaaaucuaccaaacuuagacuggcuacagggcuccggaacgugcccagcauccagucccgcggacuguuuggcgccauugccggguucaucgagggaggcuggaccgggaugguugacggaugguacggcuaucaucaccagaaugaacaaggcucuggguacgcugcggaucuuaagagcacacagaacgccaucgacgagauuaccaauaaggugaacuccgucaucgagaaaaugaauacgcaguuuacagcugugggaaaggaguucaaccaccuggagaagagaauugaaaaucucaacaaaaagguugaugacggcuuccuggauaucuggaccuacaaugccgagcugcucgugcugcuugaaaacgagcggacccuggacuaucaugauagcaaugucaaaaaccucuacgagaaggugcgcucucagcugaaaaacaaugccaaggaaauugggaacggauguuuugaguucuaucacaagugcgacaauacauguauggaauccgucaaaaacggcaccuacgauuauccuaaguacagcgaggaagcuaaacuuaauagagaggagaucgacggggugaagcuggaaucuacacggaucuaucaaauucucgccaucuacuccacgguugcgagcucccuggugcuggucgugucucucggcgcuauuagcuuuuggaugugcuccaacggaucucugcagugccgcaucuguauuuga

SEQ ID NO: 187928 - RNA, 1701 nt, Artificial Sequence; identical to SEQ ID NO: 186491
  derived and/or modified sequence opt5 from hemagglutinin__InfluenzaA__ADG58946

SEQ ID NO: 187929 - RNA, 1701 nt, Artificial Sequence; identical to SEQ ID NO: 185693
  derived and/or modified sequence opt5 from hemagglutinin__InfluenzaA__ADG58947

SEQ ID NO: 187930 - RNA, 1701 nt, Artificial Sequence
  derived and/or modified sequence opt5 from hemagglutinin__InfluenzaA__ADG58948
augaaggccauccugauugugcuccuguacaccuucgcuacagccaacgcggacacgcuuugcaucggcuaucacgcuaauaacagcaccgauacagucgacaccguucuggagaagaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccaagagcuauaucaaugacaaggggaaagaaguucuugugcuguggggcauucaccaccccuccaccucugccgaucaacagagccucuaccagaacgcugacacauacgucuucgugggaaccuccagauauagcaagaaauuuaagccugagaucgccauucggccgaaagugcgcgaucaggaggggagaaugaauuacuauuggacgcuggucgaacccggagacaagaucacauucgaggcuaccggcaaccugguugugccucgguacgccuuugcgauggaacgcaacgccgggucuggaauuaucaucuccgauacacccgugcaugacugcaauaccaccugucaaacaccuaaaggcgcuauuaacacgagccuccccuuccagaauauccacccgauuaccaucggcaagugcccuaaguaugucaaaucuacaaagcugagacuugccaccgggcugcggaacgugcccagcauucagucccgcggacucuuuggcgcuaucgccggguucaucgagggaggcuggacagggaugguugacggaugguacggcuaucaucaccagaaugaacaaggcucuggguacgccgcugaucugaaaagcacccagaacgcgauugacgagaucacgaauaaggugaacuccgucauugagaaaaugaauacacaguuuaccgccgugggaaaggaguucaaccaccuugagaagagaaucgaaaaucugaacaaaaagauugaugacggcuuccucgauaucuggaccuacaaugcugagcugcugguucuccuggaaaacgagcggacacuugacuaucaugauagcaaugugaaaaaccuguacgagaagguccgcucucagcucaaaaacaaugccaaggaaaucgggaacggauguuuugaguucuaucacaagugcgacaauaccuguauggaauccgugaaaaacggcacauacgauuauccuaaguacagcgaggaagccaaacugaauagagaggagauugacggggucaaacuugaaucuacgcggaucuaucaaauucuggcuaucuacuccaccguggccagcucccucguucugguggucucucugggcgcgauuagcuuuuggaugugcuccaacggaucucuccagugccgcaucuguauuuga

SEQ ID NO: 187931 - RNA, 1701 nt, Artificial Sequence
  derived and/or modified sequence opt5 from hemagglutinin__InfluenzaA__ADG58949
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacacauacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacaagcguccaugacugcaauaccaccugucaaacacccaaaggcgcuaucaacacgucucucccuuuccagaauauucaccccaucaccauuggcaagugcccgaaguaugugaaaagcacaaagcugagacuugccaccgggcugcggaacguuccuuccauccagucucgcggacucuuuggcgcuauugccggguucaucgagggaggcuggacagggaugguggacggaugguacggcuaucaucaccagaaugaacaaggcagcggguacgccgcugaucugaaauccacccagaacgcgaucgacgagauuacgaauaaggucaacagcgugaucgagaaaaugaauacacaguuuaccgccguuggaaaggaguucaaccaccuugagaagagaauugaaaaucugaacaaaaagaucgaugacggcuuccucgauauuuggaccuacaaugcugagcugcuggugcuccuggaaaacgagcggacacuugacuaucaugauucuaaugucaaaaaccuguacgagaaggugcgcucccagcucaaaaacaaugccaaggaaaucgggaacggauguuuugaguucuaucacaagugcgacaauaccuguauggaaagcgucaaaaacggcacauacgauuaucccaaguacucugaggaagccaaacugaauagagaggagaucgacggggugaaacuugaauccacgcggauuuaucaaauccuggcuauuuacagcaccguugccuccucucucgugcuggucgugagccugggcgcgaucuccuuuuggaugugcucuaacggaagccuccagugccgcauuuguaucuga

SEQ ID NO: 187932 - RNA, 1701 nt, Artificial Sequence
  derived and/or modified sequence opt5 from hemagglutinin__InfluenzaA__ADG58951
augaaggccauccuggugguccuccugcacaccuucgcuacagccaacgcggacacgcuuugcauuggcuaccaugcuaauaacagcaccgauacaguugacaccgugcuggagaaaaaugugacagucacccacuccgugaaccuccuggaagauaagcauaaugggaaacuuuguaagcugagaggaguugcuccccuccaccugggcaaaugcaacaucgccggguggauucugggaaauccugagugugaaucucucagcacagccuccucuuggagcuauaucguggagaccuccaacucuggcaaugggacgugcuacccgggagaauuuauugacuaugaggagcugcgggaacagcuuagcuccgucagcucuuucgagcgcuuugaaaucuuccccaagaccuccagcuggccuaaccaugauucuaauaagggcgugacagccgcuuguccccacgccggcgcgaaauccuuuuacaagaaccugaucuggcucguuaaaaaggggaauagcuauccuaaacugucuaaguccuacauuaacgacaagggaaaagaggugcuuguccuguggggcauccaccaucccagcaccuccgccgaucaacagucucucuaucagaaugcugacgccuacguguucguggggacaagcagauacuccaagaaauuuaagccugagauugcuauccggccgaaaguccgcgaucaggaaggaagaaugaacuauuacuggacccugguugagcccggcgacaagauuacguucgaagccacagggaaccugguggugccucgguaugcguuugccauggagcgcaaugcuggaagcggcaucauuaucucugauacccccguccacgacugcaacacaaccugucaaaccccuaaaggcgccaucaauacaucccuccccuuccagaacauucauccgaucacgauugggaagugcccuaaguacgugaaaagcaccaagcugagacuugcuacaggacugcggaauguucccucuauccagagccgcggccucuuuggggccauugccggauucaucgaaggcggguggaccggaaugguggauggcugguauggcuaccaccaccagaacgagcaaggguccggauaugcugcggaccugaaaucuacacagaaugccaucgacgagauuaccaacaaggucaauagcgugaucgaaaagaugaacacgcaguuuacagcuguuggcaaggaguucaaucaucuugaaaagagaauugagaaccugaauaaaaagguggaugacggguuccucgauaucuggaccuacaacgccgaacugcugguccuccuggagaaugagcggacccuugacuaccacgauuccaacgugaaaaaccuguaugaaaagguccgcagccagcucaaaaauaacgccaaggagauuggaaauggcuguuuugaguucuaccauaagugcgacaacacauguaucgaaucugugaaaaaugggaccuaugauuacccuaaguauuccgaagaggcuaaacugaacagagaggaaaucgacggcguuaaacuugagagcacacggauuuaccaaauccuggccauuuauucuacgguggcguccagccucguccuggugguuucccugggagcuaucucuuuuuggaugugcagcaauggcucccuccagugccgcauuuguaucuga

SEQ ID NO: 187933 - RNA, 1701 nt, Artificial Sequence; identical to SEQ ID NO: 187932
  derived and/or modified sequence opt5 from hemagglutinin__InfluenzaA__ADG58952

SEQ ID NO: 187934 - RNA, 1701 nt, Artificial Sequence; identical to SEQ ID NO: 187932
  derived and/or modified sequence opt5 from hemagglutinin__InfluenzaA__ADG58953

SEQ ID NO: 187935 - RNA, 1701 nt, Artificial Sequence; identical to SEQ ID NO: 187932
  derived and/or modified sequence opt5 from hemagglutinin__InfluenzaA__ADG58954

SEQ ID NO: 187936 - RNA, 1701 nt, Artificial Sequence; identical to SEQ ID NO: 187932
  derived and/or modified sequence opt5 from hemagglutinin__InfluenzaA__ADG58955

SEQ ID NO: 187937 - RNA, 1701 nt, Artificial Sequence; identical to SEQ ID NO: 187932
  derived and/or modified sequence opt5 from hemagglutinin__InfluenzaA__ADG58956

SEQ ID NO: 187938 - RNA, 1701 nt, Artificial Sequence
  derived and/or modified sequence opt5 from hemagglutinin__InfluenzaA__ADG58957
augaaggccauccuggugguccuccugcacaccuucgcuacagccaacgcggacacgcuuugcauuggcuaccaugcuaauaacagcaccgauacaguugacaccgugcuggagaaaaaugugacagucacccacuccgugaaccuccuggaagauaagcauaaugggaaacuuuguaagcugagaggaguugcuccccuccaccugggcaaaugcaacaucgccggguggauucugggaaauccugagugugaaucucucagcacagccuccucuuggagcuauaucguggagaccuccaacucuggcaaugggacgugcuacccgggagaauuuauugacuaugaggagcugcgggaacagcuuagcuccgucagcucuuucgagcgcuuugaaaucuuccccaagaccuccagcuggccuaaccaugauucuaauaagggcgugacagccgcuuguccccacgccggcgcgaaauccuuuuacaagaaccugaucuggcucguuaaaaaggggaauagcuauccuaaacugucuaaguccuacauuaacgacaagggaaaagaggugcuuguccuguggggcauccaccaucccagcaccuccgccgaucaacagucucucuaucagaaugcugacgccuacguguucguggggacaagcagauacuccaagaaauuuaagccugagauugcuauccggccgaaaguccgcgaucaggaaggaagaaugaacuauuacuggacccugguugagcccggcgacaagauuacguucgaagccacagggaaccugguggugccucgguaugcguuugccauggagcgcaaugcuggaagcggcaucauuaucucugauacccccguccacgacugcaacacaaccugucaaaccccuaaaggcgccaucaauacaucccuccccuuccagaacauucauccgaucacgauugggaagugcccuaaguacgugaaaagcaccaagcugagacuugcuacaggacugcggaauguucccucuauccagagccgcggccucuuuggggccauugccggauucaucgaaggcggguggaccggaaugguggauggcugguauggcuaccaccaccagaacgagcaaggguccggauaugcugcggaccugaaaucuacacagaaugccaucgacgagauuaccaacaaggucaauagcgugaucgaaaagaugaacacgcaguuuacagcuguuggcaaggaguucaaucaucuugaaaagagaauugagaaccugaauaaaaagguggaugacggguuccucgauaucuggaccuacaacgccgaacugcugguccuccuggagaaugagcggacccuugacuaccacgauuccaacgugaaaaaccuguaugaaaagguccgcagccagcucaaaaauaacgccaaggagauuggaaauggcuguuuugaguucuaccauaagugcgacaacacauguauggaaucugugaaaaaugggaccuaugauuacccuaaguauuccgaagaggcuaaacugaacagagaggaaaucgacggcguuaaacuugagagcacacggaucuaccaaauucuggccaucuauucuacgguggcguccagccucguccuggugguuucccugggagcuauuucuuuuuggaugugcagcaauggcucccuccagugccgcaucuguauuuga

SEQ ID NO: 187939 - RNA, 1701 nt, Artificial Sequence
  derived and/or modified sequence opt5 from hemagglutinin__InfluenzaA__ADG58959
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccaacuccuggucuuacaucguggagaccagcuccucugacaauggcacgugcuauccgggggauuuuauugacuacgaagaacugcgggagcagcuuagcuccgucagcucuuucgaacgcuuugagaucuuccccaagaccuccagcuggccuaaccacgauucuaauaagggagugacagccgcuuguccccaugccggcgcgaaauccuuuuauaagaaccugaucuggcucguuaaaaagggcaauagcuacccuaaacugucuaaguccuauauuaacgacaaggggaaagaagugcuuguccuguggggaauccaccaccccagcaccuccgccgaucaacagucucucuaccagaaugcugacgccuacguguucgugggcacaagcagauauuccaagaaauuuaagccugagauugcuauccggccgaaaguccgcgaucaggaggggagaaugaacuacuauuggacccugguugaacccggagacaagauuacguucgaggccacaggcaaccugguggugccucgguacgcguuugccauggaacgcaaugcugggagcggaaucauuaucucugauacccccguccaugacugcaacacaaccugucaaaccccuaaaggcgccaucaauacaucccuccccuuccagaacauucacccgaucacgauuggcaagugcccuaaguaugugaaaagcaccaagcugagacuugcuacagggcugcggaauguucccucuauccagagccgcggacucuuuggcgccauugccggguucaucgagggaggcuggaccgggaugguggacggaugguacggcuaucaucaccagaacgaacaaggcuccggguacgcugcggaucugaaaucuacacagaaugccaucgacgagauuaccaacaaggucaauagcgugaucgagaaaaugaacacgcaguuuacagcuguuggaaaggaguucaaucaccuugagaagagaauugaaaaccugaauaaaaagguggaugacggcuuccucgauaucuggaccuacaacgccgagcugcugguccuccuggaaaaugagcggacccuugacuaucaugauuccaacgugaaaaaccuguacgagaagguccgcagccagcucaaaaauaacgccaaggaaauugggaauggauguuuugaguucuaucacaagugcgacaacacauguauggaaucugugaaaaauggcaccuacgauuauccuaaguacuccgaggaagcuaaacugaacagagaggagaucgacgggguuaaacuugaaagcacacggaucuaucaaauucuggccaucuacucuacgguggcguccagccucguccuggugguuucccugggcgcuauuucuuuuuggaugugcagcaauggaucccuccagugccgcaucuguauuuga

SEQ ID NO: 187940 - RNA, 1701 nt, Artificial Sequence; identical to SEQ ID NO: 187857
  derived and/or modified sequence opt5 from hemagglutinin__InfluenzaA__ADG58960

SEQ ID NO: 187941 - RNA, 1701 nt, Artificial Sequence; identical to SEQ ID NO: 187857
  derived and/or modified sequence opt5 from hemagglutinin__InfluenzaA__ADG58961

SEQ ID NO: 187942 - RNA, 1701 nt, Artificial Sequence; identical to SEQ ID NO: 187857
  derived and/or modified sequence opt5 from hemagglutinin__InfluenzaA__ADG58962

SEQ ID NO: 187943 - RNA, 1701 nt, Artificial Sequence; identical to SEQ ID NO: 187857
  derived and/or modified sequence opt5 from hemagglutinin__InfluenzaA__ADG58963

SEQ ID NO: 187944 - RNA, 1701 nt, Artificial Sequence; identical to SEQ ID NO: 187857
  derived and/or modified sequence opt5 from hemagglutinin__InfluenzaA__ADG58964

SEQ ID NO: 187945 - RNA, 1701 nt, Artificial Sequence; identical to SEQ ID NO: 187857
  derived and/or modified sequence opt5 from hemagglutinin__InfluenzaA__ADG58965

SEQ ID NO: 187946 - RNA, 1701 nt, Artificial Sequence; identical to SEQ ID NO: 187857
  derived and/or modified sequence opt5 from hemagglutinin__InfluenzaA__ADG58966

SEQ ID NO: 187947 - RNA, 1701 nt, Artificial Sequence; identical to SEQ ID NO: 187857
  derived and/or modified sequence opt5 from hemagglutinin__InfluenzaA__ADG58967

SEQ ID NO: 187948 - RNA, 1701 nt, Artificial Sequence; identical to SEQ ID NO: 187857
  derived and/or modified sequence opt5 from hemagglutinin__InfluenzaA__ADG58968

SEQ ID NO: 187949 - RNA, 1701 nt, Artificial Sequence; identical to SEQ ID NO: 185693
  derived and/or modified sequence opt5 from hemagglutinin__InfluenzaA__ADG59628

SEQ ID NO: 187950 - RNA, 1701 nt, Artificial Sequence; identical to SEQ ID NO: 185693
  derived and/or modified sequence opt5 from hemagglutinin__InfluenzaA__ADG59629

SEQ ID NO: 187951 - RNA, 1701 nt, Artificial Sequence; identical to SEQ ID NO: 185693
  derived and/or modified sequence opt5 from hemagglutinin__InfluenzaA__ADG59630

SEQ ID NO: 187952 - RNA, 1701 nt, Artificial Sequence; identical to SEQ ID NO: 185693
  derived and/or modified sequence opt5 from hemagglutinin__InfluenzaA__ADG59631

SEQ ID NO: 187953 - RNA, 1701 nt, Artificial Sequence; identical to SEQ ID NO: 185693
  derived and/or modified sequence opt5 from hemagglutinin__InfluenzaA__ADG59632

SEQ ID NO: 187954 - RNA, 1701 nt, Artificial Sequence; identical to SEQ ID NO: 186794
  derived and/or modified sequence opt5 from hemagglutinin__InfluenzaA__ADG59633

SEQ ID NO: 187955 - RNA, 1701 nt, Artificial Sequence; identical to SEQ ID NO: 186794
  derived and/or modified sequence opt5 from hemagglutinin__InfluenzaA__ADG59634

SEQ ID NO: 187956 - RNA, 1701 nt, Artificial Sequence; identical to SEQ ID NO: 185693
  derived and/or modified sequence opt5 from hemagglutinin__InfluenzaA__ADG59635

SEQ ID NO: 187957 - RNA, 1701 nt, Artificial Sequence
  derived and/or modified sequence opt5 from hemagglutinin__InfluenzaA__ADG59636
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgggcaggagggaagaaugaauuacuauuggacccugguugaacccggcgauaagauuacguucgaggccacagggaaccugguggugccucgguacgcguuugccauggaacgcaacgcuggaucuggcaucauuaucuccgacacccccguccaugauugcaauacaaccugucaaaccccuaaaggcgccaucaacacaagccuccccuuccagaauauucacccgaucacgauugggaagugcccuaaguaugugaaaucuaccaagcugagacuugcuacaggacugcggaacauccccagcauucagucccgcggccucuuuggggccaucgccggauucaucgagggcggguggaccggaaugguugacggcugguacggcuaucaucaccagaaugaacaagggucuggauacgcugcggaccugaaaagcacacagaacgccauugaugagaucaccaauaaggugaacuccgucauugagaaaaugaauacgcaguuuacagcugugggcaaggaguucaaccaccuugagaagagaaucgaaaaucugaacaaaaagguugacgauggguuccucgacauuuggaccuacaaugccgagcugcuggugcuccuggaaaacgagcggacccuugauuaucaugacagcaaugucaaaaaccuguacgagaaggugcgcucucagcucaaaaacaaugccaaggaaaucggaaacggcuguuuugaguucuaucacaagugcgauaauacauguauggaauccgucaaaaacgggaccuacgacuauccuaaguacagcgaggaagcuaaacugaauagagaggagaucgauggcgugaaacuugaaucuacacggauuuaucaaauccuggccauuuacuccacgguugcgagcucccucgugcuggucgugucucugggagcuaucagcuuuuggaugugcuccaacggcucucuccagugccgcauuuguaucuga

SEQ ID NO: 187958 - RNA, 1701 nt, Artificial Sequence; identical to SEQ ID NO: 186441
  derived and/or modified sequence opt5 from hemagglutinin__InfluenzaA__ADG59638

SEQ ID NO: 187959 - RNA, 1701 nt, Artificial Sequence; identical to SEQ ID NO: 186794
  derived and/or modified sequence opt5 from hemagglutinin__InfluenzaA__ADG59639

SEQ ID NO: 187960 - RNA, 1701 nt, Artificial Sequence; identical to SEQ ID NO: 186046
  derived and/or modified sequence opt5 from hemagglutinin__InfluenzaA__ADG59641

SEQ ID NO: 187961 - RNA, 1701 nt, Artificial Sequence; identical to SEQ ID NO: 186536
  derived and/or modified sequence opt5 from hemagglutinin__InfluenzaA__ADG59643

SEQ ID NO: 187962 - RNA, 1701 nt, Artificial Sequence; identical to SEQ ID NO: 185680
  derived and/or modified sequence opt5 from hemagglutinin__InfluenzaA__ADG59644

SEQ ID NO: 187963 - RNA, 1701 nt, Artificial Sequence; identical to SEQ ID NO: 185693
  derived and/or modified sequence opt5 from hemagglutinin__InfluenzaA__ADG59646

SEQ ID NO: 187964 - RNA, 1701 nt, Artificial Sequence; identical to SEQ ID NO: 186794
  derived and/or modified sequence opt5 from hemagglutinin__InfluenzaA__ADG59647

SEQ ID NO: 187965 - RNA, 1701 nt, Artificial Sequence; identical to SEQ ID NO: 186857
  derived and/or modified sequence opt5 from hemagglutinin__InfluenzaA__ADG59648

SEQ ID NO: 187966 - RNA, 1701 nt, Artificial Sequence; identical to SEQ ID NO: 186857
  derived and/or modified sequence opt5 from hemagglutinin__InfluenzaA__ADG59649

SEQ ID NO: 187967 - RNA, 1701 nt, Artificial Sequence; identical to SEQ ID NO: 186857
  derived and/or modified sequence opt5 from hemagglutinin__InfluenzaA__ADG59650

SEQ ID NO: 187968 - RNA, 1701 nt, Artificial Sequence; identical to SEQ ID NO: 186857
  derived and/or modified sequence opt5 from hemagglutinin__InfluenzaA__ADG59651

SEQ ID NO: 187969 - RNA, 1701 nt, Artificial Sequence; identical to SEQ ID NO: 185693
  derived and/or modified sequence opt5 from hemagglutinin__InfluenzaA__ADG59652

SEQ ID NO: 187970 - RNA, 1701 nt, Artificial Sequence; identical to SEQ ID NO: 185693
  derived and/or modified sequence opt5 from hemagglutinin__InfluenzaA__ADG59653

SEQ ID NO: 187971 - RNA, 1701 nt, Artificial Sequence; identical to SEQ ID NO: 187957
  derived and/or modified sequence opt5 from hemagglutinin__InfluenzaA__ADG59655

SEQ ID NO: 187972 - RNA, 1701 nt, Artificial Sequence; identical to SEQ ID NO: 186794
  derived and/or modified sequence opt5 from hemagglutinin__InfluenzaA__ADG59656

SEQ ID NO: 187973 - RNA, 1701 nt, Artificial Sequence
  derived and/or modified sequence opt5 from hemagglutinin__InfluenzaA__ADG59657
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcaaguauucuaaaaaguuuaaaccugagauugcuaucagaccgaagguccgggaucaggaggggcgcaugaauuacuauuggacacugguugaacccggagacaaaauuaccuucgaggccacgggcaaccugguggugccuagauacgcguuugccauggaacggaacgcuggguccggaaucauuaucagcgauacacccguccaugacugcaauaccacaugucaaaccccuaagggcgccaucaacaccucucuccccuuccagaauauucacccgaucacaauuggcaagugcccuaaauauguuaagagcacgaaacugcgccuugcuaccgggcugagaaacgugcccuccacacagucucggggacucuuuggcgccaucgccggguucauugagggaggcuggaccgggaugguggacggaugguacggcuaucaucaccagaaugaacaaggcagcggguacgcugcggaucugaaguccacacagaacgccaucgacgagaucaccaauaaagucaacagcgugauugagaagaugaauacgcaguuuacagcuguuggaaaggaguucaaccaccuugagaaacgcaucgaaaaucugaacaagaaaguggaugacggcuuccucgauauuuggaccuacaaugccgagcugcugguccuccuggaaaacgagagaacccuugacuaucaugauucuaaugugaagaaccuguacgagaaaguccggucccagcucaagaacaaugccaaggaaaucgggaacggauguuuugaguucuaucacaaaugcgacaauacauguauggaaagcgugaagaacggcaccuacgauuauccuaaauacucugaggaagcuaagcugaaucgcgaggagauugacgggguuaaacuugaauccacaagaaucuaucaaauccuggccauuuacagcacgguggcguccucucucguccuggugguuagccugggcgcuaucuccuuuuggaugugcucuaacggaagccuccagugccggauuuguaucuga

SEQ ID NO: 187974 - RNA, 1701 nt, Artificial Sequence
  derived and/or modified sequence opt5 from hemagglutinin__InfluenzaA__ADG59658
augaaggccauccuggugguccuccuguacaccuucgcuacagccaacgcggacacgcuuugcauuggcuaucacgcuaauaacagcaccgauacaaucgacaccguucuggagaagaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccaagagcuauaucaaugacaaggggaaagaaguucuugugcuguggggcauucaccaccccuccaccucugccgaucaacagagccucuaccagaacgcugacgccuacgucuucgugggaacauccagauauagcaagaaauuuaagccugagaucgcuauucggccgaaagugcgcaaucaggaggggagaaugaacuacuauuggacccuggucgaacccggagauaagaucacguucgaggccacaggcaaccugguugugccucgguacgcguuugccauggaacgcaaugcugggucuggaauuaucaucuccgacacccccgugcaugauugcaacacaaccugucaaaccccuaaaggcgccauuaauacaagccuccccuuccagaacauccacccgauuacgaucggcaagugcccuaaguaugucaaaucuaccaagcugagacuugcuacagggcugcggaauauucccagcauccagucccgcggacucuuuggcgccaucgccggguucauugagggaggcuggaccgggaugguggacggaugguacggcuaucaucaccagaacgaacaaggcucuggguacgcugcggaccugaaaagcacacagaaugccaucgaugagauuaccaacaagguuaauuccgugaucgagaaaaugaacacgcaguuuacagcugucggaaaggaguucaaucaccuugagaagagaauugaaaaccugaauaaaaagguggacgauggcuuccucgacaucuggaccuacaacgccgagcugcugguucuccuggaaaaugagcggacccuugauuaucaugacagcaacgugaaaaaccuguacgagaagguccgcucucagcucaaaaauaacgccaaggaaaucgggaauggauguuuugaguucuaucacaagugcgauaacacauguauggaauccgugaaaaauggcaccuacgacuauccuaaguacagcgaggaagcuaaacugaacagagaggagauugauggggucaaacuugaaucuacacggaucuaucaaauucuggccaucuacuccacgguggcgagcucccucguucugguggucucucugggcgcuauuagcuuuuggaugugcuccaauggaucucuccagugccgcaucuguauuuga

SEQ ID NO: 187975 - RNA, 1701 nt, Artificial Sequence; identical to SEQ ID NO: 186140
  derived and/or modified sequence opt5 from hemagglutinin__InfluenzaA__ADG59659

SEQ ID NO: 187976 - RNA, 1701 nt, Artificial Sequence; identical to SEQ ID NO: 186140
  derived and/or modified sequence opt5 from hemagglutinin__InfluenzaA__ADG59660

SEQ ID NO: 187977 - RNA, 1701 nt, Artificial Sequence; identical to SEQ ID NO: 186046
  derived and/or modified sequence opt5 from hemagglutinin__InfluenzaA__ADG59662

SEQ ID NO: 187978 - RNA, 1701 nt, Artificial Sequence
  derived and/or modified sequence opt5 from hemagglutinin__InfluenzaA__ADG59663
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccuuccaugacugcaauacaaccugucaaaccccuaaaggcgccaucaacacaagccuccccuuucagaauauucacccgaucacgauuggcaagugcccuaaguaugucaaaucuaccaagcugagacuugcuacagggcugcggaacauccccagcauucagucccgcggacucuucggcgccaucgccggguuuaucgagggaggcuggaccgggaugguggacggaugguacggcuaucaucaccagaaugaacaaggcucuggguacgcugcggaucugaaaagcacacagaacgccauugacgagaucaccaauaagguuaacuccgugauugagaaaaugaauacgcaguucacagcugucggaaaggaguucaaccaccuugagaagagaaucgaaaaucugaacaaaaagguggaugacggcuuucucgauauuuggaccuacaaugccgagcugcugguucuccuggaaaacgagcggacccuugacuaucaugauagcaaugugaaaaaccuguacgagaagguccgcucucagcucaaaaacaaugccaaggaaaucgggaacggauguuucgaguuuuaucacaagugcgacaauacauguauggaauccgugaaaaacggcaccuacgauuauccuaaguacagcgaggaagcuaaacugaauagagaggagaucgacggggucaaacuugaaucuacacggauuuaucaaauccuggccauuuacuccacgguggcgagcucccucguucugguggucucucugggcgcuaucagcuucuggaugugcuccaacggaucucuccagugccgcauuuguaucuga

SEQ ID NO: 187979 - RNA, 1701 nt, Artificial Sequence; identical to SEQ ID NO: 186046
  derived and/or modified sequence opt5 from hemagglutinin__InfluenzaA__ADG59664

SEQ ID NO: 187980 - RNA, 1701 nt, Artificial Sequence
  derived and/or modified sequence opt5 from hemagglutinin__InfluenzaA__ADG59666
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcgaugcugggucuggaaucauuaucuccgacacccccguccaugacugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggauggaugguacggcuaucaucaccagaacgaacaaggcucuggguacgcugcggaccugaaaagcacacagaaugccaucgaugagauuaccaacaaggucaauuccgugaucgagaaaaugaacacgcaguuuacagcuguuggaaaggaguucaaucaccuugagaagagaauugaaaaccugaauaaaaagaucgacgauggcuuccucgacauuuggaccuacaacgccgagcugcuggugcuccuggaaaaugagcggacccuugauuaucaugacagcaacgucaaaaaucuguacgagaaggugcgcucucagcucaaaaacaacgccaaggaaaucgggaauggauguuuugaguucuaucacaagugcgauaacacauguauggaauccgucaaaaauggcaccuacgacuauccuaaguacagcgaggaagcuaaacugaacagagaggagaucgauggggugaaacuugaaucuacacggauuuaucaaauccuggccauuuacuccgcgguugcuagcucccucgugcuggucgugucucugggcgccaucagcuuuuggaugugcuccaauggaucucuccagugccgcauuuguaucuga

SEQ ID NO: 187981 - RNA, 1701 nt, Artificial Sequence; identical to SEQ ID NO: 186795
  derived and/or modified sequence opt5 from hemagglutinin__InfluenzaA__ADG59667

SEQ ID NO: 187982 - RNA, 1701 nt, Artificial Sequence
  derived and/or modified sequence opt5 from hemagglutinin__InfluenzaA__ADG59669
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugaucccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacucuaucacgauuggcaagugcccgaaguaugugaaaagcaccaagcugagacuugcuacagggcugcggaacguuccuuccauccagucucgcggacucuuuggcgccauugccggguucaucgagggaggcuggaccgggaugguggacggaugguacggcuaucaucaccagaaugaacaaggcagcggguacgcugcggaucugaaauccacacagaacgccaucgacgagauuaccaauaaggucaacagcgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauucuaaugugaaaaaccuguacgagaagguccgcucccagcucaaaaacaaugccaaggaaauugggaacggauguuuugaguucuaucacaagugcgacaauacauguauggaaagcgugaaaaacggcaccuacgauuaucccaaguacucugaggaagcuaaacugaauagagaggagaucgacgggguuaaacuugaauccacacggaucuaucaaauucuggccaucuacagcacgguggcguccucucucguccuggugguuagccugggcgcuauuuccuuuuggaugugcucuaacggaagccuccagugccgcaucuguauuuga

SEQ ID NO: 187983 - RNA, 1701 nt, Artificial Sequence; identical to SEQ ID NO: 187982
  derived and/or modified sequence opt5 from hemagglutinin__InfluenzaA__ADG59670

SEQ ID NO: 187984 - RNA, 1701 nt, Artificial Sequence; identical to SEQ ID NO: 187982
  derived and/or modified sequence opt5 from hemagglutinin__InfluenzaA__ADG59671

SEQ ID NO: 187985 - RNA, 1701 nt, Artificial Sequence; identical to SEQ ID NO: 187982
  derived and/or modified sequence opt5 from hemagglutinin__InfluenzaA__ADG59672

SEQ ID NO: 187986 - RNA, 1701 nt, Artificial Sequence
  derived and/or modified sequence opt5 from hemagglutinin__InfluenzaA__ADG59673
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccguggaucuccuggaagacaagcacaacgggaaacuuuguaagcugagaggaguugcgccccuccaucugggcgagugcaauaucgccggguggauucugggaaacccugaaugugagucucucagcacagcuuccucuuggagcuacaucguggaaaccuccucuagcgauaauggcacgugcuauccgggggacuuuauugauuacgaggagcugcgggaacagcuuuccagcgucucuuccuucgagcgcuuugaaaucuuccccaaaaccagcucuuggccuaaccacgacuccaauaagggagugacagccgcuuguccccaugccggcgccaagagcuuuuauaaaaaccugaucuggcucguuaagaaaggcaauucuuacccuaagcuguccaaaagcuauauuaacgauaaggggaaggaggugcuuguccuguggggaauccaccaccccuccaccucugccgaccaacagagccucuaccagaaugcugaugccuacguguucgugggcacauccagauauagcaaaaaguuuaaaccugagauugcuauccggccgaagguccgcgaccaggaagggagaaugaacuacuauuggacccugguugagcccggagauaaaauuacguucgaagccacaggcaaucugguggugccucgguacgcguuugccauggagcgcaacgcugggucuggaaucauuaucuccgacacccccguccaugacugcaacacaaccugucaaaccccuaagggcgccaucaauacaagccuccccuuccagaacauucacccgaucacgauuggcaaaugcccuaaguaugugaagucuaccaaacugagacuugcuacagggcugcggaauguucccagcauccagucccgcggacucuuuggcgccauugccggguucaucgaaggaggcuggaccgggaugguggauggaugguacggcuaucaucaccagaacgagcaaggcucuggguacgcugcggaccuuaagagcacacagaaugccaucgaugagauuaccaacaaagucaauuccgugaucgaaaagaugaacacgcaguuuacagcuguuggaaaagaguucaaucaccuggaaaagagaauugagaaccugaauaagaaaguggacgauggcuuccucgacaucuggaccuacaacgccgaacugcugguccuccuggagaaugagcggacccuugauuaucaugacagcaacgugaagaaucuguacgaaaaaguccgcucucagcucaagaacaacgccaaagagauugggaauggauguuuugaguucuaucacaagugcgauaacacauguauggaauccgugaagaauggcaccuacgacuauccuaaauacagcgaagaggcuaagcugaacagagaggaaaucgaugggguuaaacuugagucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 187987 - RNA, 1701 nt, Artificial Sequence
  derived and/or modified sequence opt5 from hemagglutinin__InfluenzaA__ADG59674
augaaggccauccuggugguccuccuguacaccuucgcuacagccaacgcggacacgcuuugcguuggcuaucacgcuaauaacagcaccgauacaguggacaccgugcuggagaaaaaugucacagugacccauuccguuaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauugucgagaccuccucuagcgacaacggcacgugcuauccgggggauuuuaucgacuacgaagaacugcgggagcagcuuuccagcgugucuuccuucgaacgcuuugagauuuuccccaagaccagcucuuggccuaaucacgauuccaacaagggaguuacagccgcuuguccccaugccggcgcgaaaucuuuuuauaagaaucugaucuggcucgugaaaaagggcaacagcuacccuaaacuguccaagagcuauaucaaugacaaggggaaagaaguccuugugcuguggggcauucaccaccccuccaccucugccgaucaacagagccucuaccagaacgcugacgccuacguguucgucggaacauccagauauagcaagaaauuuaagccugagaucgcuauucggccgaaaguucgcgagcaggaagggagaaugaauuacuauuggacccugguggagcccggagauaagaucacguucgaagccacaggcaaccugguggucccucgguacgcguuugccauggagcgcaacgcugggucuggaauuaucauuuccgacacccccgugcaugauugcaauacaaccugucaaaccccuaaaggcgccaucaacacaagccuccccuuccagaauguucacccgaucacgauuggcaagugcccuaaguaugugaaaucuaccaagcugagacuugcuacagggcugcggaacguccccagcauccagucccgcggacucuuuggcgccauugccggguucaucgaaggaggcuggaccgggaugguggacggaugguacggcuaucaucaccagaaugagcaaggcucuggguacgcugcggaccugaaaagcacacagaacgccauugaugagaucaccaauaagguuaacuccgugaucgaaaagaugaauacgcaguuuacagcugucggaaaggaguucaaccaccuugaaaagagaauugagaaucugaacaaaaagguggacgauggcuuccucgacaucuggaccuacaaugccgaacugcugguccuccuggagaacgagcggacccuugauuaucaugacagcaaugugaaaaaccuguacgaaaagguucgcucucagcucaaaaacaaugccaaggagauugggaacggauguuuugaguucuaucacaagugcgauaauacauguauggaguccgugaaaaacggcaccuacgacuauccuaaguacagcgaagaggcuaaacugaauagagaggaaaucgauggggucaaacuugagucuacaaaaauuuaucaaauccuggccaucuacuccacgguggcgagcucccucguucugguggucucucugggcgcuauuagcuuuuggaugugcuccaacggaucucuccagugccggaucuguauuuga

SEQ ID NO: 187988 - RNA, 1701 nt, Artificial Sequence
  derived and/or modified sequence opt5 from hemagglutinin__InfluenzaA__ADG59675
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaacggcgccaucaauaccucucuccccuuccacaacauucauccgaucacaauuggcaaaugcccuaaguauguuaagagcacgaaacugagacuugcuaccgggcugcggaaugugcccuccauccagucucgcggacucuuuggcgccauugccggguucaucgagggaggcuggacagggaugguggacggaugguacggcuaucaccaccagaacgaacagggcagcggguacgcugcggaucugaaguccacccaaaaugccaucgacgagauuacaaacaaagucaauagcgugaucgagaagaugaacacccaguuuacggcuguuggaaaagaguucaaucaucuugagaagagaauugaaaaccugaauaagaaaguggaugacggcuuccucgauaucuggacauacaacgccgagcugcugguccuccuggaaaaugagcggacccuugacuaucacgauucuaacgugaagaaccuguacgagaaaguccgcucccagcucaagaauaacgccaaagaaauugggaauggauguuuugaguucuaucauaagugcgacaacaccuguauggaaagcgugaagaauggcacauacgauuauccuaaauacucugaggaagcuaagcugaacagagaggagaucgacgggguuaaacuugaauccacccggaucuaucagauucuggccaucuacagcacaguggcguccucucucguccuggugguuagccugggcgcuauuuccuuuuggaugugcucuaauggaagccuccaaugccgcaucuguauuuga

SEQ ID NO: 187989 - RNA, 1701 nt, Artificial Sequence
  derived and/or modified sequence opt5 from hemagglutinin__InfluenzaA__ADG59676
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaaugccacaugucaaaccccuaaaggcgcuaucaacaccagccuccccuuccagaauauucacccgaucacaauuggcaagugcccuaaguaugugaaaucuacgaagcugagacuugccaccgggcugcggaacauccccagcauucagucccgcggacucuuuggcgccaucgcuggguucaucgagggaggcuggacagggaugguugacggaugguacggcuaucaucaccagaaugaacaaggcucuggguacgcggccgaucugaaaagcacccagaacgcuauugacgagaucacaaauaaggugaacuccgucauugagaaaaugaauacccaguuuacggccgugggaaaggaguucaaccaccuugagaagagaaucgaaaaucugaacaaaaagguugaugacggcuuccucgauauuuggacauacaaugccgagcugcuggugcuccuggaaaacgagcggacccuugacuaucaugauagcaaugucaaaaaccuguacgagaaggugcgcucucagcucaaaaacaaugcuaaggaaaucgggaacggauguuuugaguucuaucacaagugcgacaauaccuguauggaauccgucaaaaacggcacauacgauuauccuaaguacagcgaggaagccaaacugaauagagaggagaucgacggggugaaacuugaaucuacccggauuuaucaaauccuggcgauuuacuccacaguugcuagcucccucgugcuggucgugucucugggcgccaucagcuuuuggaugugcuccaacggaucucuccagugccgcauuuguaucuga

SEQ ID NO: 187990 - RNA, 1701 nt, Artificial Sequence; identical to SEQ ID NO: 186794
  derived and/or modified sequence opt5 from hemagglutinin__InfluenzaA__ADG59678

SEQ ID NO: 187991 - RNA, 1701 nt, Artificial Sequence; identical to SEQ ID NO: 187957
  derived and/or modified sequence opt5 from hemagglutinin__InfluenzaA__ADG59680

SEQ ID NO: 187992 - RNA, 1701 nt, Artificial Sequence; identical to SEQ ID NO: 187957
  derived and/or modified sequence opt5 from hemagglutinin__InfluenzaA__ADG59681

SEQ ID NO: 187993 - RNA, 1701 nt, Artificial Sequence
  derived and/or modified sequence opt5 from hemagglutinin__InfluenzaA__ADG59683
augaaggccauccuggugguccuccuguacaccuucgcuauugccaacgcggacacacuuugcaucggcuaucacgcuaauaacagcacggauaccguugacacagugcugaaaaagaaugugaccgucacacauuccgugaaccuccuggaggauaaacacaaugggaaacuuuguaaacugagaggaguugcgccccuccaucugggcaagugcaacauugccggguggauccugggaaauccugaaugugagucucucagcaccgcuuccucuuggagcuacauuguggaaacauccucuagcgacaacggaaccugcuauccgggggauuuuaucgacuacgaggaacugcgggagcagcuuuccagcgucucuuccuucgagcgcuuugaaaucuuccccaagacgagcucuuggccuaaucacgauuccaacaaaggagugaccgccgcuuguccccaugccggcgccaagagcuuuuauaaaaaucugauuuggcucguuaagaaaggcaacucuuacccuaagcuguccaagagcuauaucaaugacaaagggaaggaggugcuuguccuguggggcauucaccaccccuccacaucugccgaucaacagagccucuaccagaacgcugacgccuacguguucgugggcaccuccagauauagcaaaaaguuuaaaccugaaaucgcuauucggccgaagguccgcgaucaggaggggagaaugaauuacuauuggacacugguugagcccggagacaaaaucaccuucgaagccacgggcaaccugguggugccucgguacgcguuugccauggagcgcaacgcugggucuggaauugucaucuccgauacacccgugcaugacugcaauaccacaugucaaaccccuaagggcgccaucaacaccagccuccccuuccagaauauucacccgaucacaauuggcaagugcccuaaauauguuaagucuacgaaacugagacuugcuaccgggcugcggaacgugcccagcauccagucccgcggacucuuuggcgccauugccggguucaucgaaggaggcuggacagggauggucgacggaugguacggcuaucaucaccagaaugagcaaggcucuggguacgcugcggaucuuaagagcacccagaacgccaucgacgaaauuacaaauaaagugaacuccguuaucgagaagaugaauacccaguuuacggcugugggaaaggaguucaaccaccuggaaaagagaauugagaaucugaacaagaaagucgaugacggcuuccucgauaucuggacauacaaugccgaacugcuggugcuccuggagaacgaacggacccuugacuaucaugauagcaaugucaagaaccuguacgagaaagugcgcucucagcucaagaacaaugccaaggagauugggaacggauguuuugaguucuaucacaaaugcgacaauaccuguauggaauccguuaagaacggcacauacgauuauccuaaauacagcgaagaggcuaagcugaauagagaagagaucgacggggugaaacuugagucuacccggaucuaucaaauucuggccaucuacuccacagucgcgagcucccucgugcugguugugucucugggcgcuauuagcuuuuggaugugcuccaacggaucucuccagugccgcaucuguauuuga

SEQ ID NO: 187994 - RNA, 1701 nt, Artificial Sequence; identical to SEQ ID NO: 186794
  derived and/or modified sequence opt5 from hemagglutinin__InfluenzaA__ADG59684

SEQ ID NO: 187995 - RNA, 1701 nt, Artificial Sequence
  derived and/or modified sequence opt5 from hemagglutinin__InfluenzaA__ADG59685
augaaggccauccuggugguccuccuguacaccuucgcuacagccaacgcggacacgcuuugcauuggcuaucacgcuaauaacagcaccgauacaaucgacaccguucuggagaagaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccaagagcuauaucaaugacaaggggaaagaaguucuugugcuguggggcauucaccaccccuccaccucugccgaucaacagagccucuaccagaacgcugacgccuacgucuucgugggaacauccagauauagcaagaaauuuaagccugagaucgcuauucggccgaaagugcgcgaucaggaggggagaaugaauuacuauuggacccuggucgaacccggagacaagaucacguucgaggccacaggcaaccugguugugccucgguacgcguuugccauggaacgcaacgcugggucuggaauuaucaucuccgauacccccgugcaugacugcaauacaaccugucaaaccccuaaaggcgccauuaacacaagccuccccuuccagaauauccacccgauuacgaucggcaagugcccuaaguaugucaaaucuaccaagcugagacuugcuacagggcugcggaacauucccagcauccagucccgcggacucuuuggcgccaucgccggguucauugagggaggcuggaccgggaugguggacggaugguacggcuaucaucaccagaaugaacaaggcucuggguacgcugcggaucugaaaagcacacagaacgccaucgacgagauuaccaauaagguuaacuccgugaucgagaaaaugaauacgcaguuuacagcugucggaaaggaguucaaccaccuugagaagagaauugaaaaucugaacaaaaagguggaugacggcuuccucgauaucuggaccuacaaugccgagcugcugguucuccuggaaaacgagcggacccuugacuaucaugauagcaaugugaaaaaccuguacgagaagguccgcucucagcucaaaaacaaugccaaggaaaucgggaacggauguuuugaguucuaucacaagugcgacaauacauguauggaauccgugaaaaacggcaccuacgauuauccuaaguacagcgaggaagcuaaacugaauagagaggagauugacggggucaaacuugaaucuacacggaucuaucaaauucuggccaucuacuccacgguggcgagcucccucguucugguggucucucugggcgcuauuagcuuuuggaugugcuccaacggaucucuccagugccgcaucuguauuuga

SEQ ID NO: 187996 - RNA, 1701 nt, Artificial Sequence; identical to SEQ ID NO: 186794
  derived and/or modified sequence opt5 from hemagglutinin__InfluenzaA__ADG59686

SEQ ID NO: 187997 - RNA, 1701 nt, Artificial Sequence; identical to SEQ ID NO: 187957
  derived and/or modified sequence opt5 from hemagglutinin__InfluenzaA__ADG59687

SEQ ID NO: 187998 - RNA, 1701 nt, Artificial Sequence
  derived and/or modified sequence opt5 from hemagglutinin__InfluenzaA__ADG59688
augaaggccauccuggugguccuccuguacaccauugcuacagccaacgcggacacgcuuugcaucggcuaucacgcuaauaacagcaccgauacaauugacaccguucuggagaagaaugugacagugacccauuccgucaaccuccuggaagauaagcacaaugggaaacuuuguaagcugagaggaguggcuccccuccaucugggcaaaugcaacaucgccggguggauucugggaaauccugagugugaaucucucagcacagccuccucuuggagcuacaucguugagaccuccucuagcgacaacggcacgugcuauccgggggauuucaucgacuacgaggaacugcgggagcagcuuuccagcgugucuuccuuugaacgcuucgagauuuuucccaagaccagcucuuggccuaaucacgauuccaacaagggagucacagccgcuuguccccaugccggcgcgaaaucuuucuauaagaaucugaucuggcucgugaaaaagggcaacagcuacccuaaacuguccaagagcuauauuaaugacaaggggaaagaaguucuugugcuguggggaauccaccaccccuccaccucugccgaucaacagagccucuaccagaacgcugacgccuacgucuuugugggcacauccagauauagcaagaaauucaagccugagauugcuauccggccgaaagugcgcgggcaggagggaagaaugaauuacuauuggacccuggucgaacccggcgauaagauuacguuugaggccacagggaaccugguugugccucgguacgcguucgccauggaacgcaacgcuggaucuggcaucaucauuuccgacacccccgugcaugauugcaauacaaccugucaaaccccuaaaggcgccaucaacacaagccuccccuuucagaauauucacccgaucacgauugggaagugcccuaaguaugucaaaucuaccaagcugagacuugcuacaggacugcggaacauccccagcauccagucccgcggccucuucggggccauugccggauuuaucgagggcggguggaccggaaugguggacggcugguacggcuaucaucaccagaaugaacaagggucuggauacgcugcggaccugaaaagcacacagaacgccauugaugagaucaccaauaagguuaacuccgugauugagaaaaugaauacgcaguucacagcugucggcaaggaauuuaaccaccuugagaagagaaucgaaaaucugaacaaaaagguggacgauggguuccucgacaucuggaccuacaaugccgagcugcugguucuccuggaaaacgagcggacccuugauuaucaugacagcaaugugaaaaaccuguacgagaagguccgcucucagcucaaaaacaaugccaaggaaauuggaaacggcuguuucgaguuuuaucacaagugcgauaauacauguauggaauccgugaaaaacgggaccuacgacuauccuaaguacagcgaggaagcuaaacugaauagagaggagaucgauggcgucaaacuugaaucuacacggauuuaucaaauccuggccauuuacuccacgguggcgagcucccucguucugguggucucucugggagcuaucagcuucuggaugugcuccaacggcucucuccagugccgcauuuguaucuga

SEQ ID NO: 187999 - RNA, 1701 nt, Artificial Sequence; identical to SEQ ID NO: 185693
  derived and/or modified sequence opt5 from hemagglutinin__InfluenzaA__ADG59689

SEQ ID NO: 188000 - RNA, 1701 nt, Artificial Sequence; identical to SEQ ID NO: 185693
  derived and/or modified sequence opt5 from hemagglutinin__InfluenzaA__ADG59691

SEQ ID NO: 188001 - RNA, 1701 nt, Artificial Sequence
  derived and/or modified sequence opt5 from hemagglutinin__InfluenzaA__ADG59693
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaauccuuuuauaagaaucugaucuggcucguuaaaaagggcaacucuuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcaaucaggaggggagaaugaacuacuauuggacccugguugaacccggagauaagauuacguucgaggccacaggcaaccugguggugccucgguacgcguuugccauggaacgcaaugcugggucuggaaucauuaucuccgacacccccguccaugauugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauauccccagcauucagucccgcggacucuuuggcgccaucgccggguucaucgagggaggcuggaccgggaugguugacggaugguacggcuaucaucaccagaacgaacaaggcucuggguacgcugcggaccugaaaagcacacagaaugccauugaugagaucaccaacaaggugaauagcgucauugagaaaaugaacacgcaguuuacagcugugggaaaggaguucaaucaccuugagaagagaaucgaaaaccugaauaaaaagguugacgauggcuuccucgacauuuggaccuacaacgccgagcugcuggugcuccuggaaaaugagcggacccuugauuaucaugacagcaacgucaaaaaccuguacgagaaggugcgcucucagcucaaaaauaacgccaaggaaaucgggaauggauguuuugaguucuaucacaagugcgauaacacauguauggaauccgucaaaaauggcaccuacgacuauccuaaguacagcgaggaagcuaaacugaacagagaggagaucgauggggugaaacuugaaucuacacggauuuaucaaauccuggccauuuacuccacgguugcgagcucccucgugcuggucgugucucugggcgcuaucagcuuuuggaugugcuccaauggaucucuccagugccgcauuuguaucuga

SEQ ID NO: 188002 - RNA, 1701 nt, Artificial Sequence
  derived and/or modified sequence opt5 from hemagglutinin__InfluenzaA__ADG59696
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugguggugccucgguacgcguuugccauggagcgcgacgcugggucuggaaucauuaucuccgauacccccguccaugacugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgaaggaggcuggaccgggaugguggacggaugguacggcuaucaucaccagaacgagcaaggcucuggguacgcugcggaucugaaaagcacacagaaugccaucgacgagauuaccaacaaggucaauuccgugaucgaaaagaugaacacgcaguuuacagcuguuggaaaggaguucaaucaccuugaaaagagaauugagaaccugaauaaaaagguggaugacggcuuccucgauaucuggaccuacaacgccgaacugcugguccuccuggagaaugagcggacccuugacuaucaugauagcaacgugaaaaaucuguacgaaaagguccgcucucagcucaaaaacaacgccaaggagauugggaauggauguuuugaguucuaucacaagugcgacaacacauguauggaguccgugaaaaauggcaccuacgauuauccuaaguacagcgaagaggcuaaacugaacagagaggaaaucgacgggguuaaacuugagucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 188003 - RNA, 1701 nt, Artificial Sequence
  derived and/or modified sequence opt5 from hemagglutinin__InfluenzaA__ADG59697
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaaauuuuuauaagaaccugaucuggcucguuaaaaagggcaauagcuacccuaaacugucuaaguccuauauuaacgacaaggggaaagaagugcuuguccuguggggaauccaccaccccagcaccuccgccgaucaacagucucucuaccagaaugcugacgccuacguguucgugggcacaagcagauauuccaagaaauuuaagccugagauugcuauccggccgaaaguccgcgggcaggagggaagaaugaacuacuauuggacccugguugaacccggcgauaagauuacguucgaggccacagggaaccugguggugccucgguacgcguuugccauggaacgcaaugcuggaagcggcaucauuaucucugacacccccguccaugauugcaacacaaccugucaaaccccuaaaggcgccaucaauacaucccuccccuuccagaacauucacccgaucacgauugggaagugcccuaaguaugugaaaagcaccaagcugagacuugcuacaggacugcggaauguucccucuauccagagccgcggccucuuuggggccauugccggauucaucgagggcggguggaccggaaugguggacggcugguacggcuaucaucaccagaacgaacaaggguccggauacgcugcggaccugaaaucuacacagaaugccaucgaugagauuaccaacaaggucaauagcgugaucgagaaaaugaacacgcaguuuacagcuguuggcaaggaguucaaucaccuugagaagagaauugaaaaccugaauaaaaagguggacgauggguuccucgacaucuggaccuacaacgccgagcugcugguccuccuggaaaaugagcggacccuugauuaucaugacuccaacgugaaaaaccuguacgagaagguccgcagccagcucaaaaauaacgccaaggaaauuggaaauggcuguuuugaguucuaucacaagugcgauaacacauguauggaaucugugaaaaaugggaccuacgacuauccuaaguacuccgaggaagcuaaacugaacagagaggagaucgauggcguuaaacuugaaagcacacggaucuaucaaauucuggccaucuacucuacgguggcguccagccucguccuggugguuucccugggagcuauuucuuuuuggaugugcagcaauggcucccuccagugccgcaucuguauuuga

SEQ ID NO: 188004 - RNA, 1701 nt, Artificial Sequence
  derived and/or modified sequence opt5 from hemagglutinin__InfluenzaA__ADG59700
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaacccucaaaggcgccaucaacacaagccugccuuuccagaauauucaccccaucacgauuggcaagugcccgaaguaugugaaaucuaccaaacuuagacuggcuacagggcuccggaacaucccuagcauucagucccgcggacuguuuggcgccaucgccggguucaucgagggaggcuggaccgggaugguugacggaugguacggcuaucaucaccagaaugaacaaggcucuggguacgcugcggaucuuaagagcacacagaacgccauugacgagaucaccaauaaggugaacuccgucauugagaaaaugaauacgcaguuuacagcugugggaaaggaguucaaccaccuggagaagagaaucgaaaaucucaacaaaaagguugaugacggcuuccuggauauuuggaccuacaaugccgagcugcucgugcugcuugaaaacgagcggacccuggacuaucaugauagcaaugucaaaaaccucuacgagaaggugcgcucucagcugaaaaacaaugccaaggaaaucgggaacggauguuuugaguucuaucacaagugcgacaauacauguauggaauccgucaaaaacggcaccuacgauuaucccaaguacagcgaggaagcuaaacuuaauagagaggagaucgacggggugaagcuggaaucuacacggauuuaucaaauccucgccauuuacuccacgguugcgagcucccuggugcuggucgugucucucggcgcuaucagcuuuuggaugugcuccaacggaucucugcagugccgcauuuguaucuga

SEQ ID NO: 188005 - RNA, 1701 nt, Artificial Sequence
  derived and/or modified sequence opt5 from hemagglutinin__InfluenzaA__ADG59701
augaaggccauccuggugguccuccuguacaccuucgcugccgcgaacgcugacacacuuugcauuggcuaucacgccaauaacagcacggauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacauccucuagcgacaacgggaccugcuauccgggcgauuuuauugacuacgaagaacugcgggagcagcuuuccagcgucucuuccuucgaacgcuuugagaucuuccccaagacgagcucuuggccuaaucacgauuccaacaagggagugaccgcugccuguccccaugcgggcgccaagagcuuuuauaaaaaucugaucuggcucguuaaaaagggcaacucuuacccuaaacuguccaagagcuauauuaaugacaaggggaaagaagugcuuguccuguggggaauccaccaccccuccacaucugcugaucaacagagccucuaccagaacgccgacgcuuacguguucgugggcaccuccagauauagcaagaaauuuaagccugagauugccauccggccgaaaguccgcgaucaggaggggagaaugaauuacuauuggacacugguugaacccggagacaagauuaccuucgaggcgacgggcaaccugguggugccucgguacgccuuugcuauggaacgcaacgccgggucuggaaucauuaucuccgauacacccguccaugacugcaauaccacaugucaaaccccuaaaggcgcuaucaacaccagccuccccuuccagaauauucacccgaucacaauuggcaagugcccuaaguaugugaaaucuacgaagcugagacuugccaccgggcugcggaacguucccagcauccagucccgcggacucuuuggcgccauugcuggguucaucgagggaggcuggacagggaugguggacggaugguacggcuaucaucaccagaaugaacaaggcucuggguacgcggccgaucugaaaagcacccagaacgcuaucgacaagauuacaaauaaagucaacuccgugaucgagaagaugaauacccaguuuacggccguuggaaaggaguucaaccaccuugagaaaagaauugagaaucugaacaagaaaguggaugacggcuuccucgauaucuggacauacaaugccgaacugcugguccuccuggagaacgaacggacccuugacuaucaugauagcaaugugaagaaccuguacgagaaaguccgcucucagcucaagaacaaugcuaaggagauugggaacggauguuuugaguucuaucacaaaugcgacaauaccuguauggaauccgugaagaacggcacauacgauuauccuaaauacagcgaagaggccaagcugaauagagaagagaucgacgggguuaaacuugagucuacccggaucuaucaaauucuggcgaucuacuccacaguggcuagcucccucguccuggugguuucucugggcgccauuagcuuuuggaugugcuccaacggaucucuccagugccgcaucuguauuuga

SEQ ID NO: 188006 - RNA, 1701 nt, Artificial Sequence
  derived and/or modified sequence opt5 from hemagglutinin__InfluenzaA__ADG59702
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacauccccagcauucagucccgcggacucuuuggcgccaucgccggguucaucgagggaggcuggaccgggaugguugacggaugguacggcuaucaucaccagaaugaacaaggcucuggguacgcugcggaucugaaaagcacacagaacgccauugacgagaucaccaauaaggugaacuccgucauugagaaaaugaauacgcaguuuacagcugugggaaaggaguucaaccaccuugagaagagaaucgaaaaucugaacaaaaagguugaugacggcuuccucgauauuuggaccuacaaugccgagcugcuggugcuccuggaaaacgagcggaaucuugacuaucaugauagcaacgucaaaaaccuguacgagaaggugcgcucucagcucaaaaauaacgccaaggaaaucgggaauggauguuuugaguucuaucacaagugcgacaacaccuguauggaauccgucaaaaauggcacauacgauuauccuaaguacagcgaggaagcuaaacugaacagagaggagaucgacggggugaaacuugaaucuacccggauuuaucaaauccuggccauuuacuccacaguugcgagcucccucgugcuggucgugucucugggcgcuaucagcuuuuggaugugcuccaauggaucucuccagugccgcauuuguaucuga

SEQ ID NO: 188007 - RNA, 1701 nt, Artificial Sequence
  derived and/or modified sequence opt5 from hemagglutinin__InfluenzaA__ADG59703
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcagauauuccaagaaauuuaagccggagauugcuauccggcccaaaguccgcgaucaggaggggagaaugaauuacuauuggacccugguugaaccuggagacaagauuacguucgaggccacaggcaaccugguggugccccgguacgcguuugccauggaacgcaacgcugggagcggaaucgucauuucugauaccccugugcaugacugcaauacaaccugucaaacccccaaaggcgccaucaacacaucccucccguuccagaauauccacccuauuacgaucggcaagugccccaaguauguuaaaagcaccaagcugagacuugcuacagggcugcggaacgugccuucuauucagagccgcggacucuuuggcgccaucgccggguucauugagggaggcuggaccgggauggucgacggaugguacggcuaucaucaccagaaugaacaaggcuccggguacgcugcggaucugaaaucuacacagaacgccaucgacgagaucaccaauaaggugaacagcguuauugagaaaaugaauacgcaguuuacagcugugggaaaggaguucaaccaccuugagaagagaaucgaaaaucugaacaaaaaggucgaugacggcuuccucgauauuuggaccuacaaugccgagcugcuggugcuccuggaaaacgagcggacccuugacuaucaugauuccaaugucaaaaaccuguacgagaaggugcgcagccagcucaaaaacaaugccaaggaaaucgggaacggauguuuugaguucuaucacaagugcgacaauacauguauggaaucuguuaaaaacggcaccuacgauuaucccaaguacuccgaggaagcuaaacugaauagagaggagauugacggggugaaacuugaaagcacacggaucuaucaaauccuggccauuuacucuacggucgcguccagccucgugcugguugugucccugggcgcuaucucuuuuuggaugugcagcaacggaucccuccagugccgcauuuguaucuga

SEQ ID NO: 188008 - RNA, 1701 nt, Artificial Sequence; identical to SEQ ID NO: 185708
  derived and/or modified sequence opt5 from hemagglutinin__InfluenzaA__ADG76646

SEQ ID NO: 188009 - RNA, 1701 nt, Artificial Sequence
  derived and/or modified sequence opt5 from hemagglutinin__InfluenzaA__ADG76652
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucuuuuagcacauccucuagcugguccuacaucguggagaccccgucuagcgacaacggcacgugcuaucccggggauuucauugacuacgaagaacuccgggagcagcuguccagcgucucuuccuuugaacgcuucgagaucuuuccuaagaccagcucuuggcccaaucacgauuccaacaagggagugacagccgccuguccucaugcuggcgccaagagcuucuauaaaaaucuuaucuggcugguuaaaaagggcaacucuuaccccaaacucuccaagagcuauauuaaugacaaggggaaagaagugcugguccuuuggggaauccaccacccuuccaccucugcggaucaacagagccuguaccagaacgccgacacauacguguuugugggcuccagcagauauucuaagaaauucaagccggagauugcuauccggcccaaaguccgcgaucaggaggggagaaugaauuacuauuggacccucguugaaccuggagacaagauuacguuugaggccacaggcaaccugguggugccccgguacgcuuucgccauggaacgcaacgcgggguccggaaucauuaucagcgauaccccuguccaugacugcaauacaaccugucaaacccccaaaggcgccaucaacacaucucugccguuucagaauauucacccuaucacgauuggcaagugccccaaguaugugaaaagcaccaagcucagacuggcuacagggcuucggaacaucccuuccauucagucucgcggacuguucggcgccaucgcuggguuuaucgagggaggcuggaccgggaugguugacggaugguacggcuaucaucaccagaaugaacaaggcagcggguacgccgccgaucucaaauccacacagaacgcuauugacgagaucaccaauaaggugaacagcgucauugagaaaaugaauacgcaguucacagcggugggaaaggaguucaaccaccuggagaagagaaucgaaaaucuuaacaaaaagguugaugacggcuuucuggauauuuggaccuacaaugccgagcuccuggugcugcucgaaaacgagcggacccuggacuaucaugauucuaaugucaaaaaccuuuacgagaaggugcgcucccagcugaaaaacaaugcuaaggaaaucgggaacggauguuucgaguuuuaucacaagugcgacaauacauguauggaaagcgucaaaaacggcaccuacgauuaucccaaguacucugaggaagccaaacucaauagagaggagaucgacggggugaagcuggaauccacacggauuuaucaaauccuugccauuuacagcacgguugcuuccucucuggugcucgucgugagccugggcgccaucuccuucuggaugugcucuaacggaagccugcagugccgcauuuguaucuga

SEQ ID NO: 188010 - RNA, 1701 nt, Artificial Sequence; identical to SEQ ID NO: 185935
  derived and/or modified sequence opt5 from hemagglutinin__InfluenzaA__ADH01808

SEQ ID NO: 188011 - RNA, 1701 nt, Artificial Sequence
  derived and/or modified sequence opt5 from hemagglutinin__InfluenzaA__ADH01818
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggaucuaucaaauucuggccaucuacuccacgguggcgagcucccucguccugauugugucucugggcgcuaucagcuuuuggaugugcuccaacggaucucuccagugccgcauuuguaucuga

SEQ ID NO: 188012 - RNA, 1701 nt, Artificial Sequence; identical to SEQ ID NO: 185935
  derived and/or modified sequence opt5 from hemagglutinin__InfluenzaA__ADH01828

SEQ ID NO: 188013 - RNA, 1701 nt, Artificial Sequence; identical to SEQ ID NO: 185693
  derived and/or modified sequence opt5 from hemagglutinin__InfluenzaA__ADH01838

SEQ ID NO: 188014 - RNA, 1701 nt, Artificial Sequence; identical to SEQ ID NO: 185935
  derived and/or modified sequence opt5 from hemagglutinin__InfluenzaA__ADH01848

SEQ ID NO: 188015 - RNA, 1701 nt, Artificial Sequence; identical to SEQ ID NO: 185935
  derived and/or modified sequence opt5 from hemagglutinin__InfluenzaA__ADH01858

SEQ ID NO: 188016 - RNA, 1701 nt, Artificial Sequence; identical to SEQ ID NO: 185693
  derived and/or modified sequence opt5 from hemagglutinin__InfluenzaA__ADH01868

SEQ ID NO: 188017 - RNA, 1701 nt, Artificial Sequence; identical to SEQ ID NO: 185693
  derived and/or modified sequence opt5 from hemagglutinin__InfluenzaA__ADH01878

SEQ ID NO: 188018 - RNA, 1701 nt, Artificial Sequence; identical to SEQ ID NO: 185935
  derived and/or modified sequence opt5 from hemagglutinin__InfluenzaA__ADH01888

SEQ ID NO: 188019 - RNA, 1701 nt, Artificial Sequence; identical to SEQ ID NO: 185693
  derived and/or modified sequence opt5 from hemagglutinin__InfluenzaA__ADH01898

SEQ ID NO: 188020 - RNA, 1701 nt, Artificial Sequence; identical to SEQ ID NO: 185784
  derived and/or modified sequence opt5 from hemagglutinin__InfluenzaA__ADH01908

SEQ ID NO: 188021 - RNA, 1701 nt, Artificial Sequence
  derived and/or modified sequence opt5 from hemagglutinin__InfluenzaA__ADH01918
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagaguccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaagaccagcucuuggccuaaucacgauuccaacaagggagugacagccgccuguccccaugcuggcgccaagagcuuuuauaaaaaucugaucuggcucguuaaaaagggcaacucuuacccuaaacuguccaagagcuauauuaaugacaaggagaaagaggugcuuguccugugggggauccaccaccccuccaccucugcggaucaacagagccucuaccagaacgccgacgcuuacguguucgugggaacauccagauauagcaagaaauuuaagccugaaauugccauccggccgaaaguccgcgaucaggagggcagaaugaauuacuauuggacccugguugaacccggggacaagauuacguucgaggcuacaggaaaccugguggugccucgguacgccuuugcgauggaacgcaacgccggcucugggaucauuaucuccgauacccccguccaugacugcaauacaaccugucaaaccccuaaaggagcuaucaacacaagccuccccuuccagaauauucacccgaucacgauuggcaagugcccuaaguaugugaaaucuaccaagcugagacuugccacaggccugcggaacguucccagcauccagucccgcgggcucuuuggagcuauugccggcuucaucgaagggggauggaccggcaugguggacgggugguacggauaucaucaccagaaugagcaaggcucuggcuacgccgcugaucugaaaagcacacagaacgcgaucgacaagauuaccaauaaagucaacuccgugaucgaaaagaugaauacgcaguuuacagccguugggaaggaguucaaccaccuugagaaaagaauugagaaucugaacaagaaaguggaugacggauuccucgauaucuggaccuacaaugcugaacugcugguccuccuggagaacgagcggacccuugacuaucaugauagcaaugugaagaaccuguacgaaaaaguccgcucucagcucaagaacaaugccaaggagauuggcaacggguguuuugaguucuaucacaaaugcgacaauacauguauggaauccgugaagaacggaaccuacgauuauccuaaauacagcgaagaggccaagcugaauagagaggaaaucgacggcguuaaacuugagucuacacggaucuaucaaauucuggcuaucuacuccacgguggccagcucccucguccuggugguuucucugggggcgauuagcuuuuggaugugcuccaacggcucucuccagugccgcaucuguauuuga

SEQ ID NO: 188022 - RNA, 1701 nt, Artificial Sequence
  derived and/or modified sequence opt5 from hemagglutinin__InfluenzaA__ADH01928
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgccucuuccuucgaacgcuuugagaucuuccccaagaccagcucuuggccuaaucacgauuccaacaagggagucacagcugccuguccccaugcgggcgccaagagcuuuuauaagaaucugaucuggcucgugaaaaagggcaacucuuacccuaaacuguccaagagcuauauuaaugacaaggggaaagaaguucuugugcuguggggaauccaccaccccuccaccucugcugaucaacagagccucuaccagaacgccgacgcuuacgucuucgugggcacauccagauauagcaagaaauuuaagccugagauugccauccggccgaaagugcgcgaucaggaggggagaaugaauuacuauuggacccuggucgaacccggagacaagauuacguucgaggcgacaggcaaccugguugugccucgguacgccuuugcuauggaacgcaacgccgggucuggaaucauuaucuccgauacccccgugcaugacugcaauacaaccugucaaaccccuaaaggcgcuaucaacacaagccuccccuuccagaauauucacccgaucacgauuggcaagugcccuaaguaugucaaaucuaccaagcugagacuugccacagggcugcggaacauccccagcauucagucccgcggacucuuuggcgccaucgcuggguucaucgagggaggcuggaccgggaugguggacggaugguacggcuaucaucaccagaaugaacaaggcucuggguacgcggccgaucugaaaagcacacagaacgcuauugacgagaucaccaauaagguuaacuccgugauugagaaaaugaauacgcaguuuacagccgucggaaaggaguucaaccaccuugagaagagaaucgaaaaucugaacaaaaagguggaugacggcuuccucgauauuuggaccuacaaugccgagcugcugguucuccuggaaaacgagcggacccuugacuaucaugauagcaaugugaaaaaccuguacgagaagguccgcucucagcucaaaaacaaugcuaaggaaaucgggaacggauguuuugaguucuaucacaagugcgacaauacauguauggaauccgugaaaaacggcaccuacgauuauccuaaguacagcgaggaagccaaacugaauagagaggagaucgacggggucaaacuugaaucuacacggauuuaucaaauccuggcgauuuacuccacgguggcuagcucccucguucugguggucucucugggcgccaucagcuuuuggaugugcuccaacggaucucuccagugccgcauuuguaucuga

SEQ ID NO: 188023 - RNA, 1701 nt, Artificial Sequence
  derived and/or modified sequence opt5 from hemagglutinin__InfluenzaA__ADH01938
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacaagaaaguccgcucucagcucaagaacaaugccaaggagauugggaacggauguuuugaguucuaucacaaaugcgacaauacauguauggaauccgugaagaacggcaccuacgauuauccuaaauacagcgaagaggcuaagcugaauagagaagagaucgacgggguuaaacuugagucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 188024 - RNA, 1701 nt, Artificial Sequence; identical to SEQ ID NO: 186857
  derived and/or modified sequence opt5 from hemagglutinin__InfluenzaA__ADH01948

SEQ ID NO: 188025 - RNA, 1701 nt, Artificial Sequence
  derived and/or modified sequence opt5 from hemagglutinin__InfluenzaA__ADH01958
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaacugcccuaaguaugugaagucuaccaaacugagacuugcuacagggcugcggaauguucccagcauccagucccgcggacucuuuggcgccauugccggguucaucgagggaggcuggaccgggaugguggacggaugguacggcuaucaucaccagaacgaacaaggcucuggguacgcugcggaucuuaagagcacacagaaugccaucgacaaaauuaccaacaaggucaauuccgugaucgagaaaaugaacacgcaguuuacagcuguuggaaaggaguucaaucaccuugaaaagagaauugagaaccugaauaaaaagguggaugacggcuuccucgauaucuggaccuacaacgccgaacugcugguccuccuggagaaugaacggacccuugacuaucaugauagcaacgugaaaaaccuguacgagaagguccgcucucagcucaaaaauaacgccaaggagauugggaauggauguuuugaguucuaucacaagugcgacaacacauguauggaguccgugaaaaauggcaccuacgauuauccuaaguacagcgaagaggcuaaacugaacagagaagagaucgacgggguuaagcuggagucuacacggaucuaucaaauucuggccaucuacuccacgguggcgagcucccucguccugauugugucucugggcgcuaucagcuuuuggaugugcuccaauggaucucuccagugccgcauuuguaucuga

SEQ ID NO: 188026 - RNA, 1701 nt, Artificial Sequence
  derived and/or modified sequence opt5 from hemagglutinin__InfluenzaA__ADH01968
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaccugaaaagcacacagaacgccaucgauaagauuaccaauaaagucaacuccgugaucgagaagaugaauacgcaguuuacagcuguuggaaaggaguucaaccaccuugagaaaagaauugaaaaucugaacaagaaaguggacgauggcuuccucgacaucuggaccuacaaugccgagcugcugguccuccuggaaaacgagcggacccuugauuaucaugacagcaaugugaagaaccuguacgagaaaguccgcaaccagcucaagaauaacgccaaggaaauugggaauggauguuuugaguucuaucacaaaugcgauaacacauguauggaaucugugaagaauggcaccuacgacuauccuaaauacuccgaggaagcuaagcugaacagagaggagaucgaugggguuaaacuugaaagcacacggaucuaucaaauucuggccaucuacucuacgguggcguccagccucguccuggugguuucccugggcgcuauuucuuuuuggaugugcagcaauggaucccuccagugccgcaucuguauuuga

SEQ ID NO: 188027 - RNA, 1701 nt, Artificial Sequence; identical to SEQ ID NO: 186857
  derived and/or modified sequence opt5 from hemagglutinin__InfluenzaA__ADH01978

SEQ ID NO: 188028 - RNA, 1701 nt, Artificial Sequence; identical to SEQ ID NO: 186857
  derived and/or modified sequence opt5 from hemagglutinin__InfluenzaA__ADH01988

SEQ ID NO: 188029 - RNA, 1701 nt, Artificial Sequence; identical to SEQ ID NO: 187860
  derived and/or modified sequence opt5 from hemagglutinin__InfluenzaA__ADH01998

SEQ ID NO: 188030 - RNA, 1701 nt, Artificial Sequence
  derived and/or modified sequence opt5 from hemagglutinin__InfluenzaA__ADH02008
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagggaagcacaauggaaaacuuuguaagcugagaggcguugcuccccuccaucuggggaaaugcaacaucgccggauggauucugggcaauccugagugugaaucucucagcacagccuccucuuggagcuacaucguggagaccuccucuagcgauaacgggacgugcuauccgggagacuuuauugauuacgaagaacugcgggagcagcuuuccagcgucucuuccuucgaacgcuuugagaucuuccccaagaccagcucuuggccuaaucacgacuccaacaagggcgugacagccgcuuguccccaugccggcgcgaaaucuuuuuauaagaaucugaucuggcucauuaaaaaggggaacagcuacccuaaacuguccaagagcuauaucaaugauaaggaaaaagagguucuugugcuguggggcauucaccaccccuccaccucugccgaccaacagagccucuaccagaacgcugaugccuacgucuucgugggaacauccagauauagcaagaaauuuaagccugagaucgcuauucggccgaaagugcgcgaccaggaagggagaaugaauuacuauuggacccuggucgagcccggagauaagaucacguucgaagccacaggcaaccugguugugccucgguacgcguuugccauggagcgcaacgcugggucuggaauuaucaucuccgacacccccgugcaugauugcaauacaaccugucaaaccccuaaaggcgccauuaacacaagccuccccuuccagaauauccacccgauuacgaucggcaagugcccuaaguaugucaaaucuaccaagcugagacuugcuacagggcugcggaacauucccagcauccagucccgcggacucuuuggcgccaucgccggguucauugaaggaggcuggaccgggaugguggacggaugguacggcuaucaucaccagaaugagcaaggcucuggguacgcugcggaccugaaaagcacacagaacgccaucgaugagauuaccaauaagguuaacuccgugaucgaaaagaugaauacgcaguuuacagcugucggaaaggaguucaaccaccuugaaaagagaauugagaaucugaacaaaaagguggacgauggcuuccucgacaucuggaccuacaaugccgaacugcugguucuccuggagaacgagcggacccuugauuaucaugacagcaaugugaaaaaccuguacgaaaagguccgcucucagcucaaaaacaaugccaaggagaucgggaacggauguuuugaguucuaucacaagugcgauaauacauguauggaguccgugaaaaacggcaccuacgacuauccuaaguacagcgaagaggcuaaacugaauagagaggaaauugauggggucaaacuugagucuacacggaucuaucaaauucuggccaucuacuccacgguggcgagcucccucguucugguggucucucugggcgcuauuagcuuuuggaugugcuccaacggaucucuccagugccgcaucuguauuuga

SEQ ID NO: 188031 - RNA, 1701 nt, Artificial Sequence; identical to SEQ ID NO: 186857
  derived and/or modified sequence opt5 from hemagglutinin__InfluenzaA__ADI24508

SEQ ID NO: 188032 - RNA, 1701 nt, Artificial Sequence
  derived and/or modified sequence opt5 from hemagglutinin__InfluenzaA__ADI24515
augaaggccauccuggugguccuccuguacaccuucgcuacagccaacgcggacacgcuuugcguuggcuaucacgcuaauaacagcaccgauacaguggacaccgugcuggagaaaaaugucacagugacccauuccguuaaccuccuggaagauaagcacaaugggaaacuuuguaagcugagaggaguggcuccccuccaucugggcaaaugcaacauugccggguggauccugggaaauccugagugugaaucucucccgacagccagcuccuggucuuacauugucgagaccagcuccucugacaacggcacgugcuaucccggggauuuuaucgacuacgaagaacugcgggagcagcuuagcuccgugagcucuuucgaacgcuuugagauuuucccuaagaccuccagcuggcccaaucacgauucuaacaagggaguuacagccgcuuguccucaugccggcgcgaaauccuuuuauaagaaucugaucuggcucgugaaaaagggcaacagcuaccccaaacugucuaaguccuauaucaaugacaaggggaaagaaguccuugugcuguggggcauucaccacccuagcaccuccgccgaucaacagucucucuaccagaacgcugacgccuacguguucgucggaacaagcagauauuccaagaaauuuaagccggagaucgcuauucggcccaaaguucgcgaucaggaggggagaaugaauuacuauuggacccugguggaaccuggagacaagaucacguucgaggccacaggcaaccugguggucccccgguacgcguuugccauggaacgcaacgcugggagcggaauuaucauuucugauaccccugugcaugacugcaauacaaccugucaaacccccaaaggcgccaucaacacaucccucccguuccagaauauccacccuauuacgaucggcaagugccccaaguauguuaaaagcaccaagcugagacuugcuacagggcugcggaacgugccuucuauucagagccgcggacucuuuggcgccaucgccggguucauugagggaggcuggaccgggauggucgacggaugguacggcuaucaucaccagaaugaacaaggcuccggguacgcugcggaucugaaaucuacacagaacgccaucgacaagagcaccaauaaagugaacuccguuaucgagaagaugaauacgcaguuuacagcugugggaaaggaguucaaccaccuugagaaaagaauugagaaucugaacaagaaagucgaugacggcuuccucgauaucuggaccuacaaugccgaacugcuggugcuccuggagaacgaacggacccuugacuaucaugauagcaaugucaagaaccuguacgagaaagugcgcucucagcucaagaacaaugccaaggagauugggaacggauguuuugaguucuaucacaaaugcgacaauacauguauggaauccguuaagaacggcaccuacgauuaucccaaauacagcgaagaggcuaagcugaauagagaagagaucgacggggugaaacuugagucuacacggauuuaucaaauccuggccaucuacuccacggucgcgagcucccucgugcugguugugucucugggcgcuauuagcuuuuggaugugcuccaacggaucucuccagugccgcaucuguauuuga

SEQ ID NO: 188033 - RNA, 1701 nt, Artificial Sequence; identical to SEQ ID NO: 186857
  derived and/or modified sequence opt5 from hemagglutinin__InfluenzaA__ADI24517

SEQ ID NO: 188034 - RNA, 1701 nt, Artificial Sequence; identical to SEQ ID NO: 186857
  derived and/or modified sequence opt5 from hemagglutinin__InfluenzaA__ADI24519

SEQ ID NO: 188035 - RNA, 1701 nt, Artificial Sequence; identical to SEQ ID NO: 186857
  derived and/or modified sequence opt5 from hemagglutinin__InfluenzaA__ADI24521

SEQ ID NO: 188036 - RNA, 1701 nt, Artificial Sequence; identical to SEQ ID NO: 187245
  derived and/or modified sequence opt5 from hemagglutinin__InfluenzaA__ADI24523

SEQ ID NO: 188037 - RNA, 1701 nt, Artificial Sequence
  derived and/or modified sequence opt5 from hemagglutinin__InfluenzaA__ADI24525
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuugugagcugagaggaguugcuccccuccaucugggcaagugcaacaucgccggguggauucugggaaauccugaaugugagucucucagcacagcccgguccuggucuuacaucguggaaaccagcuccucugacaacggcacgugcuauccgggggauuuuauugacuacgaggagcugcgcgaacagcuuagcuccgucagcucuuucgagagauuugaaaucuuccccaaaaccuccagcuggccuaaucacgauucuaacaagggagugacagccgcuuguccccaugccggcgcgaaguccuuuuauaaaaaucugaucuggcucguuaagaaaggcaacagcuacccuaagcugucuaaauccuauauuaaugacaaggggaaggaggugcuuguccuguggggaauccaccaccccagcaccuccgccgaucaacagucucucuaccagaacgcugacgccuacguguucgugggcacaagccgguauuccaaaaaguuuaaaccugagauugcuauccgcccgaaggucagagaucaggaagggcggaugaauuacuauuggacccugguugagcccggagacaaaauuacguucgaagccacaggcaaccugguggugccucgcuacgcguuugccauggagagaaacgcugggagcggaaucauuaucucugauacccccguccaugacugcaauacaaccugucaaaccccuaagggcgccaucaacacaucccuccccuuccagaauauucacccgaucacgauuggcaaaugcccuaaguauguuaagagcaccaaacugcggcuugcuacagggcugcgcaacgugcccucuauccagagcagaggacucuuuggcgccauugccggguucaucgaaggaggcuggaccgggaugguggacggaugguacggcuaucaucaccagaaugagcaaggcuccggguacgcugcggaucugaagucuacacagaacgccaucgacaaaauuaccaauaaggucaacagcgugaucgagaaaaugaauacgcaguuuacagcuguuggaaaggaguucaaccaccuugaaaagcggauugaaaaucugaacaaaaagguggaugacggcuuccucgauaucuggaccuacaaugccgagcugcugguccuccuggaaaacgagcgcacccuugacuaucaugauuccaaugugaaaaaccuguacgagaaggucaaaagccagcucaagaacaaugccaaggaaauugggaacggauguuuugaguucuaucacaaaugcgacaauacauguauggaaucugugaagaacggcaccuacgauuauccuaaauacuccgaggaagcuaagcugaauagagaggagaucgacgggguuaaacuugaaagcacacggaucuaucaaauucuggccaucuacucuacgguggcguccagccucguccuggugguuucccugggcgcuauuucuuuuuggaugugcagcaacggaucccuccagugccgcaucuguauuuga

SEQ ID NO: 188038 - RNA, 1701 nt, Artificial Sequence; identical to SEQ ID NO: 186857
  derived and/or modified sequence opt5 from hemagglutinin__InfluenzaA__ADI24527

SEQ ID NO: 188039 - RNA, 1701 nt, Artificial Sequence; identical to SEQ ID NO: 187245
  derived and/or modified sequence opt5 from hemagglutinin__InfluenzaA__ADI24529

SEQ ID NO: 188040 - RNA, 1701 nt, Artificial Sequence
  derived and/or modified sequence opt5 from hemagglutinin__InfluenzaA__ADI24531
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaggaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaccugguggugccucgguacgcguuugccauggaacgcaaugcugggucuggaaucauuaucuccgacacccccguccaugauugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacuccugggcgccauugccggguuuaucgagggaggcuggaccgggaugguggacggaugguacggcuaucaucaccagaacgaacaaggcucuggguacgcugcggaccuuaaaagcacacagaaugccaucgauaagauuaccaacaaagucaauuccgugaucgagaagaugaacacgcaguucacagcuguuggaaaggaguuuaaucaccuggaaaagagaauugagaaccucaauaagaaaguggacgauggcuuccuggacaucuggaccuacaacgccgaacugcucguccugcuugagaaugaacggacccuggauuaucaugacagcaacgugaagaaccucuacgagaaaguccgcucucagcugaagaauaacgccaaggagauugggaauggauguuucgaauuuuaucacaaaugcgauaacacauguauggaguccgugaagaauggcaccuacgacuauccuaaauacagcgaagaggcuaaacuuaacagagaagagaucgaugggguuaaacuggagucuacacggaucuaucaaauucucgccaucuacuccacgguggcgagcucccugguccuggugguuucucucggcgcuauuagcuucuggaugugcuccaauggaucucugcagugcaagaucuguauuuga

SEQ ID NO: 188041 - RNA, 1701 nt, Artificial Sequence
  derived and/or modified sequence opt5 from hemagglutinin__InfluenzaA__ADI24536
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcgaugcugggucuggaaucauuaucuccgacacccccguccaugacugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggauggaugguacggcuaucaucaccagaacgaacaaggcucuggguacgcugcggaccugaaaagcacacagaaugccaucgauaagauuaccaacaaagucaauuccgugaucgagaagaugaacacgcaguuuacagcuguuggaaaggaguucaaucaccuugagaaaagaauugagaaccugaauaagaaaaucgacgauggcuuccucgacauuuggaccuacaacgccgaacugcuggugcuccuggagaaugaacggacccuugauuaucaugacagcaacgucaagaaucuguacgagaaagugcgcucucagcucaagaacaacgccaaggagaucgggaauggauguuuugaguucuaucacaaaugcgauaacacauguauggaauccgucaagaauggcaccuacgacuauccuaaauacagcgaagaggcuaagcugaacagagaagagaucgauggggugaaacuugagucuacacggauuuaucaaauccuggccauuuacuccacgguugcgagcucccucgugcuggucgugucucugggcgcuaucagcuuuuggaugugcuccaauggaucucuccagugccgcauuuguaucuga

SEQ ID NO: 188042 - RNA, 1701 nt, Artificial Sequence; identical to SEQ ID NO: 186857
  derived and/or modified sequence opt5 from hemagglutinin__InfluenzaA__ADI24546

SEQ ID NO: 188043 - RNA, 1701 nt, Artificial Sequence; identical to SEQ ID NO: 186857
  derived and/or modified sequence opt5 from hemagglutinin__InfluenzaA__ADI24553

SEQ ID NO: 188044 - RNA, 1701 nt, Artificial Sequence; identical to SEQ ID NO: 186857
  derived and/or modified sequence opt5 from hemagglutinin__InfluenzaA__ADI24555

SEQ ID NO: 188045 - RNA, 1701 nt, Artificial Sequence
  derived and/or modified sequence opt5 from hemagglutinin__InfluenzaA__ADI24557
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaaauccuugugcuguggggcauucaccaccccuccaccucugccgaucaacagagccucuaccagaacgcugacgccuacgucuucgugggaacauccagauauagcaagaaauuuaagccugagaucgcuauucggccgaaagugcgcgaucaggaggggagaaugaauuacuauuggacccuggucgaacccggagacaagaucacguucgaggccacaggcaaccugguugugccucgguacgcguuugccauggaacgcaacgcugggucuggaauuaucaucuccgauacccccgugcaugacugcaauacaaccugucaaaccccuaaaggcgccauuaacacaagccuccccuuccagaauauccacccgauuacgaucggcaagugcccuaaguaugucaaaucuaccaagcugagacuugcuacagggcugcggaacgugcccagcauucagucccgcggacucuuuggcgccaucgccggguucaucgagggaggcuggaccgggaugguugacggaugguacggcuaucaucaccagaaugaacaaggcucuggguacgcugcggaucugaaaagcacacagaacgccauugacaagaucaccaauaaagugaacuccgucauugagaagaugaauacgcaguuuacagcugugggaaaggaguucaaccaccuugagaaaagaaucgagaaucugaacaagaaaguugaugacggcuuccucgauauuuggaccuacaaugccgaacugcuggugcuccuggagaacgaacggacccuugacuaucaugauagcaaugucaagaaccuguacgagaaagugcgcucucagcucaagaacaaugccaaggagaucgggaacggauguuuugaguucuaucacaaaugcgacaauacauguauggaauccgucaagaacggcaccuacgauuauccuaaauacagcgaagaggcuaagcugaauagagaagagaucgacggggugaaacuugagucuacacggauuuaucaaauccuggccauuuacuccacgguugcgagcucccucgugcuggucgugucucugggcgcuaucagcuuuuggaugugcuccaacggaucucuccagugccgcauuuguaucuga

SEQ ID NO: 188046 - RNA, 1701 nt, Artificial Sequence; identical to SEQ ID NO: 186857
  derived and/or modified sequence opt5 from hemagglutinin__InfluenzaA__ADI24559

SEQ ID NO: 188047 - RNA, 1701 nt, Artificial Sequence
  derived and/or modified sequence opt5 from hemagglutinin__InfluenzaA__ADI24561
augaaggccauccuggugauucuccuguacaccuucgcuacagccaacgcggacacgcuuugcaucggcuaucacgcuaauaacagcaccgauacagucgacaccguucuggagaaaaaugugacagugacccauuccgucaaccuccuggaagauaagcacgacgggaaacuuuguaagcugagaggaguggcuccccuccaucugggcaaaugcaauauugccggguggauccugggaaacccugagugugaaucucucagcacagccuccucuuggagcuacauuguugagaccuccucuagcgauaauggcacgugcuauccgggggacuuuaucgauuacgaagaacugcgggagcagcuuuccagcgugucuuccuucgaacgcuuugagaucuuccccaagaccagcucuuggccuaaccacgacuccaauaagggagucacagccgcuuguccccaugccggcgcgaaauccuuuuauaagaaccugauuuggcucgugaaaaagggcaauucuuacccuaaacuguccaagagcuauaucaacgauaaggggaaagaaguucuugugcuguggggcauucaccaccccuccaccucugccgaccaacagagccucuaccagaaugcugaugccuacgucuucgugggaacauccagauauagcaagaaauuuaagccugagaucgcuauucggccgaaagugcgcgaccaggaggggagaaugaacuacuauuggacccuggucgaacccggagauaagaucacguucgaggccacaggcaaucugguugugccucgguacgcguuugccauggaacgcaacgcugggucuggaauuaucaucuccgacacccccgugcaugacugcaacacaaccugucaaaccccuaaaggcgccauuaauacaagccuccccuuccagaacauccacccgauuacgaucggcaagugcccuaaguaugucaaaucuaccaagcugagacuugcuacagggcugcggaaugugcccagcauucagucccgcggacucuuuggcgccaucgccggguucaucgagggaggcuggaccgggaugguugauggaugguacggcuaucaucaccagaacgaacaaggcucuggguacgcugcggaccugaaaagcacacagaaugccauugauaagaucaccaacaaagugaauagcgucauugagaagaugaacacgcaguuuacagcugugggaaaggaguucaaucaccuugagaaaagaaucgagaaccugaauaagaaaguugacgauggcuuccucgacauuuggaccuacaacgccgaacugcuggugcuccuggagaaugaacggacccuugauuaucaugacagcaacgucaagaaucuguacgagaaagugcgcucucagcucaagaacaacgccaaggagaucgggaauggauguuuugaguucuaucacaaaugcgauaacacauguauggaauccgucaagaauggcaccuacgacuauccuaaauacagcgaagaggcuaagcugaacagagaagagaucgauggggugaaacuugagucuacacggauuuaucaaauccuggccauuuacuccacgguugcgagcucccucgugcuggucgugucucugggcgcuaucagcuuuuggaugugcuccaauggaucucuccagugccgcauuuguaucuga

SEQ ID NO: 188048 - RNA, 1701 nt, Artificial Sequence; identical to SEQ ID NO: 186857
  derived and/or modified sequence opt5 from hemagglutinin__InfluenzaA__ADI24563

SEQ ID NO: 188049 - RNA, 1701 nt, Artificial Sequence
  derived and/or modified sequence opt5 from hemagglutinin__InfluenzaA__ADI24565
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacgacgggaaacuuuguaagcugagaggaguugcuccccuccaucugggcaaaugcaauaucgccggguggauucugggaaacccugagugugaaucucucagcacagccuccucuuggagcuacaucguggagaccuccucuagcgauaauggcacgugcuauccgggggacuuuauugauuacgaggaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaaaaggugcuuguccuguggggaauccaccaccccuccaccucugccgaccaacagagccucuaccagaaugcugaugccuacguguucgugggcacauccagauauagcaaaaaguuuaaaccugaaauugcuauccggccgaagguccgcgaccaggaggggagaaugaacuacuauuggacccugguugagcccggagauaaaauuacguucgaagccacaggcaaucugguggugccucgguacgcguuugccauggagcgcaacgcugggucuggaaucauuaucuccgacacccccguccaugacugcaacacaaccugucaaaccccuaagggcgccaucaauacaagccuccccuuccagaacauucacccgaucacgauuggcaagugcccuaaauaugugaagucuaccaaacugagacuugcuacagggcugcggaauguucccagcauccagucccgcggacucuuuggcgccauugccggguucaucgaaggaggcuggaccgggaugguggauggaugguacggcuaucaucaccagaacgagcaaggcucuggguacgcugcggaccuuaagagcacacagaaugccaucgauaaaauuaccaacaaggucaauuccgugaucgaaaagaugaacacgcaguuuacagcuguuggaaaagaguucaaucaccuugagaagagaauugaaaaccugaauaaaaagguggacgauggcuuccucgacaucuggaccuacaacgccgagcugcugguccuccuggaaaaugagcggacccuugauuaucaugacagcaacgugaaaaaucuguacgaaaagguccgcucucagcucaagaacaacgccaaagagauugggaauggauguuuugaguucuaucacaagugcgauaacacauguauggaauccgugaaaaauggcaccuacgacuauccuaaguacagcgaggaagcuaaacugaacagagaggaaaucgaugggguuaagcuggagucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 188050 - RNA, 1701 nt, Artificial Sequence; identical to SEQ ID NO: 186857
  derived and/or modified sequence opt5 from hemagglutinin__InfluenzaA__ADI24567

SEQ ID NO: 188051 - RNA, 1701 nt, Artificial Sequence
  derived and/or modified sequence opt5 from hemagglutinin__InfluenzaA__ADI24569
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccaucgaacgcaacgcugggucuggaauuaucaucuccgauacccccguccaugacugcaauacaaccugucaaaccccuaaaggcgccauuaacacaagccuccccuuccagaauauccacccgauuacgaucggcaagugcccuaaguaugugaaaucuaccaagcugagacuugcuacagggcugcggaacguucccagcauucagucccgcggacucuuuggcgccaucgccggguucaucgagggaggcuggaccgggaugguggacggaugguacggcuaucaucaccagaaugaacaaggcucuggguacgcugcggaucugaaaagcacacagaacgccauugacaagaucaccaauaaagucaacuccgugauugagaagaugaauacgcaguuuacagcuguuggaaaggaguucaaccaccuugagaaaagaaucgagaaucugaacaagaaaguggaugacggcuuccucgauauuuggaccuacaaugccgaacugcugguccuccuggagaacgaacggacccuugacuaucaugauagcaaugugaagaaccuguacgagaaaguccgcucucagcucaagaacaaugccaaggagaucgggaacggauguuuugaguucuaucacaaaugcgacaauacauguauggaauccgugaagaacggcaccuacgauuauccuaaauacagcgaagaggcuaagcugaauagagaagagaucgacgggguuaaacuugagucuacacggauuuaucaaauccuggccauuuacuccacgguggcgagcucccucguccuggugguuucucugggcgcuaucagcuuuuggaugugcuccaacggaucucuccagugccgcauuuguaucuga

SEQ ID NO: 188052 - RNA, 1701 nt, Artificial Sequence; identical to SEQ ID NO: 186857
  derived and/or modified sequence opt5 from hemagglutinin__InfluenzaA__ADI24571

SEQ ID NO: 188053 - RNA, 1701 nt, Artificial Sequence; identical to SEQ ID NO: 187245
  derived and/or modified sequence opt5 from hemagglutinin__InfluenzaA__ADI24573

SEQ ID NO: 188054 - RNA, 1701 nt, Artificial Sequence
  derived and/or modified sequence opt5 from hemagglutinin__InfluenzaA__ADI24575
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaggaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaccugguggugccucgguacgcguuugccauggaacgcaaugcugggucuggaaucauuaucuccgacacccccguccaugauugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggacggaugguacggcuaucaucaccagaacgaacaaggcucuggguacgcugcggaccugaaaagcacacagaaugccaucgauaagauuaccaacaaagucaauuccgugaucgagaagaugaacacgcaguuuacagcuguuggaaaggaguucaaucaccuugaaaagagaauugagaaccugaauaagaaaguggacgauggcuuccucgacaucuggaccuacaacgccgaacugcugguccuccuggagaaugaacggacccuugauuaucaugacagcaacguggagaaccuguacgagaagguccgcucucagcucaaaaauaacgccaaggaaauugggaauggauguuuugaguucuaucacaagugcgauaacacauguauggaauccgugaaaaauggcaccuacgacuauccuaaguacagcgaggaagcuaaacugaacagagaggagaucgaugggguuaaacuugaaucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 188055 - RNA, 1701 nt, Artificial Sequence; identical to SEQ ID NO: 186857
  derived and/or modified sequence opt5 from hemagglutinin__InfluenzaA__ADI24577

SEQ ID NO: 188056 - RNA, 1701 nt, Artificial Sequence
  derived and/or modified sequence opt5 from hemagglutinin__InfluenzaA__ADI24581
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccgggugggugcugggaaauccugagugugaaucucucagcacagccuccucuuggagcuacauugucgagaccuccucuagcgacaacggcacgugcuauccgggggauuuuaucgacuacgaagaacugcgggagcagcuuuccagcgugucuuccuucgaacgcuuugagauuuuccccaagaccagcucuuggccuaaucacgauuccaacaagggaguuacagccgcuuguccccaugccggcgcgaaaucuuuuuauaagaaucugaucuggcucgugaaaaagggcaacagcuacccuaaacuguccaagagcuauaucaaugacaaggggaaagaaguccuugugcuguggggcauucaccaccccuccaccucugccgaucaacagagccucuaccagaacgcugacgccuacguguucgucggaacauccagauauagcaagaaauuuaagccugagaucgcuauucggccgaaaguucgcgaucaggaggggagaaugaauuacuauuggacccugguggaacccggagacaagaucacguucgaggccacaggcaaccugguggucccucgguacgcguuugccauggaacgcaacgcugggucuggaauuaucauuuccgauacccccgugcaugacugcaauacaaccugucaaaccccuaaaggcgccaucaacacaagccuccccuuccagaauauccacccgauuacgaucggcaagugcccuaaguauguuaaaucuaccaagcugagacuugcuacagggcugcggaacgugcccagcauucagucccgcggacucuuuggcgccaucgccggguucauugagggaggcuggaccgggauggucgacggaugguacggcuaucaucaccagaaugaacaaggcucuggguacgcugcggaucugaaaagcacacagaacgccaucgacaagaucaccaauaaagugaacuccguuauugagaagaugaauacgcaguuuacagcugugggaaaggaguucaaccaccuugagaaaagaaucgagaaucugaacaagaaagucgaugacggcuuccucgauauuuggaccuacaaugccgaacugcuggugcuccuggagaacgaacggacccuugacuaucaugauagcaaugucaagaaccuguacgagaaagugcgcucucagcucaagaacaaugccaaggagaucgggaacggauguuuugaguucuaucacaaaugcgacaauacauguauggaauccguuaagaacggcaccuacgauuauccuaaauacagcgaagaggcuaagcugaauagagaagagauugacggggugaaacuugagucuacacggaucuaucaaauccuggccauuuacuccacggucgcgagcucccucgugcugguugugucucugggcgcuaucagcuuuuggaugugcuccaacggaucucuccagugccgcauuuguaucuga

SEQ ID NO: 188057 - RNA, 1701 nt, Artificial Sequence
  derived and/or modified sequence opt5 from hemagglutinin__InfluenzaA__ADI24583
augaaggccauccuggugguccuccuguacaccuucgcuacagccaacgcggacacgcuuugcauuggcuaucacgcuaauaacagcaccgauacaguugacaccauccuggagaaaaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccaagagcuauaucaaugacaaggggaaagaaguucuugugcuguggggcauucaccaccccuccaccucugccgaucaacagagccucuaccagaacgcugacgccuacgucuucgugggaacauccagauauagcaagaaauuuaagccugagaucgcuauucggccgaaagugcgcgaucaggaggggagaaugaauuacuauuggacccuggucgaacccggagacaagaucacguucgaggccacaggcaaccugguugugccucgguacgcguuugccauggaacgcaacgcugggucuggaauuaucaucuccgauacccccgugcaugacugcaauacaaccugucaaaccccuaaaggcgccauuaacacaagccuccccuuccagaauauccacccgauuacgaucggcaagugcccuaaguaugucaaaucuaccaagcugagacuugcuacagggcugcggaacgugcccagcauucagucccgcggacucuuuggcgccaucgccggguucaucgagggaggcuggaccgggaugguugacggaugguacggcuaucaucaccagaaugaacaaggcucuggguacgcugcggaucugaaaagcacacagaacgccauugacaagaucaccaauaaagugaacuccgucauugagaagaugaauacgcaguuuacagcugugggaaaggaguucaaccaccuugagaaaagaaucgagaaucugaacaagaaaguugaugacggcuuccucgauauuuggaccuacaaugccgaacugcuggugcuccuggagaacgaacggacccuugacuaucaugauagcaaugucaagaaccuguacgagaaagugcgcucucagcucaagaacaaugccaaggagaucgggaacggauguuuugaguucuaucacaaaugcgacaauacauguauggaauccgucaagaacggcaccuacgauuauccuaaauacagcgaagaggcuaagcugaauagagaagagaucgacggggugaaacuugagucuacacggauuuaucaaauccuggccauuuacuccacgguugcgagcucccucgugcuggucgugucucugggcgcuaucagcuuuuggaugugcuccaacggaucucuccagugccgcauuuguaucuga

SEQ ID NO: 188058 - RNA, 1701 nt, Artificial Sequence
  derived and/or modified sequence opt5 from hemagglutinin__InfluenzaA__ADI24590
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgccaaccuccuggaagauaagcacaaugggaaacuuuguaagcugagaggaguggcuccccuccaucugggcaaaugcaacaucgccggguggauucugggaaauccugagugugaaucucucagcacagccuccucuuggagcuacaucguugagaccuccucuagcgacaacggcacgugcuauccgggggauuuuauugacuacgaagaacugcgggagcagcuuuccagcgugucuuccuucgaacgcuuugagaucuuccccaagaccagcucuuggccuaaucacgauuccaacaagggagucacagcugccuguccccaugcgggcgccaagagcuuuuauaaaaaucugaucuggcucgugaaaaagggcaacucuuacccuaaacuguccaagagcuauauuaaugacaaggggaaagaaguucuugugcuguggggaauccaccaccccuccaccucugcugaucaacagagccucuaccagaacgccgacgcuuacgucuucgugggcacauccagauauagcaagaaauuuaagccugagauugccauccggccgaaagugcgcgaucaggaggggagaaugaauuacuauuggacccuggucgaacccggagacaagauuacguucgaggcgacaggcaaccugguugugccucgguacgccuuugcuauggaacgcaacgccgggucuggaaucauuaucuccgauacccccgugcaugacugcaauacaaccugucaaaccccuaaaggcgcuaucaacacaagccuccccuuccagaauauucacccgaucacgauuggcaagugcccuaaguaugucaaaucuaccaagcugagacuugccacagggcugcggaacgugcccagcauccagucccgcggacucuuuggcgccauugcuggguucaucgagggaggcuggaccgggaugguugacggaugguacggcuaucaucaccagaaugaacaaggcucuggguacgcggccgaucugaaaagcacacagaacgcuaucgacaagauuaccaauaaagugaacuccgucaucgagaagaugaauacgcaguuuacagccgugggaaaggaguucaaccaccuugagaaaagaauugagaaucugaacaagaaaguugaugacggcuuccucgauaucuggaccuacaaugccgaacugcuggugcuccuggagaacgaacggacccuugacuaucaugauagcaaugucaagaaccuguacgagaaagugcgcucucagcucaagaacaaugcuaaggagauugggaacggauguuuugaguucuaucacaaaugcgacaauacauguauggaauccgucaagaacggcaccuacgauuauccuaaauacagcgaagaggccaagcugaauagagaagagaucgacggggugaaacuugagucuacacggaucuaucaaauucuggcgaucuacuccacgguugcuagcucccucgugcuggucgugucucugggcgccauuagcuuuuggaugugcuccaacggaucucuccagugccgcaucuguauuuga

SEQ ID NO: 188059 - RNA, 1701 nt, Artificial Sequence
  derived and/or modified sequence opt5 from hemagglutinin__InfluenzaA__ADI24597
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgccaaccuccuggaagauaagcacaaugggaaacuuuguaagcugagaggaguggcuccccuccaucugggcaacugcaauaucgccggguggauucugggaaacccugagugugaaucucucagcacagccuccucuuggagcuacaucguugagaccuccucuagcgacaauggcacgugcuauccgggggauuuuauugacuacgaagaacugcgggagcagcuuuccagcgugucuuccuucgaacgcuuugagaucuuccccaaaaccagcucuuggccuaaccacgauuccaauaagggagucacagcugccuguccccaugcgggcgccaagagcuuuuauaaaaaccugaucuggcucgugaagaaaggcaauucuuacccuaagcuguccaaaagcuauauuaacgacaaggggaaggaaguucuugugcuguggggaauccaccaccccuccaccucugcugaucaacagagccucuaccagaaugccgacgcuuacgucuucgugggcacauccagauauagcaaaaaguuuaaaccugagauugccauccggccgaaggugcgcgaucaggaggggagaaugaacuacuauuggacccuggucgaacccggagacaaaauuacguucgaggcgacaggcaaccugguugugccucgguacgccuuugcuauggaacgcaaugccgggucuggaaucauuaucuccgauacccccgugcaugacugcaacacaaccugucaaaccccuaagggcgcuaucaauacaagccuccccuuccagaacauucacccgaucacgauuggcaaaugcccuaaguaugucaagucuaccaaacugagacuugccacagggcugcggaaugugcccagcauccagucccgcggacucuuuggcgccauugcuggguucaucgagggaggcuggaccgggaugguugacggaugguacggcuaucaucaccagaacgaacaaggcucuggguacgcggccgaucuuaagagcacacagaaugcuaucgacaaaauuaccaacaaggucaauuccgugaucgagaaaaugaacacgcaguuuacagccgugggaaaggaguucaaucaccuugaaaagagaauugagaaccugaauaaaaagguugaugacggcuuccucgauaucuggaccuacaacgccgaacugcuggugcuccuggagaaugaacggacccuugacuaucaugauagcaacgucaaaaaccuguacgagaaggugcgcucucagcucaaaaauaacgcuaaggagauugggaauggauguuuugaguucuaucacaagugcgacaacacauguauggaguccgucaaaaauggcaccuacgauuauccuaaguacagcgaagaggccaaacugaacagagaagagaucgacggggugaagcuggagucuacacggaucuaucaaauucuggcgaucuacuccacgguugcuagcucccucgugcuggucgugucucugggcgccauuagcuuuuggaugugcuccaauggaucucuccagugccgcaucuguauuuga

SEQ ID NO: 188060 - RNA, 1701 nt, Artificial Sequence; identical to SEQ ID NO: 188058
  derived and/or modified sequence opt5 from hemagglutinin__InfluenzaA__ADI24612

SEQ ID NO: 188061 - RNA, 1701 nt, Artificial Sequence
  derived and/or modified sequence opt5 from hemagglutinin__InfluenzaA__ADI24619
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgccaaccuccuggaagauaagcacaaugggaaacuuuguaagcugagaggaguggcuccccuccaucugggcaaaugcaacaucgccggguggauucugggaaauccugagugugaaucucucagcacagccuccucuuggagcuacaucguugagaccuccucuagcgacaacggcacgugcuauccgggggauuuuauugacuacgaagaacugcgggagcagcuuuccagcgugucuuccuucgaacgcuuugagaucuuccccaagaccagcucuuggccuaaucacgauuccaacaagggagucacagcugccuguccccaugcgggcgccaagagcuuuuauaaaaaucugaucuggcucgugaaaaagggcaacucuuacccuaaacuguccaagagcuauauuaaugacaaggggaaagaaguucuugugcuguggggaauccaccaccccuccaccucugucgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacaagauuaccaauaaagucaacuccgugaucgagaagaugaauacgcaguuuacagcuguuggaaaggaguucaaccaccuugagaaaagaauugagaaucugaacaagaaaguggaugacggcuuccucgauaucuggaccuacaaugccgaacugcugguccuccuggagaacgaacggacccuugacuaucaugauagcaaugugaagaaccuguacgagaaaguccgcucucagcucaagaacaaugccaaggagauugggaacggauguuuugaguucuaucacaaaugcgacaauacauguauggaauccgugaagaacggcaccuacgauuauccuaaauacagcgaagaggcuaagcugaauagagaagagaucgacgggguuaaacuugagucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 188062 - RNA, 1701 nt, Artificial Sequence
  derived and/or modified sequence opt5 from hemagglutinin__InfluenzaA__ADI24621
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcacaaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacaagauuacgaauaaagucaacuccgugaucgagaagaugaauacacaguuuaccgccguuggaaaggaguucaaccaccuugagaaaagaauugagaaucugaacaagaaaguggaugacggcuuccucgauaucuggaccuacaaugcugaacugcugguccuccuggagaacgaacggacacuugacuaucaugauagcaaugugaagaaccuguacgagaaaguccgcucucagcucaagaacaaugccaaggagauugggaacggauguuuugaguucuaucacaaaugcgacaauaccuguauggaauccgugaagaacggcacauacgauuauccuaaauacagcgaagaggccaagcugaauagagaagagaucgacgggguuaaacuugagucuacgcggaucuaucaaauucuggcuaucuacuccaccguggccagcucccucguccugauugugucucugggcgcgaucagcuuuuggaugugcuccaacggaucucuccagugccgcauuuguaucuga

SEQ ID NO: 188063 - RNA, 1701 nt, Artificial Sequence
  derived and/or modified sequence opt5 from hemagglutinin__InfluenzaA__ADI48184
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaggaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggggcgcaacgcuggaucuggcaucauuaucuccgauacccccguccaugacugcaauacaaccugucaaaccccuaaaggcgccaucaacacaagccuccccuuccagaauauucacccgaucacgauugggaagugcccuaaguaugugaaaucuaccaagcugagacuugcuacaggacugcggaacguucccagcauccagucccgcggccucuuuggggccauugccggauucaucgaaggcggguggaccggaaugguggacggcugguacggcuaucaucaccagaaugagcaagggucuggauacgcugcggaucugaaaagcacacagaacgccaucgacaagauuaccaauaaagucaacuccgugaucgaaaagaugaauacgcaguuuacagcuguuggcaaggaguucaaccaccuugagaaaagaauugaaaaucugaacaagaaaguggaugacggguuccucgauaucuggaccuacaaugccgagcugcugguccuccuggaaaacgagcggacccuugacuaucaugauagcaaugugaagaaccuguacgaacgcgucagaucucagcucaaaaacaaugccaaggagauuggaaacggcuguuuugaguucuaucacaagugcgacaauacauguauggaauccgugaaaaacgggaccuacgauuauccuaaguacagcgaggaagcuaaacugaaucgggaggaaaucgacggcguuaaacuugagucuacacgcaucuaucaaauucuggccaucuacuccacgguggcgagcucccucguccuggugguuucucugggagcuauuagcuuuuggaugugcuccaacggcucucuccagugcagaaucuguauuuga

SEQ ID NO: 188064 - RNA, 1701 nt, Artificial Sequence; identical to SEQ ID NO: 186857
  derived and/or modified sequence opt5 from hemagglutinin__InfluenzaA__ADI48186

SEQ ID NO: 188065 - RNA, 1701 nt, Artificial Sequence
  derived and/or modified sequence opt5 from hemagglutinin__InfluenzaA__ADI48188
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucugauaucauuaucuccgacacccccguccaugacugcaauacaaccugucaaaccccuaaaggagccaucaacacaagccuccccuuccagaauauucacccgaucacgauuggcaagugcccuaaguaugugaaaucuaccaagcugagacuugcuacaggccugcggaacguucccagcauccagucccgcgggcucuuuggagccauugccggcuucaucgaagggggauggaccggcaugguggaugggugguacggauaucaucaccagaaugaacaaggcucuggcuacgcugcggaccugaaaagcacacagaacgccaucgauaagauuaccaauaaagucaacuccgugaucgagaagaugaauacgcaguuuacagcuguugggaaggaguucaaccaccuugagaaaagaauugagaaucugaacaagaaaguggacgauggauuccucgacaucuggaccuacaaugccgaacugcugguccuccuggagaacgaacggacccuugauuaucaugacagcaaugugaagaaccuguacgagaaaguccgcucucagcucaagaacaaugccaaggagauuggcaacggguguuuugaguucuaucacaaaugcgauaauacauguauggaguccgugaagaacggaaccuacgacuauccuaaauacagcgaagaggcuaagcugaauagagaagagaucgauggcguuaaacuugagucuacacggaucuaucaaauucuggccaucuacuccacgguggcgagcucccucguccuggugguuucucugggggcuauuagcuuuuggaugugcuccaacggcucucuccagugccgcaucuguauuuga

SEQ ID NO: 188066 - RNA, 1701 nt, Artificial Sequence
  derived and/or modified sequence opt5 from hemagglutinin__InfluenzaA__ADI48190
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacaagauuaccaauaaagucaacuccgugaucgagaagaugaauacgcaguuuacagcuguuggaaaggaguucaaccaccuugagaaaagaauugagaaucugaacaagaaaguggaugacggcuuccucgauaucuggaccuacaaugccgaacugcugguccuccuggagaacgaacggacccuugacuaucaugauagcaaugugaagaaccuguacgagaaaguccgcucucagcucaagaacaaugccaaggagauugggaacggauguuuugaguucuaucacaaaugcgacaauacauguauggaauccgugaagaacggcaccuacgauuauccuaaauacagcgaagaggcuaagcugaauagagaagagaucgacgggguuaaacuugagucuacaaagaucuaucaaauucuggccaucuacuccacgguggcgagcucccucguccuggugguuucucugggcgcuauuagcuuuuggaugugcuccaacggaucucuccagugccggaucuguauuuga

SEQ ID NO: 188067 - RNA, 1701 nt, Artificial Sequence
  derived and/or modified sequence opt5 from hemagglutinin__InfluenzaA__ADI48192
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacaagauuaccaauaaagucaacuccgugaucgagaagaugaauacgcaguuuacagcuguuggaaaggaguucaaccaccuugagaaaagaauugagaaucugaacaagaaaguggaugacggcuuccucgauaucuggaccuacaaugccgaacugcugguccuccuggagaacgaacggacccuugacuaucaugauagcaaugugaagaaccuguacgagaaaguccgcucucagcucaagaacaaugccaaggagauugggaacggauguuuugaguucuaucacaaaugcgacaauacauguauggaauccgugaagaacggcaccuacgauuauccuaaauacagcgaagaggcuaagcugaauagagaagagaucgacgggguuaaacuugagucuacacggaucuaucaaauucugacgaucuacuccaccguggccagcucccucguccuggugguuucucugggcgcgauuagcuuuuggaugugcuccaacggaucucuccagugccgcaucuguauuuga

SEQ ID NO: 188068 - RNA, 1701 nt, Artificial Sequence
  derived and/or modified sequence opt5 from hemagglutinin__InfluenzaA__ADI48194
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuucccuggucagcucuuucgaacgcuuugagaucuuccccaagaccaauuccuggccuaaccacgauagcaauaagggagugacagccgcuuguccccaugccggcgcgaaaucuuuuuauaagaaccucaucuggcugguuaaaaagggcaauuccuacccuaaacuuagcaagucuuauauuaacgacaaggggaaagaagugcugguccucuggggaauccaccaccccuccaccagcgccgaucaacagucccuguaccagaaugcugacgccuacguguucgugggcacaucuagauauagcaagaaauuuaagccugagauugcuauccggccgaaaguccgcgaucaggaggggagaaugaacuacuauuggacccugguugaacccggagacaagauuacguucgaggccacaggcaaccucguggugccucgguacgcguuugccauggaacgcaaugcuggguccggaaucauuaucagcgauacccccguccaugacugcaacacaaccugucaaaccccuaaaggcgccaucaauacaucucugcccuuccagaacauucacccgaucacgauuggcaagugcccuaaguaugugaaauccaccaaacuuagacuggcuacagggcuccggaauguucccagcauccagucucgcggacuguuuggcgccauugccggguucaucgagggaggcuggaccgggaugguggacggaugguacggcuaucaucaccagaacgaacaaggcagcggguacgcugcggaucuuaaauccacacagaaugccaucgacaagauuaccaacaaagucaauucugugaucgagaagaugaacacgcaguuuacagcuguuggaaaggaguucaaucaccuggaaaagagaauugagaaccucaauaagaaaguggaugacggcuuccuggauaucuggaccuacaacgccgaacugcucguccugcuugagaaugaacggacccuggacuaucaugauagcaacgugaagaaccucuacgagaaaguccgcucccagcugaagaauaacgccaaggagauugggaauggauguuuugaguucuaucacaaaugcgacaacacauguauggagagcgugaagaauggcaccuacgauuauccuaaauacucugaagaggcuaaacuuaacagagaagagaucgacgggguuaagcuggaguccacacggaucuaucaaauucucgccaucuacagcacgguggcgucuucccugguccuggugguuagccucggcgcuauuuccuuuuggaugugcucuaauggaagccugcagugccgcaucuguauuuga

SEQ ID NO: 188069 - RNA, 1701 nt, Artificial Sequence
  derived and/or modified sequence opt5 from hemagglutinin__InfluenzaA__ADI48196
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacaagauuaccaauaaagucaacuccgugaucgagaagaugaauacgcaguuuacagcuguuggaaaggaguucaaccaccuugagaaaagaauugagaaucugaacaagaaaguggaugacggcuuccucgauaucuggaccuacaaugccgaacugcugguccuccuggagaacgaacggacccuugacuaucaugauagcaaugugaagaaccuguacgagaaaguccgcucucagcucaagaacaaugccaaggagauugggaacggauguuuugaguucuaucacaaaugcgacaauacauguauggaauccgugaagaacggcaccuacgauuauccuaaauacagcgaagaggcuaagcugaauagagaagagaucgacgggguuaaacuugauucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 188070 - RNA, 1701 nt, Artificial Sequence; identical to SEQ ID NO: 186857
  derived and/or modified sequence opt5 from hemagglutinin__InfluenzaA__ADI48198

SEQ ID NO: 188071 - RNA, 1701 nt, Artificial Sequence; identical to SEQ ID NO: 186857
  derived and/or modified sequence opt5 from hemagglutinin__InfluenzaA__ADI48200

SEQ ID NO: 188072 - RNA, 1701 nt, Artificial Sequence
  derived and/or modified sequence opt5 from hemagglutinin__InfluenzaA__ADI48202
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaucagcucuuggccuaaucacgauuccaacaagggagugaccgccgcuuguccccaugccggcgcgaaaucuuuuuauaagaaucugauuuggcucguuaaaaagggcaacagcuacccuaaacuguccaagagcuauaucaaugacaaggggaaagaagugcuuguccuguggggcauucaccaccccuccacaucugccgaucaacagagccucuaccagaacgcugacgccuacguguucgugggaaccuccagauauagcaagaaauuuaagccugagaucgcuauucggccgaaaguccgcgaucaggaggggagaaugaauuacuauuggacacugguugaacccggagacaagaucaccuucgaggccacgggcaaccugguggugccucgguacgcguuugccauggaacgcaacgcugggucuggaauuaucaucuccgauacacccguccaugacugcaauaccacaugucaaaccccuaaaggcgccauuaacaccagccuccccuuccagaauauccacccgauuacaaucggcaagugcccuaaguaugugaaaucuacgaagcugagacuugcuaccgggcugcggaacguucccagcauucagucccgcggacucuuuggcgccaucgccggguucaucgagggaggcuggacagggaugguggacggaugguacggcuaucaucaccagaaugaacaaggcucuggguacgcugcggaucugaaaagcacccagaacgccauugacaagaucacaaauaaagucaacuccgugauugagaagaugaauacccaguuuacggcuguuggaaaggaguucaaccaccuugagaaaagaaucgagaaucugaacaagaaaguggaugacggcuuccucgauauuuggacauacaaugccgaacugcugguccuccuggagaacgaacggacccuugacuaucaugauagcaaugugaagaaccuguacgagaaaguccgcucucagcucaagaacaaugccaaggagaucgggaacggauguuuugaguucuaucacaaaugcgacaauaccuguauggaauccgugaagaacggcacauacgauuauccuaaauacagcgaagaggcuaagcugaauagagaagagaucgacgggguuaaacuugagucuacccggauuuaucaaauccuggccauuuacuccacaguggcgagcucccucguccuggugguuucucugggcgcuaucagcuuuuggaugugcuccaacggaucucuccagugccgcauuuguaucuga

SEQ ID NO: 188073 - RNA, 1701 nt, Artificial Sequence
  derived and/or modified sequence opt5 from hemagglutinin__InfluenzaA__ADI48204
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaauccuuuuauaagaaucugaucuggcucguuaaaaagggcaacucuuacccuaaacuguccaagagcuauauuaaugacaaggggaaagaagugcuuguccuguggggaauccaccaccccuccaccucugccgaucaacagagccucuaccagaacguggacgcuuacguguucgucggcacauccagauauagcaagaaauuuaagccugagauugccauccggccgaaaguucgcgaucaggaggggagaaugaauuacuauuggacccugguggaacccggagacaagauuacguucgaggcuacaggcaaccugguggucccucgguacgccuuugcgauggaacgcaacgccgggucuggaaucauuaucuccgauacccccgugcaugacugcaauacaaccugucaaaccccuaaaggcgcuaucaacacaagccuccccuuccagaauauucacccgaucacgauuggcaagugcccuaaguauguuaaaucuaccaagcugagacuugccacagggcugcggaacgugcccagcauccagucccgcggacucuuuggcgcuauugccggguucaucgagggaggcuggaccgggauggucgacggaugguacggcuaucaucaccagaaugaacaaggcucuggguacgccgcugaucugaaaagcacacagaacgcgaucgacaagauuaccaaaaaggugaauagcguuaucgagaagaugaacacgcaguuuacagccgugggaaaagaguucaaucaccuugaaaagagaauugagaaccugaauaaaaaggucgaugacggcuuccucgauaucuggaccuacaacgcugaacugcuggugcuccuggagaaugaacggacccuugacuaucaugauagcaacgucaaaaaucuguacgagaaggugcgcucucagcucaagaacaacgccaaagagauugggaauggauguuuugaguucuaucacaagugcgacaacacauguauggaguccguuaaaaauggcaccuacgauuauccuaaguacagcgaagaggccaaacugaacagagaagagaucgacggggugaaacuugagucuacacggaucuaucaaauucuggcuaucuacuccacggucgccagcucccucgugcugguugugucucugggcgcgauuagcuuuuggaugugcuccaauggaucucuccagugccgcaucuguauuuga

SEQ ID NO: 188074 - RNA, 1701 nt, Artificial Sequence; identical to SEQ ID NO: 186857
  derived and/or modified sequence opt5 from hemagglutinin__InfluenzaA__ADI48208

SEQ ID NO: 188075 - RNA, 1701 nt, Artificial Sequence; identical to SEQ ID NO: 186857
  derived and/or modified sequence opt5 from hemagglutinin__InfluenzaA__ADI48210

SEQ ID NO: 188076 - RNA, 1701 nt, Artificial Sequence
  derived and/or modified sequence opt5 from hemagglutinin__InfluenzaA__ADI48212
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacaagauuaccaauaaagucaacuccgugaucgagaagaugaauacgcaguuuacagcuguuggaaaggaguucaaccaccuugagaaaagaauugagaaucugaacaagaaaguggaugacggcuuccucgaugucuggaccuacaaugccgaacugcuggugcuccuggagaacgaacggacccuugacuaucaugauagcaaugucaagaaccuguacgagaaagugcgcucucagcucaagaacaaugccaaggagaucgggaacggauguuuugaguucuaucacaaaugcgacaauacauguauggaauccguuaagaacggcaccuacgauuauccuaaauacagcgaagaggcuaagcugaauagagaagagauugacggggugaaacuugagucuacacggaucuaucaaauccuggccauuuacuccacggucgcgagcucccucgugcugguugugucucugggcgcuaucagcuuuuggaugugcuccaacggaucucuccagugccgcauuuguaucuga

SEQ ID NO: 188077 - RNA, 1701 nt, Artificial Sequence
  derived and/or modified sequence opt5 from hemagglutinin__InfluenzaA__ADI48214
augaaggccauccuggugguccuccuguacaccuucgcuauugccaacgcggacacacuuugcaucggcuaucacgcuaauaacagcacggauaccguugacacagugcuggagaaaaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacauccucuagcgacaacggaaccugcuauccgggggauuuuaucgacuacgaagaacugcgggagcagcuuuccagcgucucuuccuucgaacgcuuugagaucuuccccaagacgagcucuuggccuaaucacgauuccaacaagggagugaccgccgcuuguccccaugccggcgcgaaaucuuuuuauaagaaucugauuuggcucguuaaaaagggcaacagcuacccuaaacuguccaagagcuauaucaaugacaaggggaaagaagugcuuguccuguggggcauucaccaccccuccacaucugccgaucaacagagccucuaccagaacgcugacgccuacguguucgugggcaccuccagauauagcaagaaauuuaagccugagaucgcuauucggccgaaaguccgcgaucaggaggggagaaugaauuacuauuggacacugguugaacccggagacaagaucaccuucgaggccacgggcaaccugguggugccucgguacgcguuugccauggaacgcaacgcugggucuggaauuaucaucuccgauacacccguccaugacugcaauaccacaugucaaaccccuaaaggcgccauuaacaccagccuccccuuccagaauauccacccgauuacaaucggcaagugcccuaaguaugugaaaucuacgaagcugagacuugcuaccgggcugcggaacguucccagcauucagucccgcggacucuuuggcgccaucgccggguucaucgagggaggcuggacagggaugguggacggaugguacggcuaucaucaccagaaugaacaaggcucuggguacgcugcggaucugaaaagcacccagaacgccauugacaagaucacaaauaaagucaacuccgugauugagaagaugaauacccaguuuacggcuguuggaaaggaguucaaccaccuugagaaaagaaucgagaaucugaacaagaaaguggaugacggcuuccucgauauuuggacauacaaugccgaacugcugguccuccuggagaacgaacggacccuugacuaucaugauagcaaugugaagaaccuguacgagaaaguccgcucucagcucaagaacaaugccaaggagaucgggaacggauguuuugaguucuaucacaaaugcgacaauaccuguauggaauccgugaagaacggcacauacgauuauccuaaauacagcgaagaggcuaagcugaauagagaagagaucgacgggguuaaacuugagucuacccggauuuaucaaauccuggccauuuacuccacaguggcgagcucccucguccuggcugugucucugggcgccaucagcuuuuggaugugcuccaacggaucucuccagugccgcauuuguaucuga

SEQ ID NO: 188078 - RNA, 1701 nt, Artificial Sequence; identical to SEQ ID NO: 188076
  derived and/or modified sequence opt5 from hemagglutinin__InfluenzaA__ADI48216

SEQ ID NO: 188079 - RNA, 1701 nt, Artificial Sequence
  derived and/or modified sequence opt5 from hemagglutinin__InfluenzaA__ADI48218
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacaagauuaccaauaaagucaacuccgugaucgagaagaugaauacgcaguuuacagcuguuggaaaggaguucaaccaccuugagaaaagaauugagaaucugaacaagaaaguggaugacggcuuccucgauaucuggaccuacaaugccgaacugcugguccuccuggagaacgaacggacccuugacuaucaggauagcaaugugaagaaccuguacgagaaaguccgcucucaacucaagaacaaugccaaggagauugggaacggauguuuugaguucuaucauaaaugcgacaauacauguauggaauccgugaagaacggcaccuacgauuauccuaaauacagcgaagaggcuaagcugaauagagaagagaucgacgggguuaaacuugagucuacacggaucuaucagauucuggccaucuacuccacgguggcgagcucccucguccuggugguuucucugggcgcuauuagcuuuuggaugugcuccaacggaucucuccagugccgcaucuguauuuga

SEQ ID NO: 188080 - RNA, 1701 nt, Artificial Sequence
  derived and/or modified sequence opt5 from hemagglutinin__InfluenzaA__ADI48220
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgagacaaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacaagauuacgaauaaagucaacuccgugaucgagaagaugaauacacaguuuaccgccguuggaaaggaguucaaccaccuugagaaaagaauugagaaucugaacaagaaaguggaugacggcuuccucgauaucuggaccuacaaugcugaacugcugguccuccuggagaacgaacggacacuuggguaucaugacagcaaugugaagaaccuguacgagaaaguccgcucucagcucaagaacaaugccaaggagauuggaaacggcuguuuugaguucuaucacaaaugcgauaauaccuguauggaauccgugaagaacgggacauacgacuauccuaaauacagcgaagaggccaagcugaauagagaagagaucgauggcguuaaacuugagucuacgcggaucuaucaaauucuggcuaucuacuccaccguggccagcucccucguccuggugguuucucugggagcgauuagcuuuuggaugugcuccaacggcucucuccagugccgcaucuguauuuga

SEQ ID NO: 188081 - RNA, 1701 nt, Artificial Sequence
  derived and/or modified sequence opt5 from hemagglutinin__InfluenzaA__ADI48622
augaaggccauccugguguuccuccuguacaccuuugcuacagccaacgcggacacgcuuugcauuggcuaucacgcuaauaacagcaccgauacagucgacaccguucuggagaagaaugugacagugacccauuccgucaaccuccuggaagauaagcacaaugggaaacuuuguaagcugagaggaguggcuccccuccaucugggcaaaugcaacaucgccggguggauucugggaaauccugagugugaaucucucagcacagccuccucuuggagcuacaucguugagaccuccucuagcgacaacggcacgugcuauccgggggauuucauugacuacgaagaacugcgggagcagcuuuccagcgugucuuccuuugaacgcuucgagaucuuucccaagaccagcucuuggccuaaucacgauuccaacaagggagucacagccgcuuguccccaugccggcgcgaaaucuuucuauaagaaucugaucuggcucgugaaaaagggcaacagcuacccuaaacuguccaagagcuauauuaaugacaaggggaaagaaguucuugugcuguggggaauccaccaccccuccaccucugccgaucaacagagccucuaccagaacgcugacgccuacgucuuugugggcacauccagauauagcaagaaauucaagccugagauugcuauccggccgaaagugcgcgaucaggaggggagaaugaauuacuauuggacccuggucgaacccggagacaagauuacguuugaggccacaggcaaccugguugugccucgguacgcguucgccauggaacgcaacgcugggucuggaaucauuaucuccgauacccccgugcaugacugcaauacaaccugucaaaccccuaaaggcgccaucaacacaagccuccccuuucagaauauucacccgaucacgauuggcaagugcccuaaguaugucaaaucuaccaagcugagacuugcuacagggcugcggaacgugcccagcauccagucccgcggacucuucggcgccauugccggguuuaucgagggaggcuggaccgggaugguugacggaugguacggcuaucaucaccagaaugaacaaggcucuggguacgcugcggaucugaaaagcacacagaacgccaucgacgagauuaccaauaaggugaacuccgucaucgagaaaaugaauacgcaguucacagcugugggaaaggaguucaaccaccuugagaagagaauugaaaaucugaacaaaaagguugaugacggcuuucucgauaucuggaccuacaaugccgagcugcuggugcuccuggaaaacgagcggacccuugacuaucaugauagcaaugucaaaaaccuguacgagaaggugcgcucucagcucaaaaacaaugccaaggaaauugggaacggauguuucgaguuuuaucacaagugcgacaauacauguauggaauccgucaaaaacggcaccuacgauuauccuaaguacagcgaggaagcuaaacugaauagagaggagaucgacggggugaaacuugaaucuacacggaucuaucaaauucuggccaucuacuccacgguugcgagcucccucgugcuggucgugucucugggcgcuauuagcuucuggaugugcuccaacggaucucuccagugccgcaucuguauuuga

SEQ ID NO: 188082 - RNA, 1701 nt, Artificial Sequence
  derived and/or modified sequence opt5 from hemagglutinin__InfluenzaA__ADI48632
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggagugcaccaccccuccaccucugccgaucaacagagccucuaccagaacgcugacgccuacguguucgucggcuccagcagauauucuaaaaaguuuaaaccugagaucgcuauucggccgaagguucgcgaucaggaagggagaaugaauuacuauuggacacugguggagcccggagacaaaaucaccuucgaagccacgggcaaccugguggucccucgguacgcguuugccauggagcgcaacgcuggguccggaauuaucauuagcgauacacccgugcaugacugcaauaccacaugucaaaccccuaagggcgccaucaacaccucucuccccuuccacaauauccauccgauuacaaucggcaaaugcccuaaguauguuaagagcacgaaacugagacuugcuaccgggcugcggaacgugcccuccauucagucucgcggacucuuuggcgccaucgccggguucauugaaggaggcuggacagggauggucgacggaugguacggcuaucaccaccagaaugagcagggcagcggguacgcugcggaucugaaguccacccaaaacgccaucgacgagaucacaaauaaagugaacagcguuauugaaaagaugaauacccaguuuacggcugugggaaaagaguucaaccaucuugaaaagagaaucgagaaucugaacaagaaagucgaugacggcuuccucgauauuuggacauacaaugccgaacugcuggugcuccuggagaacgagcggacccuugacuaucacgauucuaaugucaagaaccuguacgaaaaagugcgcucccagcucaagaacaaugccaaagagaucgggaacggauguuuugaguucuaucauaagugcgacaauaccuguauggaaagcguuaagaacggcacauacgauuauccuaaauacucugaagaggcuaagcugaauagagaggaaauugacggggugaaacuugaguccacccggaucuaucagauccuggccauuuacagcacagucgcguccucucucgugcugguugugagccugggcgcuaucuccuuuuggaugugcucuaacggaagccuccaaugccgcauuuguaucuga

SEQ ID NO: 188083 - RNA, 1701 nt, Artificial Sequence; identical to SEQ ID NO: 185935
  derived and/or modified sequence opt5 from hemagglutinin__InfluenzaA__ADI48642

SEQ ID NO: 188084 - RNA, 1701 nt, Artificial Sequence; identical to SEQ ID NO: 185935
  derived and/or modified sequence opt5 from hemagglutinin__InfluenzaA__ADI48652

SEQ ID NO: 188085 - RNA, 1701 nt, Artificial Sequence
  derived and/or modified sequence opt5 from hemagglutinin__InfluenzaA__ADI48672
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaaacugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaauaaccugaucuggcucguuaaaaagggcaauucuuacccuaaacuguccaagagcuauauuaacgacaaagggaaggaggugcuuguccuguggggaauccaccaccccuccaccucugccgaucaacagagccucuaccagaaugcugacgccuacguguucgugggcuccagcagauauucuaagaaauuuaagccugagauugcuauccggccgaaaguccgcgaucaggaagggagaaugaacuacuauuggacacugguugagcccggagacaagauuaccuucgaagccacgggcaaccugguggugccucgguacgcguuugccauggagcgcaaugcuggguccggaaucauuaucagcgauacacccguccaugacugcaacaccacaugucaaaccccuaaaggcgccaucaauaccucucuccccuuccacaacauucauccgaucacaauuggcaagugcccuaaauauguuaagagcacgaagcugagacuugcuaccgggcugcggaaugugcccuccauccagucucgcggacucuuuggcgccauugccggguucaucgaaggaggcuggacagggaugguggacggaugguacggcuaucaccaccagaacgagcagggcagcggguacgcugcggaucugaaauccacccaaaaugccaucgacgagauuacaaacaaggucaauagcgugaucgaaaagaugaacacccaguuuacggcuguuggaaaggaguucaaucaucuugaaaagagaauugagaaccugaauaagaagguggaugacggcuuccucgauaucuggacauacaacgccgaacugcugguccuccuggagaaugagcggacccuugacuaucacgauucuaacgugaaaaaccuguacgaaaagguccgcucccagcucaaaaauaacgccaaggagauugggaauggauguuuugaguucuaucauaaaugcgacaacaccuguauggaaagcgugaagaauggcacauacgauuauccuaaguacucugaagaggcuaaacugaacagagaggaaaucgacgggguuaaacuugaguccacccggaucuaucagauucuggccaucuacagcacaguggcguccucucucguccuggugguuagccugggcgcuauuuccuuuuggaugugcucuaauggaagccuccaaugccgcaucuguauuuga

SEQ ID NO: 188086 - RNA, 1701 nt, Artificial Sequence; identical to SEQ ID NO: 185693
  derived and/or modified sequence opt5 from hemagglutinin__InfluenzaA__ADI48682

SEQ ID NO: 188087 - RNA, 1701 nt, Artificial Sequence; identical to SEQ ID NO: 185935
  derived and/or modified sequence opt5 from hemagglutinin__InfluenzaA__ADI48692

SEQ ID NO: 188088 - RNA, 1701 nt, Artificial Sequence; identical to SEQ ID NO: 185873
  derived and/or modified sequence opt5 from hemagglutinin__InfluenzaA__ADI48702

SEQ ID NO: 188089 - RNA, 1701 nt, Artificial Sequence; identical to SEQ ID NO: 185935
  derived and/or modified sequence opt5 from hemagglutinin__InfluenzaA__ADI48712

SEQ ID NO: 188090 - RNA, 1701 nt, Artificial Sequence; identical to SEQ ID NO: 185935
  derived and/or modified sequence opt5 from hemagglutinin__InfluenzaA__ADI48722

SEQ ID NO: 188091 - RNA, 1701 nt, Artificial Sequence; identical to SEQ ID NO: 185693
  derived and/or modified sequence opt5 from hemagglutinin__InfluenzaA__ADI48732

SEQ ID NO: 188092 - RNA, 1701 nt, Artificial Sequence; identical to SEQ ID NO: 185693
  derived and/or modified sequence opt5 from hemagglutinin__InfluenzaA__ADI48742

SEQ ID NO: 188093 - RNA, 1701 nt, Artificial Sequence
  derived and/or modified sequence opt5 from hemagglutinin__InfluenzaA__ADI48752
auggaggccauccugguguuccuccuguacaccuuugcuacagccaacgcggacacgcuuugcauuggcuaucacgcuaauaacagcaccgauacagucgacaccguucuggaaaagaaugugacagugacccauuccgucaaccuccuggaggauaaacacaaugggaaacuuuguaagcugagaggaguggcgccccuccaucugggcaagugcaacaucgccggguggauucugggaaauccugaaugugagucucucagcacagcuuccucuuggagcuacaucguugaaaccuccucuagcgacaacggcacgugcuauccgggggauuucauugacuacgaggagcugcgggaacagcuuuccagcgugucuuccuuugagcgcuucgaaaucuuucccaaaaccagcucuuggccuaaucacgauuccaacaagggaaucacagccgcuuguccccaugccggcgccaagagcuucuauaaaaaucugauuuggcucgucaagaaaggcaacucuuacccuaagcuguccaaaagcuauaucaaugacaaggggaaggaggugcuuguucuguggggcauucaccaccccuccaccucugccgaucaacagagccucuaccagaacgcugacgccuacguguuugucggauccagcagauauucuaaaaaguucaaaccugagaucgcuauucggccgaaggugcgcgaucaggaagggagaaugaauuacuauuggacacugguggagcccggagacaaaaucaccuuugaagccacgggcaaccuggucguuccucgguacgcguucgccauggagcgcaacgcuggguccggaauuaucaucagcgauacacccgugcaugacugcaauaccacaugucaaaccccuaagggcgccauuaacaccucucuccccuuucacaauauccauccgauuacaaucggcaaaugcccuaaguaugucaagagcacgaaacugagacuugcuaccgggcugcggaacgugcccuccauucagucucgcggacucuucggcgccaucgccggguuuaucgaaggaggcuggacagggaugguggacggaugguacggcuaucaccaccagaaugagcagggcagcggguacgcugcggaucugaaguccacccaaaacgccauugacgagaucacaaauaaaguuaacagcgugauugaaaagaugaauacccaguucacggcugucggaaaagaguucaaccaucuugaaaagagaaucgagaaucugaacaagaaaguggaugacggcuuucucgauauuuggacauacaaugccgaacugcugguucuccuggagaacgagcggacccuugacuaucacgauucuaaugugaagaaccuguacgaaaaaguccgcucccagcucaagaacaaugccaaagagaucgggaacggauguuucgaauuuuaucauaagugcgacaauaccuguauggagagcgugaagaacggcacauacgauuauccuaaauacucugaagaggcuaagcugaauagagaggaaaucgacggggucaaacuugaguccacccggauuuaucagauccuggccauuuacagcacaguggcguccucucucguucugguggucagccugggcgcuaucuccuucuggaugugcucuaacggaagccuccaaugccgcauuuguaucuga

SEQ ID NO: 188094 - RNA, 1701 nt, Artificial Sequence; identical to SEQ ID NO: 185935
  derived and/or modified sequence opt5 from hemagglutinin__InfluenzaA__ADI48762

SEQ ID NO: 188095 - RNA, 1701 nt, Artificial Sequence
  derived and/or modified sequence opt5 from hemagglutinin__InfluenzaA__ADI48772
auggaggccauccuggugguccuccuguacaccuucgcuacagccaacgcggacacgcuuugcauuggcuaucaggcuaauaacagcaccgauacaguugacaccgugcuggaaaagaaugugacagucacccacuccgugaaccuccuggaggauaaacauaaugggaaacuuuguaagcugagaggaguugcgccccuccaccugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacaacuuuccagcgucucuuccuucgagcgcuuugaaaucuuccccaaaaccagcucuuggccuaaucaugauuccaacaagggagugacagccgcuuguccccacgccggcgccaagagcuuuuauaaaaaucugaucuggcucguuaagaaaggcaacucuuacccuaagcuguccaaaagcuauauuaaugacaaggggaaggaggugcuuguccuguggggaauccaucaccccuccaccucugccgaucagcagagccucuaccagaacgcugacgccuacguguucgugggcuccagcagauauucuaaaaaguuuaaaccugagauugcuauccggccgaagguccgcgaucaagaagggagaaugaauuacuauuggacacugguugagcccggagacaaaauuaccuucgaagccacgggcaaccugguggugccucgguacgcguuugccauggagcgcaacgcuggguccggaaucauuaucagcgauacacccguccacgacugcaauaccacaugucagaccccuaagggcgccaucaacaccucucuccccuuccauaauauucacccgaucacaauuggcaaaugcccuaaguauguuaagagcacgaaacugagacuugcuaccgggcugcggaacgugcccuccauccagucucgcggacucuuuggcgccauugccggguucaucgaaggaggcuggacagggaugguggacggaugguacggcuaucaucaccagaaugagcaaggcagcggguacgcugcggaucugaaguccacccagaacgccaucgacgagauuacaaauaaagucaacagcgugaucgaaaagaugaauacccaguuuacggcuguuggaaaagaguucaaccaccuugaaaagagaauugagaaucugaacaagaaaguggaugacggcuuccucgauaucuggacauacaaugccgaacugcugguccuccuggagaacgagcggacccuugacuaucaugauucuaaugugaagaaccuguacgaaaaaguccgcucccagcucaagaacaaugccaaagagauugggaacggauguuuugaguucuaucacaagugcgacaauaccuguauggaaagcgugaagaacggcacauacgauuauccuaaauacucugaagaggcuaagcugaauagagaggaaaucgacgggguuaaacuugaguccacccggaucuaucaaauucuggccaucuacagcacaguggcguccucucucguccuggugguuagccugggcgcuauuuccuuuuggaugugcucuaacggaagccuccagugccgcaucuguauuuga

SEQ ID NO: 188096 - RNA, 1701 nt, Artificial Sequence
  derived and/or modified sequence opt5 from hemagglutinin__InfluenzaA__ADI48782
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaaucuaaacugaauagagaggagaucgacgggguuaaacuugaauccacacggaucuaucaaauucuggcuaucuacagcacgguggccuccucucucguccuggugguuagccugggcgcgauuuccuuuuggaugugcucuaacggaagccuccagugccgcaucuguauuuga

SEQ ID NO: 188097 - RNA, 1701 nt, Artificial Sequence
  derived and/or modified sequence opt5 from hemagglutinin__InfluenzaA__ADI48792
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagagccucuaccagaacgcugacgccuacauuuucgugggcuccagcagauauucuaaaaaguuuaaaccugagaucgcuauucggccgaaggugcgcgaucaggaagggagaaugaauuacuauuggacacuggucgagcccggagacaaaaucaccuucgaagccacgggcaaccugguugugccucgguacgcguuugccauggagcgcaacgcuggguccggaauuaucaucagcgauacacccgugcaugacugcaauaccacaugucaaaccccuaagggcgccauuaacaccucucuccccuuccacaauauccauccgauuacaaucggcaaaugcccuaaguaugucaagagcacgaaacugagacuugcuaccgggcugcggaacgugcccuccauucagucucgcggacucuuuggcgccaucgccggguucaucgaaggaggcuggacagggaugguugacggaugguacggcuaucaccaccagaaugagcagggcagcggguacgcugcggaucugaaguccacccaaaacgccauugacgagaucacaaauaaagugaacagcgucauugaaaagaugaauacccaguuuacggcugugggaaaagaguucaaccaucuugaaaagagaaucgagaaucugaacaagaaaguugaugacggcuuccucgauauuuggacauacaaugccgaacugcuggugcuccuggagaacgagcggacccuugacuaucacgauucuaaugucaagaaccuguacgaaaaagugcgcucccagcucaagaacaaugccaaagagaucgggaacggauguuuugaguucuaucauaagugcgacaauaccuguauggaaagcgucaagaacggcacauacgauuauccuaaauacucugaagaggcuaagcugaauagagaggaaaucgacggggugaaacuugaguccacccggauuuaucagauccuggccauuuacagcacaguugcguccucucucgugcuggucgugagccugggcgcuaucuccuuuuggaugugcucuaacggaagccuccaaugccgcauuuguaucuga

SEQ ID NO: 188098 - RNA, 1701 nt, Artificial Sequence
  derived and/or modified sequence opt5 from hemagglutinin__InfluenzaA__ADI49029
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaagcacaaugggaaacuuuguaaacugagaggaguugcuccccuccaucugggcaagugcaacaucgccggguggauucugggaaauccugaaugugagucucucagcacagccuccucuuggagcuacaucguggaaaccuccauuucugacaacggcacgugcuauccgggggauuuuaucgacuacgaggagcugcgggaacagcuuagcuccgucagcucuuucgagcgcuuugaaaucuuccccaaaaccuccagcuggccuaaucacgauucuaacaagggagugacagccgcuuguccccaugccggcgcgaaguccuuuuauaaaaaucugauuuggcucguuaagaaaggcaacagcuacccuaagcugucuaaauccuauaucaaugacaaggggaaggaggugcuuguccuguggggcauucaccaccccagcaccuccgccgaucaacagucucucuaccagaacgcugacgccuacguguucgugggaagcuccagauauagcaaaaaguuuaaaccugagaucgcuauucggccgaagguccgcgaucaggaagggagaaugaauuacuauuggacacugguugagcccggagacaaaaucaccuucgaagccacgggcaaccugguggugccucgguacgcguuugccauggagcgcaacgcugggucuggaauuaucaucuccgauacacccguccaugacugcaauaccacaugucaaaccccuaagggcgccauuaacaccagccuccccuuccacaauauccauccgauuacaaucggcaaaugcccuaaguaugugaagucuacgaaacugagacuugcuaccgggcugaagaacguucccagcauucagucccggggacucuuuggcgccaucgccggguucaucgaaggaggcuggacagggaugguggacggaugguacggcuaucaccaccagaaugagcagggcucuggguacgcugcggaucugaaaagcacccaaaacgccauugacgagaucacaaauaaggucaacuccgugauugaaaagaugaauacccaguuuacggcuguuggaaaggaguucaaccaucuugaaaagcgcaucgagaaucugaacaaaaagguggaugacggcuuccucgauauuuggacauacaaugccgaacugcugguccuccuggagaacgagagaacccuugacuaucacgauagcaaugugaaaaaccuguacgaaaagguccggucucagcucaaaaacaaugccaaggagaucgggaacggauguuuugaguucuaucauaagugcgacaauaccuguauggaauccgugaaaaacggcacauacgauuauccuaaguacagcgaagaggcuaaacugaaucgcgaggaaaucgacgggguuaaacuugagucuaccagaauuuaucagauccuggccauuuacuccacaguggcgagcucccucguccuggugguuucucugggcgcuaucagcuuuuggaugugcuccaacggaucucuccaaugccggauuuguaucuga

SEQ ID NO: 188099 - RNA, 1701 nt, Artificial Sequence; identical to SEQ ID NO: 185935
  derived and/or modified sequence opt5 from hemagglutinin__InfluenzaA__ADI49240

SEQ ID NO: 188100 - RNA, 1701 nt, Artificial Sequence; identical to SEQ ID NO: 185935
  derived and/or modified sequence opt5 from hemagglutinin__InfluenzaA__ADI49260

SEQ ID NO: 188101 - RNA, 1701 nt, Artificial Sequence
  derived and/or modified sequence opt5 from hemagglutinin__InfluenzaA__ADI49270
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccagagaaauugggaacggauguuuugaguucuaucacaagugcgacaauacauguauggaauccgugaagaacggcaccuacgauuauccuaaauacagcgaggaagcuaagcugaaucgggaggagaucgacgggguuaaacuugaaucuacacgcaucuaucaaauucuggccaucuacuccacgguggcgagcucccucguccuggugguuucucugggcgcuauuagcuuuuggaugugcuccaacggaucucuccagugcagaaucuguauuuga

SEQ ID NO: 188102 - RNA, 1701 nt, Artificial Sequence; identical to SEQ ID NO: 185935
  derived and/or modified sequence opt5 from hemagglutinin__InfluenzaA__ADI49280

SEQ ID NO: 188103 - RNA, 1701 nt, Artificial Sequence; identical to SEQ ID NO: 185935
  derived and/or modified sequence opt5 from hemagglutinin__InfluenzaA__ADI49312

SEQ ID NO: 188104 - RNA, 1701 nt, Artificial Sequence; identical to SEQ ID NO: 185935
  derived and/or modified sequence opt5 from hemagglutinin__InfluenzaA__ADI49322

SEQ ID NO: 188105 - RNA, 1701 nt, Artificial Sequence; identical to SEQ ID NO: 185935
  derived and/or modified sequence opt5 from hemagglutinin__InfluenzaA__ADI49332

SEQ ID NO: 188106 - RNA, 1701 nt, Artificial Sequence; identical to SEQ ID NO: 186262
  derived and/or modified sequence opt5 from hemagglutinin__InfluenzaA__ADI49342

SEQ ID NO: 188107 - RNA, 1701 nt, Artificial Sequence; identical to SEQ ID NO: 185935
  derived and/or modified sequence opt5 from hemagglutinin__InfluenzaA__ADI49352

SEQ ID NO: 188108 - RNA, 1701 nt, Artificial Sequence; identical to SEQ ID NO: 185693
  derived and/or modified sequence opt5 from hemagglutinin__InfluenzaA__ADI49362

SEQ ID NO: 188109 - RNA, 1701 nt, Artificial Sequence; identical to SEQ ID NO: 187245
  derived and/or modified sequence opt5 from hemagglutinin__InfluenzaA__ADI49382

SEQ ID NO: 188110 - RNA, 1701 nt, Artificial Sequence; identical to SEQ ID NO: 186046
  derived and/or modified sequence opt5 from hemagglutinin__InfluenzaA__ADI49392

SEQ ID NO: 188111 - RNA, 1701 nt, Artificial Sequence; identical to SEQ ID NO: 185680
  derived and/or modified sequence opt5 from hemagglutinin__InfluenzaA__ADI49717

SEQ ID NO: 188112 - RNA, 1701 nt, Artificial Sequence
  derived and/or modified sequence opt5 from hemagglutinin__InfluenzaA__ADI49727
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucuccccuuccagaauauucacccgaucacaauuggcaagugcccuaaguaugugaaaagcacgaagcugagacuugcuaccgggcugcggaacguucccuccauccagucucgcggacucuuuggcgccauugccggguucaucgagggaggcuggacagggaugguggacggaugguacggcuaucaucaccagaaugaacaaggcagcggguacgcugcggaucugaaauccacccagaacgccaucgacgagauuacaaauaaggucaacagcaucauugagaaaaugaauacccaguuuacggcugugggaaaggaguucaaccaccuugagaagagaaucgaaaaucugaacaaaaagguugaugacggcuuccucgauauuuggacauacaaugccgagcugcuggugcuccuggaaaacgagcggacccuugacuaucaugauucuaaugucaaaaaccuguacgagaaggugcgcucccagcucaaaaacaaugccaaggaaaucgggaacggauguuuugaguucuaucacaagugcgacaauaccuguauggaaagcgucaaaaacggcacauacgauuauccuaaguacucugaggaagcuaaacugaauagagaggagaucgacggggugaaacuugaauccacccggauuuaucaaauccuggccauuuacagcacaguugcguccucucucgugcuggucgugagccugggcgcuaucuccuuuuggaugugcucuaacggaagccuccagugccgcauuuguaucuga

SEQ ID NO: 188113 - RNA, 1701 nt, Artificial Sequence; identical to SEQ ID NO: 185680
  derived and/or modified sequence opt5 from hemagglutinin__InfluenzaA__ADI49737

SEQ ID NO: 188114 - RNA, 1701 nt, Artificial Sequence; identical to SEQ ID NO: 185680
  derived and/or modified sequence opt5 from hemagglutinin__InfluenzaA__ADI49747

SEQ ID NO: 188115 - RNA, 1701 nt, Artificial Sequence; identical to SEQ ID NO: 185680
  derived and/or modified sequence opt5 from hemagglutinin__InfluenzaA__ADI49757

SEQ ID NO: 188116 - RNA, 1701 nt, Artificial Sequence; identical to SEQ ID NO: 185680
  derived and/or modified sequence opt5 from hemagglutinin__InfluenzaA__ADI49767

SEQ ID NO: 188117 - RNA, 1701 nt, Artificial Sequence
  derived and/or modified sequence opt5 from hemagglutinin__InfluenzaA__ADI49777
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucuacagaucaacagagccuguaccagaacgccgacgcuuacguguucgugggauccagcagauauucuaagaaauuuaagccugagaucgccauucggccgaaaguccgcgaucaggaggggagaaugaauuacuauuggacccucguugaacccggagacaagaucacguucgaggcuacaggcaaccugguggugccucgguacgccuuugcgauggaacgcaacgccggguccggaauuaucaucagcgauacccccguccaugacugcaauacaaccugucaaaccccuaaaggcgcuauuaacacaucucugcccuuccagaauauccacccgauuacgaucggcaagugcccuaaguaugugaaaagcaccaagcucagacuggccacagggcuucggaacguucccuccauucagucucgcggacuguuuggcgcuaucgccggguucaucgagggaggcuggaccgggaugguggacggaugguacggcuaucaucaccagaaugaacaaggcagcggguacgccgcugaucucaaauccacacagaacgcgauugacgagaucaccaauaaggucaacagcgugauugagaaaaugaauacgcaguuuacagccguuggaaaggaguucaaccaccuggagaagagaaucgaaaaucuuaacaaaaagguggaugacggcuuccuggauauuuggaccuacaaugcugagcuccugguccugcucgaaaacgagcggacccuggacuaucaugauucuaaugugaaaaaccuuuacgagaagguccgcucccagcugaaaaacaaugccaaggaaaucgggaacggauguuuugaguucuaucacaagugcgacaauacauguauggaaagcgugaaaaacggcaccuacgauuauccuaaguacucugaggaagccaaacucaauagagaggagaucgacgggguuaagcuggaauccacacggauuuaucaaauccuugcuauuuacagcacgguggccuccucucugguccucgugguuagccugggcgcgaucuccuuuuggaugugcucuaacggaagccugcagugccgcauuuguaucuga

SEQ ID NO: 188118 - RNA, 1701 nt, Artificial Sequence
  derived and/or modified sequence opt5 from hemagglutinin__InfluenzaA__ADI49787
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucuaucagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggauccagcagauauucuaagaaauuuaagccugagaucgcuauucggccgaaaguccgcgaucaggaggggagaaugaauuacuauuggacacucguugaacccggagacaagaucaccuucgaggccacgggcaaccugguggugccucgguacgcguuugccauggaacgcaacgcuggguccggaauuaucaucagcgauacacccguccaugacugcaauaccacaugucaaaccccuaaaggcgccauuaacaccucucugcccuuccagaauauccacccgauuacaaucggcaagugcccuaaguaugugaaaagcacgaagcucagacuggcuaccgggcuucggaacguucccuccauucagucucgcggacuguuuggcgccaucgccggguucaucgagggaggcuggacagggaugguggacggaugguacggcuaucaucaccagaaugaacaaggcagcggguacgcugcggaucucaaauccacccagaacgccauugacgagaucacaaauaaggucaacagcgugauugagaaaaugaauacccaguuuacggcuguuggaaaggaguucaaccaccuggagaagagaaucgaaaaucuuaacaaaaagguggaugacggcuuccuggauauuuggacauacaaugccgagcuccugguccugcucgaaaacgagcggacccuggacuaucaugauucuaaugugaaaaaccuuuacgagaagguccgcucccagcugaaaaacaaugccaaggaaaucgggaacggauguuuugaguucuaucacaagugcgacaauaccuguauggaaagcgugaaaaacggcacauacgauuauccuaaguacucugaggaagcuaaacucaauagagaggagaucgacgggguuaagcuggaauccacccggauuuaucaaauccuugccauuuacagcacaguggcguccucucugguccucgugguuagccugggcgcuaucuccuuuuggaugugcucuaacggaagccugcagugccgcauuuguaucuga

SEQ ID NO: 188119 - RNA, 1701 nt, Artificial Sequence; identical to SEQ ID NO: 187028
  derived and/or modified sequence opt5 from hemagglutinin__InfluenzaA__ADI49822

SEQ ID NO: 188120 - RNA, 1701 nt, Artificial Sequence
  derived and/or modified sequence opt5 from hemagglutinin__InfluenzaA__ADI50027
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaaguacuauuggacacugguugaacccggagacaaaauuaccuucgaggccacgggcaaucugguggugccucgguacgcguuugccauggaacgcaacgcuggguccggaaucauuaucagcgauacacccguccaugacugcaacaccacaugucaaaccccuaagggcgccaucaauaccucucuccccuuccagaacauucacccgaucacaauuggcaagugcccuaaauauguuaagagcacgaaacugagacuugcuaccgggcugcggaaugugcccuccauccagucucgcggacucuuuggcgccauugccggguucaucgagggaggcuggacagggaugguggacggaugguacggccaucaccaccagaacgaacaaggcagcggguaugcugcggaucugaaguccacccagaaugccaucgacgagauuacaaacaaagucaauagcgugaucgagaagaugaacacccaguuuacggcuguuggaaaggaguucaaucaucuugagaaaagaauugaaaaccugaauaagaaaguggaugacggcuuccucgauaucuggacauacaacgccgagcugcugguccuccuggaaaaugagcggacccuugacuaccacgauucuaacgugaagaaucuguaugagaaaguccgcucccagcucaagaacaacgccaaggaaauugggaauggauguuuugaguucuaccauaaaugcgacaacaccuguauggaaagcgugaagaauggcacauaugauuacccuaaauauucugaggaagcuaagcugaacagagaggagaucgacgggaucaaacuugaauccacccggauuuaccaaauccuggccauuuauagcacaguugcguccucucucgugcuggucgugagccugggcgcuaucuccuuuuggaugugcucuaauggaagccuccagugccgcauuuguaucuga

SEQ ID NO: 188121 - RNA, 1701 nt, Artificial Sequence
  derived and/or modified sequence opt5 from hemagglutinin__InfluenzaA__ADI52834
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaucccccuaccuccgccgaucaacagucucuguaccagaacgcugacgccuacguguucgugggaagcuccagauauagcaagaaauuuaagccggagaucgcuauucggcccaaaguccgcgaucaggaggggagaaugaauuacuauuggacacucguugaaccuggagacaagaucaccuucgaggccacgggcaaccugguggugccccgguacgcguuugccauggaacgcaacgcugggucuggaauuaucaucuccgauacaccuguccacgacugcaauaccacaugucaaacccccaaaggcgccauuaacaccagccugccguuccagaauauccacccuauuacaaucggcaagugccccaaguaugugaaaucuacgaagcucagacuggcuaccgggcuucggaacguuccuagcauucagucccgcggacuguuuggcgccaucgccggguucaucgagggaggcuggacagggaugguggacggaugguacggcuaucaucaccagaaugaacaaggcucuggguacgcugcggaucucaaaagcacccagaacgccauugacgagaucacaaauaaggucaacuccgugauugagaaaaugaauacccaguuuacggcuguuggaaaggaguucaaccaccuggagaagagaaucgaaaaucuuaacaaaaagguggaugacggcuuccuggauauuuggacauacaaugccgagcuccugguccugcucgaaaacgagcggacccuggacuaucaugauagcaaugugaaaaaccuuuacgagaagguccgcucucagcugaaaaacaaugccaaggaaguggggaacggauguuuugaguucuaucacaagugcgacaauaccuguauggaauccguuaaaaacggcacauacgauuaucccaaguacagcgaggaagcuaaacucaauagagaggagaucgacggggugaagcuggaaucuacccggaucuaucaaauucuugccaucuacuccacagcggcuagcucccugguccucgugguuucucugggcgccauuagcuuuuggaugugcuccaacggaucucugcagugccgcaucuguauuuga

SEQ ID NO: 188122 - RNA, 1701 nt, Artificial Sequence
  derived and/or modified sequence opt5 from hemagglutinin__InfluenzaA__ADI52835
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaaacugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaucccccuaccuccgccgaucaacagucucucuaccagaacgcugacgccuacguguucgugggcagcuccaaauauagcaagaaauuuaagccggagauugcuaucagacccaaaguccgggaucaggaagggcgcaugaauuacuauuggacacugguugagccuggagacaagauuaccuucgaagccacgggcaaccugguggugcccagauacgcguuugccauggagcggaacgcugggucuggaaucauuaucuccgauacaccuguccacgacugcaauaccacaugucaaacccccaaaggcgccaucaacaccagccucccguuccacaauauucauccuaucacaauuggcaagugccccaaguaugugaaaucuacgaagcugcgccuugcuaccgggcugagaaacguuccuagcauccagucccggggacucuuuggcgccauugccggguucaucgaaggaggcuggacagggaugguggacggaugguacggcuaucaccaccagaaugagcagggcucuggguacgcugcggaucugaaaagcacccaaaacgccaucgacgagauuacaaauaaggucaacuccgugaucgaaaagaugaauacccaguuuacggcuguuggaaaggaguucaaccaucuugaaaagcgcauugagaaucugaacaaaaagguggaugacggcuuccucgauaucuggacauacaaugccgaacugcugguccuccuggagaacgagagaacccuugacuaucacgauagcaaugugaaaaaccuguacgaaaagguccggucucagcucaaaaacaaugccaaggagauugggaacggauguuuugaguucuaucauaagugcgacaauaccuguauggaauccgugaaaaacggcacauacgauuaucccaaguacagcgaagaggcuaaacugaaucgcgaggaaaucgacgggguuaaacuugagucuaccaagaucuaucagauucuggccaucuacuccacaguggcgagcucccucguccuggugguuucucugggcgcuauuagcuuuuggaugugcuccaacggaucucuccaaugcagaaucuguauuuga

SEQ ID NO: 188123 - RNA, 1701 nt, Artificial Sequence
  derived and/or modified sequence opt5 from hemagglutinin__InfluenzaA__ADI52836
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaagagaacucuuacccuaagcuguccaaaagcuauauuaaugacaagggcaaggaggugcuuguccugugggggauccaccaccccuccaccucugccgaucaacagagacucuaccagaacgcugacgccuacguguucgugggaagcuccaaauauagcaagaaauuuaagccugaaauugcuauccggccgaaaguccgcgaucaggagggcagaaugaauuacuauuggacacugguugaacccggggacaagauuaccuucgaggccacgggaaaccugguggugccucgguacgcguuugccauggaacgcaacgcuggcucugggaucauuaucuccgauacacccguccaugacugcaauaccacaugucaaaccccuaaaggagccaucaacaccagccuccccuuccacaauauucauccgaucacaauuggcaagugcccuaaguaugugaaaucuacgaagcugagacuugcuaccggccugcggaacguucccagcauccagucccgcgggcucuuuggagccauugccggcuucaucgaagggggauggacaggcaugguggacgggugguacggauaucaccaccagaaugagcagggcucuggcuacgcugcggaucugaaaagcacccaaaacgccaucgacgaaauuacaaauaaggucaacuccgugaucgagaaaaugaauacccaguuuacggcuguugggaaggaguucaaccaucuugagaagagaauugaaaaucugaacaaaaagguggaugacggauuccucgauaucuggacauacaaugccgagcugcugguccuccuggagaacgaacggacccuugacuaucacgauagcaaugugaaaaaccuguacgagaagguccgcucucagcucaaaaacaaugccaaggaaauuggcaacggguguuuugaguucuaucauaagugcgacaauaccuguauggaauccgugaaaaacggaacauacgauuauccuaaguacagcgaggaggcuaaacugaauagagaagagaucgacggcguuaaacuugaaucuaccaagaucuaucagauucuggccaucuacuccacaguggcgagcucccucguccuggugguuucucugggggcuauuagcuuuuggaugugcuccaacggcucucuccaaugccggaucuguauuuga

SEQ ID NO: 188124 - RNA, 1701 nt, Artificial Sequence
  derived and/or modified sequence opt5 from hemagglutinin__InfluenzaA__ADI52837
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggagguuaaacacaaugggaaacuuuguaaacugagaggaguggcgccccuccaucugggcaagugcaacaucgccggguggauucugggaaauccugaaugugagucucucagcacagcuuccucuuggagcuacaucgucgaaaccuccucuagcgauaacggcacgugcuauccgggggacuuuauugauuacgaggagcugcgggaacagcuuuccagcgugucuuccuucgagcgcuuugaaaucuuccccaaaaccagcucuuggccuaaucacgacuccaacaagggaguuacagccgcuuguccccaugccggcgccaagagcuuuuauaaaaaucugaucuggcucgugaagaaaggcaacucuuacccuaagcuguccaaaagcuauauuaaugauaaggggaaggagguccuugugcuguggggaauccaccaccccuccaccucugccgaccaacagagccucuaccagaacgcugaugccuacguguucgucggcuccagcaaauauucuaagaaauuuaagccugagauugcuaucagaccgaaaguucgggaccaggaagggcgcaugaauuacuauuggacacugguggagcccggagauaagauuaccuucgaagccaacggcaaccugguggucccuagauacgcguuugccauggagcggaaugcuggguccggaaucauuaucagcgacacgcccgugcaugauugcaacacaaccugucaaacaccuaaaggcgccaucaauaccucucuccccuuccacaacauucauccgaucaccauuggcaagugcccuaaguauguuaaaagcacaaagcugcgccuugcuacggggcugagaaaugugcccuccauccagucucggggacucuuuggcgccauugccggguucaucgaaggaggcuggaccgggauggucgacggaugguacggcuaucaccaccagaacgagcagggcagcggguacgcugcggaccugaaauccacacaaaaugccaucgaugagauuaccaacaaggugaauagcguuaucgaaaagaugaacacacaguuuaccgcugugggaaaggaguucaaucaucuugaaaagcgcauugagaaccugaauaaaaaggucgacgauggcuuccucgacaucuggacguacaacgccgaacugcuggugcuccuggagaaugagagaacacuugauuaucacgacucuaacgucaaaaaccuguacgaaaaggugcggucccagcucaaaaauaacgccaaggagauugggaauggauguuuugaguucuaucauaagugcgauaacaccuguauggaaagcguuaaaaauggcaccuacgacuauccuaaguacucugaagaggcuaaacugaaccgcgaggaaaucgauggggugaaacuugaguccacaaagaucuaucagauucuggccaucuacagcaccgucgcguccucucucgugcugguugugagccugggcgcuauuuccuuuuggaugugcucuaauggaagccuccaaugcagaaucuguauuuga

SEQ ID NO: 188125 - RNA, 1701 nt, Artificial Sequence; identical to SEQ ID NO: 186491
  derived and/or modified sequence opt5 from hemagglutinin__InfluenzaA__ADI72915

SEQ ID NO: 188126 - RNA, 1701 nt, Artificial Sequence; identical to SEQ ID NO: 186491
  derived and/or modified sequence opt5 from hemagglutinin__InfluenzaA__ADI72916

SEQ ID NO: 188127 - RNA, 1701 nt, Artificial Sequence; identical to SEQ ID NO: 186491
  derived and/or modified sequence opt5 from hemagglutinin__InfluenzaA__ADI72917

SEQ ID NO: 188128 - RNA, 1701 nt, Artificial Sequence
  derived and/or modified sequence opt5 from hemagglutinin__InfluenzaA__ADI72918
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacagagggaaggaagugcuuguccuguggggaauccaccacccuagcaccuccgccgaucaacagucucucuaccagaacgcugacgccuacguguucgugggcacaagccgguauuccaaaaaguuuaaaccggagauugcuauccgccccaaggucagagaucaggaggggcggaugaauuacuauuggacccugguugaaccuggagacaaaauuacguucgaggccacaggcaaccugguggugccccgcuacgcguuugccauggaaagaaacgcugggagcggaaucauuaucucugauaccccuguccaugacugcaauacaaccugucaaacccccaagggcgccaucaacacaucccucccguuccagaauauucacccuaucacgauuggcaaaugccccaaguauguuaagagcaccaaacugcggcuugcuacagggcugcgcaacgugccuucuauccagagcagaggacucuuuggcgccauugccggguucaucgagggaggcuggaccgggaugguggacggaugguacggcuaucaucaccagaaugaacaaggcuccggguacgcugcggaucugaagucuacacagaacgccaucgacgagauuaccaauaaagucaacagcgugaucgagaagaugaauacgcaguuuacagcuguuggaaaagaguucaaccaccuugagaagcggauugaaaaucugaacaagaaaguggaugacggcuuccucgauaucuggaccuacaaugccgagcugcugguccuccuggaaaacgagcgcacccuugacuaucaugauuccaaugugaagaaacuguacgagaaggucagaagccagcucaaaaacaacgccaaggaaauugggaauggauguuuugaguucuaucacaagugcgacaacacauguauggaaucugugaaaaauggcaccuacgauuaucccaaguacuccgaggaagcuaaacugaaccgggaggagaucgacgggguuaaacuugaaagcacacgcaucuaucaaauucuggccaucuacucuacgguggcguccagccucguccuggugguuucccugggcgcuauuucuuuuuggaugugcagcaauggaucccuccagugcagaaucuguauuuga

SEQ ID NO: 188129 - RNA, 1701 nt, Artificial Sequence; identical to SEQ ID NO: 186491
  derived and/or modified sequence opt5 from hemagglutinin__InfluenzaA__ADI72919

SEQ ID NO: 188130 - RNA, 1701 nt, Artificial Sequence; identical to SEQ ID NO: 186491
  derived and/or modified sequence opt5 from hemagglutinin__InfluenzaA__ADI72920

SEQ ID NO: 188131 - RNA, 1701 nt, Artificial Sequence
  derived and/or modified sequence opt5 from hemagglutinin__InfluenzaA__ADI72921
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcagauauuccaagaaauuuaagccggagauugcuauccggcccaaaguccgcgaucaggaggggagaaugaauuacuauuggacccugguugaaccuggagacaagauuacguucgaggccacaggcaaccugguggugccccgguacgcguuugccauggaacgcaacgcugggagcggaaucauuaucucugauaccccuguccaugacugcaauacaaccugucaaacccccaaaggcgccaucaacacaucccucccguuccagaauauucacccuaucacgauuggcaagugccccaaguaugugaaaagcaccaagcugagacuugcuacagggcugcggaacguuccuucuauccagagccgcggacucuuuggcgccauugccggguucaucgagggaggcuggaccgggaugguggacggaugguacggcuaucaucaccagaaugaacaaggcuccggguacgcugcggaucugaaaucuacacagaacgcccuugacgagaucaccaauaaggucaacagcgugauugagaaaaugaauacgcaguuuacagcuguuggaaaggaguucaaccaccuggagaagagaaucgaaaaucucaacaaaaagguggaugacggcuuccuggauauuuggaccuacaaugccgagcugcucguccugcuugaaaacgagcggacccuggacuaucaugauuccaaugugaaaaaccucuacgagaagguccgcagccagcugaaaaacaaugccaaggaaaucgggaacggauguuuugaguucuaucacaagugcgacaauacauguauggaaucugugaaaaacggcaccuacgauuaucccaaguacuccgaggaagcuaaacuuaauagagaggagauugacgggguuaagcuggaaagcacacggaucuaucaaauccucgccauuuacucuacgguggcguccagccugguccuggugguuucccucggcgcuaucucuuuuuggaugugcagcaacggaucccugcagugccgcauuuguaucuga

SEQ ID NO: 188132 - RNA, 1701 nt, Artificial Sequence; identical to SEQ ID NO: 185693
  derived and/or modified sequence opt5 from hemagglutinin__InfluenzaA__ADI72922

SEQ ID NO: 188133 - RNA, 1701 nt, Artificial Sequence
  derived and/or modified sequence opt5 from hemagglutinin__InfluenzaA__ADI72923
augaaggccauccuggugguccuccuguacaccuucgcuacaagcaacgccgacacgcuuugcauuggcuaucacgcgaauaacuccaccgauacaguugacaccgugcuggagaaaaaugugacagucacccauucugugaaccuccuggaagauaagcacaaugggaaacuuuguaagcugagaggaguugcuccccuccaucugggcaaaugcaacaucgccggguggauucugggaaauccugagugugaaagccucuccacagccucuagcugguccuacaucguggagaccucuagcuccgacaacggcacgugcuauccgggggauuuuauugacuacgaagaacugcgggagcagcuuagcucugucuccagcuucgaacgcuuugagaucuuccccaagaccucuuccuggccuaaucacgaucccaacaagggagugacagcugccuguccucaugcuggcgccaagagcuuuuauaagaaucugaucuggcucguuaaaaagggcaacucuuaccccaaacuguccaagagcuauauuaaugacaaggggaaagaagugcuuguccuguggggaauccaccacccuuccaccucugcggaucaacagagccucuaccagaacgccgacgcuuacguguucgugggcacauccagauauagcaagaaauuuaagccggagauugccauccggcccaaaguccgcgaucaggaggggagaaugaauuacuauuggacccugguugaaccuggagacaagauuacguucgaggcuacaggcaaccugguggugccccgguacgccuuugcgauggaacgcaacgccgggccuggaaucauuaucucugauacccccguccaugacugcaauacaaccugucaaaccccgaaaggcgcuaucaacacaucccucccuuuccagaauauucaccccaucacgauuggcaagugcccuaaguaugugaaaagcaccaagcugagacuugccacagggcugcggaacguucccucuauccagagccgcggacucuuuggcgcuauugccggguucaucgagggaggcuggaccgggaugguggacggaugguacggcuaucaucaccagaaugaacaaggcuccggguacgccgcugaucugaaaucuacacagaacgcgaucgacgagauuaccaauaaggucaacagcgugaucgagaaaaugaauacgcaguuuacagccguuggaaaggaguucaaccaccuugagaagagaauugaaaaucugaacaaaaagguggaugacggcuuccucgauaucuggaccuacaaugcugagcugcugguccuccuggaaaacgagcggacccuugacuaucaugauuccaaugugaaaaaccuguacgagaagguccgcagccagcucaaaaacaaugccaaggaaauugggaacggauguuuugaguucuaucacaagugcgacaauacauguauggaaucugugaaaaacggcaccuacgauuaucccaaguacuccgaggaagccaaacugaauagagaggagaucgacgggguuaaacuugaaagcacacggaucuaucaaauucuggcuaucuacucuacgguggccuccagccucguccuggugguuucccugggcgcgauuucuuuuuggaugugcagcaacggaucccuccagugccgcaucuguauuuga

SEQ ID NO: 188134 - RNA, 1701 nt, Artificial Sequence; identical to SEQ ID NO: 186491
  derived and/or modified sequence opt5 from hemagglutinin__InfluenzaA__ADI72924

SEQ ID NO: 188135 - RNA, 1701 nt, Artificial Sequence; identical to SEQ ID NO: 185693
  derived and/or modified sequence opt5 from hemagglutinin__InfluenzaA__ADI72925

SEQ ID NO: 188136 - RNA, 1701 nt, Artificial Sequence
  derived and/or modified sequence opt5 from hemagglutinin__InfluenzaA__ADI72926
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcggguauuccaagaaauuuaagccggagauugcuaucagacccaaaguccgggaucaggagggacgcaugaauuacuauuggacccugguugaaccuggcgacaagauuacguucgaggccacagggaaccugguggugcccagauacgcguuugccauggaacggaacgcuggaagcggcaucauuaucucugauaccccuguccaugacugcaauacaaccugucaaacccccaaaggcgccaucaacacaucccucccguuccagaauauucacccuaucacgauugggaagugccccaaguaugugaaaagcaccaagcugcgccuugcuacaggacugagaaacguuccuucuauccagagccggggccucuuuggggccauugccggauucaucgagggcggguggaccggaaugguggacggcugguacggcuaucaucaccagaaugaacaaggguccggauacgcugcggaucugaaaucuacacagaacgccaucgacgagauuaccaauaaggucaacagcgugaucgagaaaaugaauacgcaguuuacagcuguuggcaaggaguucaaccaccuugagaagcgcauugaaaaucugaacaaaaagguggaugacggguuccucgauaucuggaccuacaaugccgagcugcugguccuccuggaaaacgagagaacccuugacuaucaugauuccaaugugaaaaaccuguacgagaagguccggagccagcucaaaaacaaugccaaggaaauuggaaacggcuguuuugaguucuaucacaagugcgacaauacauguauggaaucugugaaaaacgggaccuacgauuaucccaaguacuccgaggaagcuaaacugaaucgcgaggagaucgacggcguuaaacuugaaagcacaagaaucuaucaaauucuggccaucuacucuacgguggcguccagccucguccuggugguuucccugggagcuauuucuuuuuggaugugcagcaacggcucccuccagugccggaucuguauuuga

SEQ ID NO: 188137 - RNA, 1701 nt, Artificial Sequence
  derived and/or modified sequence opt5 from hemagglutinin__InfluenzaA__ADI72927
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcagauauuccaagaaauuuaagccggagauugcuauccggcccaaaguccgcgaucaggaggggagaaugaauuacuauuggacccugguugaaccuggagacaagauuacguucgaggccacaggcaaccugguggugccccgguacgcguuugccauggaacgcaacgcugggagcggaaucauuaccucugauacaccuguccaugacugcaauaccaccugucaaacacccaaaggcgccaucaacacgucccucccguuccagaauauccacccuauuaccaucggcaagugccccaaguaugugaaaagcacaaagcugagacuugcuaccgggcugcggaacguuccuucuauucagagccgcggacucuuuggcgccaucgccggguucauugagggaggcuggacagggaugguggacggaugguacggcuaucaucaccagaaugaacaaggcuccggguacgcugcggaucugaaaucuacccagaacgccaucgacgagaucacgaauaaggucaacagcgugauugagaaaaugaauacacaguuuaccgcuguuggaaaggaguucaaccaccuugagaagagaaucgaaaaucugaacaaaaagguggaugacggcuuccucgauauuuggaccuacaaugccgagcugcugguccuccuggaaaacgagcggacacuugacuaucaugauuccaaugugaaaaaccuguacgagaagguccgcagccagcucaaaaacaaugccaaggaaaucgggaacggauguuuugaguucuaucacaagugcgacaauaccuguauggaaucugugaaaaacggcacauacgauuaucccaaguacuccgaggaagcuaaacugaauagagaggagauugacgggguuaaacuugaaagcacgcggaucuaucaaauccuggccauuuacucuaccguggcguccagccucguccuggugguuucccugggcgcuaucucuuuuuggaugugcagcaacggaucccuccagugccgcauuuguaucuga

SEQ ID NO: 188138 - RNA, 1701 nt, Artificial Sequence
  derived and/or modified sequence opt5 from hemagglutinin__InfluenzaA__ADI72928
augaaggccauccuggugguccuccuguacaccuucgcuacagccaacgcggacacgcuuugcauuggcuaucacgcuaauaacagcaccgauacaguugacaccauccuggagaaaaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgaucccaacaagggagucacagccgcuuguccucaugccggcgcgaaauccuuuuauaagaaucugauuuggcucgugaaaaagggcaacagcuaccccaaacugucuaaguccuauaucaaugacaaggggaaagaaguucuugugcuguggggcauucaccacccuagcaccuccgccgaucaacagucucucuaccagaacgcugacgccuacgucuucgugggaacaagcagauauuccaagaaauuuaagccggagaucgcuauucggcccaaagugcgcgaucaggaggggagaaugaauuacuauuggacccuggucgaaccuggagacaagaucacguucgaggccacaggcaaccugguugugccccgguacgcguuugccauggaacgcaacgcugggagcggaauuaucaucucugauaccccugugcaugacugcaauacaaccugucaaacccccaaaggcgccauuaacacaucccucccguuccagaauauccacccuauuacgaucggcaagugccccaaguaugucaaaagcaccaagcugagacuugcuacagggcugcggaacgugccuucuauucagagccgcggacucuuuggcgccaucgccggguucaucgagggaggcuggaccgggaugguugacggaugguacggcuaucaucaccagaaugaacaaggcuccggguacgcugcggaucugaaaucuacacagaacgccauugacgagaucaccaauaaggugaacagcgucauugagaaaaugaauacgcaguuuacagcugugggaaaggaguucaaccaccuugagaagagaaucgaaaaucugaacaaaaagguugaugacggcuuccucgauauuuggaccuacaaugccgagcugcuggugcuccuggaaaacgagcggacccuugacuaucaugauuccaaugucaaaaaccuguacgagaaggugcgcagccagcucaaaaacaaugccaaggaaaucgggaacggauguuuugaguucuaucacaagugcgacaauacauguauggaaucugucaaaaacggcaccuacgauuaucccaaguacuccgaggaagcuaaacugaauagaaaggagaucgacggggugaaacuugagagcacacggauuuaucaaauccuggccauuuacucuacgguugcguccagccucgugcuggucgugucccugggcgcuaucucuuuuuggaugugcagcaacggaucccuccagugccgcauuuguaucuga

SEQ ID NO: 188139 - RNA, 1701 nt, Artificial Sequence; identical to SEQ ID NO: 185693
  derived and/or modified sequence opt5 from hemagglutinin__InfluenzaA__ADI72929

SEQ ID NO: 188140 - RNA, 1701 nt, Artificial Sequence; identical to SEQ ID NO: 185693
  derived and/or modified sequence opt5 from hemagglutinin__InfluenzaA__ADI72930

SEQ ID NO: 188141 - RNA, 1701 nt, Artificial Sequence
  derived and/or modified sequence opt5 from hemagglutinin__InfluenzaA__ADI72931
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcagauauuccaagaaauuuaagccggagauugcuauccggcccaaaguccgcgaucaggaggggagaaugaauuacuauuggacccugguugaaccuggagacaagauuacguucgaggccacaggcaaccugguggugccccgguacgcguuugccauggaacgcaacgcugggagcggaaucauuaucucugauaccccuguccaugacugcaauacaaccugucaaacccccaaaggcgccaucaacacaucccucccguuccagaauauucacccuaucacgauuggcaagugccccaaguaugugaaaagcaccaagcugagacuugcuacagggcugcggaacguuccuucuauccagagccgcggacucuuuggcgccauugccggguucaucgagggaggcuggaccgggaugguggacggaugguacggcuaucaucaccagaaugaacaaggcuccggguacgcugcggaucugaaaucuacacagaacgccaucgacgagauuaccaauaaggucaacagcgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauuccaaugugaaaaaccuguacgagaagguccgcagccagcucaaaaacaaugccaaggaaauugggaacggauguuuugaguucuaucacaagugcgacaauacauguauggaaucugugaaaaacggcaccuacgauuaucccaaguacuccgaggaagcuaaacugaauagagaggagaucgacgggaucaaacuugaaagcacacggauuuaucaaauccuggccauuuacucuacgguugcguccagccucgugcuggucgugucccugggcgcuaucucuuuuuggaugugcagcaacggaucccuccagugccgcauuuguaucuga

SEQ ID NO: 188142 - RNA, 1701 nt, Artificial Sequence; identical to SEQ ID NO: 187349
  derived and/or modified sequence opt5 from hemagglutinin__InfluenzaA__ADI72932

SEQ ID NO: 188143 - RNA, 1698 nt, Artificial Sequence
  derived and/or modified sequence opt5 from hemagglutinin__InfluenzaA__ADI75818
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuauaaaaaccugcuuuggcugacagagaagaauggccucuaccccaaccugucuaaauccuaugcuaauaacaaggaaaaagaggugcugguccucuggggagugcaccacccuccgagcaucuccgaccagaagacccuguaccauacagaaaacgccuacgugucugucguuagcucccacuauagccgcaaguucacccccgagauugcuaaaagaccuaaggugcgggaucaggaggggcgcaucaauuacuauuggacgcuucuggaacccggcgacacaauuaucuuugaggccaacgggaaucucauugcgccuagauacgccuucgcucugucucggggauuuggcuccgggaucauuaacagcaaugcccccauggauaaaugugacgcuaagugccagaccccgcaaggagccaucaacucuagccuuccuuuccagaaugugcaucccgucacaaucggcgaauguccuaaauaugugcgcuccgcgaagcugagaaugguuaccggccuccggaacauucccucuauccagagccgcgggcuguuuggagccauugcuggcuucaucgaagggggauggaccggcaugguggaugggugguacggauaucaccaccagaaugagcaaggcuccggcuacgccgcugaccagaaaagcacacagaacgccauuaaugggaucacgaacaaggucaauucugugaucgagaagaugaacacccaguuuacagccguuggaaaagaguucaauaagcuggaaagacggauggagaaccucaacaaaaagguggaugacggcuucauugauaucuggaccuacaaugcugaacugcuuguccugcucgagaacgaacgcacacuggacuuucaugacuccaaugugaaaaaccuuuaugagaaggucaagaaucaacugaaaaacaaugcgaaggagauugggaacggaugcuucgaauuuuaccacaaauguaaugaugagugcauggaaagcgugaagaacggcaccuaugacuaccccaaauauucugaggaguccaagcucaauagagaaaagaucgaugggguuaaacuggagagcaugggcguguaccagauucuggccaucuauuccacggucgcuucuagccucgugcugcuuguuucccugggagccaucucuuucuggaugugcagcaacggcucccuccagugucggauuugcaucuga

SEQ ID NO: 188144 - RNA, 1698 nt, Artificial Sequence
  derived and/or modified sequence opt5 from hemagglutinin__InfluenzaA__ADI75851
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcggccugcuuaucuccaaagaaucuuggagcuacauuguggagaagccgaaccccgaaaaugggaccuguuauccuggacauuuugccgauuacgaggagcugagagaacaacucuccucugucagcuccuucgagcgguuugaaaucuuccccaaggagagcucuuggccuaaccacacggugaccggcguuuccgccagcugcucucauaauggcgaguccagcuuuuaucgcaaccugcuuuggcugacagggaaaaauggacucuaccccaaccugucuaaguccuaugcuaauaacaaagaaaaggaggugcugguccucuggggcgugcaccacccuccgaacaucguggaccagaaaacccuguacagaacagaaaaugccuacgucagcguuguguccucucauuauagccggaaguucacccccgagauugcuaagcgcccuaaagugagagaucaggaagggcggaucaacuacuauuggacgcuucuggagcccggagacacaauuaucuuugaggccaauggcaaccucauugcgccucgcuacgccuucgcucuguccagaggguuuggaagcggcaucauuaauucuaacgcccccaugggcaagugugaugcuaaaugccagaccccgcaaggggccaucaauuccagccuuccuuuccagaacguccaccccgugacaaucggagaauguccuaaguauguucggucugcgaaacugcgcauggugaccggccucagaaauauucccagcauccagucccgggggcuguuuggagccauugcuggcuucaucgaagggggauggaccggcauggucgacggcugguacggguaucaucaccagaacgaacaaggaucuggcuacgccgcugaucaaaagagcacacagaaugccauuaacgggaucacgaauaaagugaacuccguuaucgagaagaugaauacccaguuuacagccgugggaaaggaguucaacaaacuggagcgcagaauggagaaccucaauaagaaagucgacgauggcuucauugacaucuggaccuacaacgcugaacugcuugugcugcucgagaaugaacggacacuggauuuucacgacagcaacgucaagaaucuuuaugagaaagugaagucucagcugaagaacaaugcgaaagaaauugggaacggcugcuucgaguuuuaccauaaguguaaugacgagugcauggaauccguuaaaaacggaaccuaugauuaccccaaguauagcgaggaaucuaaacucaaucgcgagaagaucgacggcgugaagcuggaguccaugggggucuaccagauucuggccaucuauagcacgguggcuuccucucucguucugcuugugagccugggagccaucuccuucuggaugugcucuaacggcagccuccaguguagaauuugcaucuga

SEQ ID NO: 188145 - RNA, 1701 nt, Artificial Sequence; identical to SEQ ID NO: 185458
  derived and/or modified sequence opt5 from hemagglutinin__InfluenzaA__ADI75884

SEQ ID NO: 188146 - RNA, 1701 nt, Artificial Sequence; identical to SEQ ID NO: 185458
  derived and/or modified sequence opt5 from hemagglutinin__InfluenzaA__ADI75917

SEQ ID NO: 188147 - RNA, 1698 nt, Artificial Sequence
  derived and/or modified sequence opt5 from hemagglutinin__InfluenzaA__ADI77349
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaaaacuccuuuuaucgcaaucugcuuuggcugacaggcaaaaacgggcucuaccccaaucugagcaagucuuaugcuaacaacaaagagaaggaagugcugauccucuggggaguccaccacccuccgaauauggccgaccagaaaacccuguaccauacagagaacgcuuacguguccguggucagcucccacuauucuagaaaguucacccccgaaauugccaagcggccuaaaguucgcgaucaggagggcagaaucaauuacuauuggacgcuucuggagcccggggacacaauuaucuuugaagcgaacggaaaucucauugccccucgguacgcuuucgcccugagccgcggcuuuggguccggaaucauuaacagcaaugcucccauggauaagugugacaccaaaugccagacaccgcaaggcgccaucaacucuucccuuccuuuccagaaugugcaucccgugaccaucggcgaguguccuaaguaugucagaagcgcgaaacugcggauggugaccgggcuccgcaacauucccucuauccagagcagaggacuguuuggcgccauugcuggguucaucgaaggaggcuggacagggaugguugauggaugguacggcuaucaccaccagaaugagcaaggcuccggguacgccgcugaccagaagucuacgcagaacgccauuaauggaaucaccaacaaagugaauagcgucaucgaaaagaugaacacacaguuuaccgccgugggcaaggaguucaacaaacuggagcggcgcauggaaaaucucaacaagaaaguugaugacggguucauugauaucuggacauacaaugcugagcugcuugugcugcucgaaaacgagagaacccuggacuuucaugacuccaaugucaagaaccuuuaugaaaaagucaagagccaacugaagaauaacgcgaaagagauuggaaauggcugcuucgaguuuuaccacaaguguaacgaugaaugcauggagucugugaaaaaugggacguaugacuaccccaaguauuccgaagagagcaaacucaaccgggagaagaucgauggcgugaagcuggaaucuaugggaguuuaccagauucuggccaucuauuccacaguggcuagcucccucguccugcuugugucucugggcgccaucagcuucuggaugugcuccaaugggucucuccagugucgcauuugcaucuga

SEQ ID NO: 188148 - RNA, 1701 nt, Artificial Sequence; identical to SEQ ID NO: 185693
  derived and/or modified sequence opt5 from hemagglutinin__InfluenzaA__ADI77360

SEQ ID NO: 188149 - RNA, 1701 nt, Artificial Sequence
  derived and/or modified sequence opt5 from hemagglutinin__InfluenzaA__ADI99498
augaagaccauccuggugguccuccuguacacauucgccacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaagaaucugaucuggcucguuaaaaagggcaacucuuacccuaaacugaauaaguccuauauuaacgacaaggggaaagaagugcuuguccuguggggaauccaccaccccagcacauccgcggaucaacagucucucuaccagaaugccgacgcuuacguguucgugggcaccagcagauauuccaagaaauuuaagccugagauugccauccggccgaaaguccgcgggcaggagggaagaaugaacuacuauuggacgcugguuaagcccggcgauaaaauuacauucgaagcuaccgggaaccugguggugccucgguacgccuuugcgauggagcgcaaugccggaagcggcaucauuaucucugacacacccguccaugauugcaacaccaccugucaaacaccuaagggcgcuaucaauacgucccuccccuuccagaacauucacccgaucaccauugggaagugcccuaaauaugugaaaagcacaaaacugagacuugccaccggacugcggaauguucccucuauccagagccgcggccucuuuggggcuauugccggauucaucgaaggcggguggacaggaaugguggacggcugguacggcuaucaucaccagaacgagcaaggguccggauacgccgcugaccugaagucuacccagaaugcgaucgaugaaauuacgaacaaagucaauagcgugaucgagaagaugaacacacaguuuaccgccguuggcaaggaguucaaucaccuugagaaaagaauugagaaccugaauaagaaaguggacgauggguuccucgacaucuggaccuacaacgcugaacugcugguccuccuggagaaugaacggacacuugauuaucaugacuccaacgugaagaaccuguacgagaaaguccgcagccagcucaagaauaacgccaaggagauuggaaauggcuguuuugaguucuaucacaaaugcgauaacaccuguauggaaucugugaagaaugggacauacgacuauccuaaauacuccgaagaggccaagcugaacagagaagagaucgauggcguuaaacuugagagcacgcggaucuaucaaauucuggcuaucuacucuaccguggccuccagccucguccuggugguuucccugggagcgauuucuuuuuggaugugcagcaauggcucccuccagugccgcaucuguauuuga

SEQ ID NO: 188150 - RNA, 1701 nt, Artificial Sequence
  derived and/or modified sequence opt5 from hemagglutinin__InfluenzaA__ADI99560
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaccugguggugccucgguacgcguuugccauggaacgcaaugcugggucuggaaucauuaucuccgacacccccguccaugauugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggacggaugguacggcuaucaucaccagaacgaacaaggcucuggguacgcugcggaccugaaaagcacacagaaugccaucgauaagauuaccaacaaagucaauuccgugaucgagaagaugaacacgcaguuuacagcuguuggaaaggaguucaaucaccuugagaaaagaauugagaaccugaauaagaaaguggacgauggcuuccucgacaucuggaccuacaacgccgaacugcugguccuccuggagaaugaacggacccuugauuaucaugacagcaacgugaagaaccuguacgagaaaguccgcucucagcucaagaauaacgccaaggagauugggaauggauguuuugaguucuaucacaaaugcaacaauacauguauggaauccgugaagaacggcaccuacgauuauccuaaauacagcgaagaggcuaagcugaauagagaagagaucgacgggguuaaacuugagucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 188151 - RNA, 1701 nt, Artificial Sequence; identical to SEQ ID NO: 188150
  derived and/or modified sequence opt5 from hemagglutinin__InfluenzaA__ADI99570

SEQ ID NO: 188152 - RNA, 1701 nt, Artificial Sequence; identical to SEQ ID NO: 188150
  derived and/or modified sequence opt5 from hemagglutinin__InfluenzaA__ADI99580

SEQ ID NO: 188153 - RNA, 1701 nt, Artificial Sequence; identical to SEQ ID NO: 187306
  derived and/or modified sequence opt5 from hemagglutinin__InfluenzaA__ADI99590

SEQ ID NO: 188154 - RNA, 1701 nt, Artificial Sequence
  derived and/or modified sequence opt5 from hemagglutinin__InfluenzaA__ADI99610
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaauccuuuuauaagaaccugaucuggcucguuaaaaagggcaauucuuacccuaaacuguccaagagcuauauuaacgauaaggggaaagaaauccuugugcuguggggcauucaccaccccuccaccucugccgaccaacagagccucuaccagaaugcugaugccuacgucuucgugggaacauccagauauagcaagaaauuuaagccugagaucgcuauucggccgaaagugcgcgaccaggaggggagaaugaacuacuauuggacccuggucgaacccggagauaagaucacguucgaggccacaggcaaccugguugugccucgguacgcguuugccauggaacgcaaugcugggucuggaauuaucaucuccgacacccccgugcaugauugcaacacaaccugucaaaccccuaaaggcgccauuaauacaagccuccccuuccagaacauccacccgauuacgaucggcaagugcccuaaguaugucaaaucuaccaagcugagacuugcuacagggcugcggaaugugcccagcauucagucccgcggacucuuuggcgccaucgccggguucaucgagggaggcuggaccgggaugguugacggaugguacggcuaucaucaccagaacgaacaaggcucuggguacgcugcggaccugaaaagcacacagaaugccauugauaagaucaccaacaaagugaauagcgucauugagaagaugaacacgcaguuuacagcugugggaaaggaguucaaucaccuugagaaaagaaucgagaaccugaauaagaaaguugacgauggcuuccucgacauuuggaccuacaacgccgaacugcuggugcuccuggagaaugaacggacccuugauuaucaugacagcaacgucaagaaccuguacgagaaagugcgcucucagcucaagaauaacgccaaggagaucgggaauggauguuuugaguucuaucacaaaugcgauaacacauguauggaauccgucaagaauggcaccuacgacuauccuaaauacagcgaagaggcuaagcugaacagagaagagaucgauggggugaaacuugagucuacacggauuuaucaaauccuggccauuuacuccacgguugcgagcucccucgugcuggucgugucucugggcgcuaucagcuuuuggaugugcuccaauggaucucuccagugccgcauuuguaucuga

SEQ ID NO: 188155 - RNA, 1701 nt, Artificial Sequence
  derived and/or modified sequence opt5 from hemagglutinin__InfluenzaA__ADI99620
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaccugguggugccucgguacgcguuugccauggaacgcaaugcugggucuggaaucauuaucaccgacacacccguccaugauugcaacaccaccugucaaacaccuaaaggcgccaucaauacgucccuccccuuccagaacauucacccgaucaccauuggcaagugcccuaaguaugugaaaagcacaaagcugagacuugcuaccgggcugcggaauguucccucuauccagagccgcggacucuuuggcgccauugccggguucaucgagggaggcuggacagggaugguggacggaugguacggcuaucaucaccagaacgaacaaggcuccggguacgcugcggaccugaaaucuacccagaaugccaucgauaagauuacgaacaaagucaauagcgugaucgagaagaugaacacacaguuuaccgcuguuggaaaggaguucaaucaccuugagaaaagaauugagaaccugaauaagaaaguggacgauggcuuccucgacaucuggaccuacaacgccgaacugcugguccuccuggagaaugaacggacacuugauuaucaugacuccaacgugaagaaccuguacgagaaaguccgcagccagcucaagaauaacgccaaggagauugggaauggauguuuugaguucuaucacaaaugcgauaacaccuguauggaaucugugaagaauggcacauacgacuauccuaaauacuccgaagaggcuaagcugaacagagaagagaucgaugggguuaaacuugagagcacgcggaucuaucaaauucuggccaucuacucuaccguggcguccagccucguccuggugguuucccugggcgcuauuucuuuuuggaugugcagcaauggaucccuccagugccgcaucuguauuuga

SEQ ID NO: 188156 - RNA, 1701 nt, Artificial Sequence
  derived and/or modified sequence opt5 from hemagglutinin__InfluenzaA__ADI99630
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagaauaacgggaaacuuuguaagcugagaggaguugcuccccuccaccugggcaaaugcaauaucgccggguggauucugggaaacccugagugugaaucucucagcacagccuccucuuggagcuacaucguggagaccuccucuagcgacaauggcacgugcuauccggggaacuuuauugauuacgaagaacugcgggagcagcuuuccagcgucucuuccuucgaacgcuuugagaucuuccccaagaccagcucuuggccuaaucaugacuccaacaagggagugacagccgcuuguccccacgccggcgcgaaaucuuuuuauaagaaucugaucuggcucguuaaaaagggcaacagcuacccuaaacuguccaagagcuauauuaaugauaaggggaaagaagugcuuguccuguggggaauccaucaccccuccaccucugccgaccaacagagccucuaccagaacgcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaucugguggugccucgguacgcguuugccauggaacgcaacgcugggucuggaaucauuaucuccgacacccccguccacgauugcaauacaaccugucaaaccccuaaaggcgccaucaacacaagccuccccuuccagaauauucauccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaccaucagaaugaacaaggcucuggguacgcugcggaccugaaaagcacacagaacgccaucgauaagauuaccaauaaagucaacuccgugaucgagaagaugaauacgcaguuuacagcuguuggaaaggaguucaaccaccuugagaaaagaauugagaaucugaacaagaaaguggacgauggcuuccucgacaucuggaccuacaaugccgaacugcugguccuccuggagaacgaacggacccuugauuaucacgacagcaacgugaagaaucuguacgagaaaguccgcucucagcucaagaacaaugccaaggagauugggaacggauguuuugaguucuaucauaaaugcgauaauacauguauggaauccgugaagaacggcaccuacgacuauccuaaauacagcgaagaggcuaagcugaauagagaagagaucgaugggguuaaacuugagucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 188157 - RNA, 1701 nt, Artificial Sequence
  derived and/or modified sequence opt5 from hemagglutinin__InfluenzaA__ADI99640
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucuacagaucaacagagccucuaccagaacgccgacuccuacguguucgugggcaccagcagauauucuaagaaauuuaagccugagauugcuauccggccgaaaguccgcgaucaggaggggagaaugaauuacuauuggacgcugguugaacccggagacaagauuacauucgaggccaccggcaaccugguggugccucgguacgcuuuugccauggaacgcaacgcgggguccggaaucauuaucagcgauacacccauccaugacugcaauaccaccugucaaacaccugagggcgccauuaacacgucucuccccuuccagaauauccacccgauuaccaucggcaaaugcccuaaguaugucaagagcacaaaacugagacuugcuaccgggcugcggaacgugcccuccauucagucucgcggacucuuuggcgccaucgcuggguucaucgaaggaggcuggacagggaugguugacggaugguacggcuaucaucaccagaaugagcaaggcagcggguacgccgccgaucugaaguccacccagaacgcuauugacgagaucacgaauaaagugaacagcgucauugaaaagaugaauacacaguuuaccgcggugggaaaagaguucaaccaccuugaaaagagaaucgagaaucugaacaagaaaguugaugacggcuuccucgauauuuggaccuacaaugccgaacugcuggugcuccuggagaacgagcggacacuugacuaucaugauucuaaugucaagaaccuguacgaaaaagugcgcucccagcucaagaacaaugcuaaagagaucgggaacggauguuuugaguucuaucacaagugcgacaauaccuguauggagagcgucaagaacggcacauacgauuauccuaaauacucugaagaggccaagcugaauagagaggaaaucgacggggugaaacuugaguccacgcggauuuaucaaauccuggccauuuacagcaccguugcuuccucucucgugcuggucgugagccugggcgccaucuccuuuuggaugugcucuaacggaagccuccagugccgcauuuguaucuga

SEQ ID NO: 188158 - RNA, 1701 nt, Artificial Sequence; identical to SEQ ID NO: 187245
  derived and/or modified sequence opt5 from hemagglutinin__InfluenzaA__ADI99660

SEQ ID NO: 188159 - RNA, 1701 nt, Artificial Sequence
  derived and/or modified sequence opt5 from hemagglutinin__InfluenzaA__ADI99670
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggaacauccagauauagcaagaaauuuaagccugagaucgcuauucggccgaaaguccgcgaucaggaggggagaaugaauuacuauuggacccucguugaacccggagacaagaucacguucgaggccacaggcaaccugguggugccucgguacgcguuugccauggaacgcaacgcugggucuggaauuaucaucuccgauacccccguccaugacugcaauacaaccugucaaaccccuaaaggcgccauuaacacaagccugcccuuccagaauauccacccgauuacgaucggcaagugcccuaaguaugugaaaucuaccaagcucagacuggcuacagggcuucggaacguucccagcauucagucccgcggacuguuuggcgccaucgccggguucaucgagggaggcuggaccgggaugguggacggaugguacggcuaucaucaccagaaugaacaaggcucuggguacgcugcggaucucaaaagcacacagaacgccauugacgagaucaccaauaaggucaacuccgugauugagaaaaugaauacgcaguuuacagcuguuggaaaggaguucaaccaccuggagaagagaaucgaaaaucuuaacaaaaagguggaugacggcuuccuggauauuuggaccuacaaugccgagcuccugguccugcucgaaaacgagcggacccuggacuaucaugauagcaaugugaaaaaccuuuacgagaagguccgcucucagcugaaaaacaaugccaaggaaaucgggaacggauguuuugaguucuaucacaagugcgacaauacauguauggaauccgugaaaaacggcaccuacggguauccuaaguacagcgaggaagcuaaacucaauagagaggagaucgauggcguuaagcuggaaucuacacggauuuaucaaauccuugccauuuacuccacgguggcgagcucccugguccucgugguuucucugggagcuaucagcuuuuggaugugcuccaacggcucucugcagugccgcauuuguaucuga

SEQ ID NO: 188160 - RNA, 1701 nt, Artificial Sequence
  derived and/or modified sequence opt5 from hemagglutinin__InfluenzaA__ADI99680
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggaacauccagauauagcaagaaauuuaagccugagaucgcuauucggccgaaaguccgcgaucaggaggggagaaugaauuacuauuggaccaucguugaacccggagacaagauuacguucgaggccacaggcaaccucguggugccucgguacgcguuugccauggaacgcaacgcugggucuggaaucaucauuuccgauacccccguccaugacugcaauacaaccugucaaaccccuaaaggcgccaucaacacaagccugcccuuccagaauauucacccgaucacgauuggcaagugcccuaaguaugugaaaucuaccaagcugagacucgcuacagggcugcggaacguucccagcauccagucccgcggacuuuuuggcgccaucgccggguucauugagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccucgagaagagaauugaaaaucugaacaaaaagguggaugacggcuuccuugauaucuggaccuacaaugccgagcugcucguccugcuggaaaacgagcggacccucgacuaucaugauagcaaugugaaaaaccuguacgagaagguccgcucucagcuuaaaaacaaugccaaggaaaucgggaacggauguuuugaguucuaucacaagugcgacaauacauguauggaauccgugaaaaacggcaccuacgauuauccuaaguacagcgaggaagcuaaacugaauagagaggagauugacgggguuaagcucgaaucuacacggaucuaucaaauucuggccaucuacuccacgguggcgagcucccuuguccuggugguuucucucggcgcuauuagcuuuuggaugugcuccaacggaucucugcagugccgcaucuguauuuga

SEQ ID NO: 188161 - RNA, 1701 nt, Artificial Sequence
  derived and/or modified sequence opt5 from hemagglutinin__InfluenzaA__ADI99690
augaaggccauccuggcugugcuccuguacaccuucgccauugcgaacgcugacacacuuugcaucggcuaucacgccaauaacagcacggauaccgucgacacaguucuggagaaaaaugugaccgugacacauuccgucaacauucucgaagauaagcacaaugggaaacuguguaaacuuagaggaguggcuccccugcaucucggcaaaugcaacaucgccggguggauucugggaaauccugagugugaaucucugagcaccgccuccucuuggagcuacaucguugagacauccucuagcgacaacgggaccugcuauccgggcgauuuuaucgacuacgaagaacuccgggagcagcuguccagcgugucuuccuucgaacgcuuugagauuuuccccaagacgagcucuuggccuaaucacgauuccaacaagggagucaccgcugccuguccccaugcgggcgccaagagcuuuuauaagaaucuuaucuggcuggugaaaaagggcaacucuuacccuaaacucuccaagagcuauauuaaugacaaggggaaaaagguucuggugcuuuggggaauccaccaccccuccacaucugcugaucaacagagccuguaccagaacgccgacgcuuacgucuucgugggcaccuccagauauagcaaaaaguuuaaaccugaaauugccauccggccgaaggugcgcgaucaggaggggagaaugaauuacuauuggacacucgucgagcccggagacaaaauuaccuucgaagcgacgggcaaccugguugugccucgguacgccuuugcuauggagcgcaacgccgggucuggaaucaucauuuccgauacacccgugcaugacugcaauaccacaugucaaaccccuaagggcgcuaucaacaccagccugcccuuccagaauauucacccgaucacaauuggcaagugcccuaaauaugucaagucuacgaaacucagacuggccaccgggcuucggaacgugcccagcauccagucccgcggacuguuuggcgccaucgcuggguucauugaaggaggcuggacagggaugguugacggaugguacggcuaucaucaccagaaugagcaaggcucuggguacgcggccgaucucaagagcacccagaacgcuaucgacgaaauuacaaauaaagugaacuccgucaucgagaagaugaauacccaguuuacggccgugggaaaggaguucaaccaccuggagaaaagaauugagaaucuuaacaagaaaguugaugacggcuuccuggauaucuggacauacaaugccgaacuccuggugcugcucgagaacgaacggacccuggacuaucaugauagcaaugucaagaaccuuuacgagaaagugcgcucucagcugaagaacaaugcuaaggagaucgggaacggauguuuugaguucuaucacaaaugcgacaauaccuguauggaauccgucaagaacggcacauacgauuauccuaaauacagcgaagaggccaagcucaauagagaagagauugacggggugaaacuggagucuacccggaucuaucaaauucuugcgaucuacuccacaguugcuagcucccuggugcucgucgugucucugggcgccauuagcuuuuggaugugcuccaacggaucucugcagugccgcaucuguauuuga

SEQ ID NO: 188162 - RNA, 1701 nt, Artificial Sequence
  derived and/or modified sequence opt5 from hemagglutinin__InfluenzaA__ADI99700
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguuucuccccuccaucugggcaaaugcaacaucgccggguggauucugggaaauccugagugugaaagccucuccacagccucuagcugguccuacaucguggagaccucuagcuccgacaacggcacgugcuauccgggggauuuuauugacuacgaagaacugcgggagcagcuuagcucugucuccagcuucgaacgcuuugagaucuuccccaagaccucuuccuggccuaaucacgauagcaacaagggagugacagcugccuguccccaugcuggcgccaaaucuuuuuauaagaaucugaucuggcucguuaaaaagggcaacuccuacccuaaacugagcaaguccuauauuaaugacaaggggaaagaagugcuuguccuguggggagugcaccaccccucuaccagcgcggaucaacagucccucuaccagaacgccgacgcuuacguguucgucggcacaagcagauauucuaagaaauuuaagccugagaucgccauucggccgaaaguucgcgaucaggaggggagaaugaauuacuauuggacccugguggaacccggagacaagaucacguucgaggcuacaggcaaccugguggccccucgguacgcguuugccauggaacgcaacgcuggguccggaauuaucauuagcgauacccccguccaugacugcaauacaaccugucaaaccccuaaaggcgccaucaacacaucucuccccuuccagaauauccacccgauuacgaucggcaagugcccuaaguaugugaaaagcaccaagcugagacuugcuacagggcugcggaacguucccuccauucagucucgcggacucuuuggcgccaucgccggguucauugagggaggcuggaccgggaugguggacggaugguacggcuaucaucaccagaaugaacaaggcagcggguacgcugcggaucugaaauccacacagaacgccaucgacgagaucaccaauaaggucaacagcgugauugagaaaaugaauacgcaguuuacagcuguuggaaaggaguucaaccaccuugagaagagaaucgaaaaucugaacaaaaagguggaugacggcuuccucgauauuuggaccuacaaugccgagcugcugguccuccuggaaaacgagcggacccuugacuaucaugauucuaaugugaaaaaccuguacgagaagguccgcucccagcucaaaaacaaugccaaggaaaucgggaacggauguuuugaguucuaucacaagugcgacaauacauguauggaaagcgugaaaaacggcaccuacgauuauccuaaguacucugaggaagcuaaacugaauagagaggagauugacgggguuaaacuugaauccacacggaucuaucaaauccuggccauuuacagcacgguggcguccucucucguccuggugguuagccugggcgcuaucuccuuuuggaugugcucuaacggaagccuccagugccgcauuuguaucuga

SEQ ID NO: 188163 - RNA, 1701 nt, Artificial Sequence; identical to SEQ ID NO: 187342
  derived and/or modified sequence opt5 from hemagglutinin__InfluenzaA__ADI99710

SEQ ID NO: 188164 - RNA, 1701 nt, Artificial Sequence
  derived and/or modified sequence opt5 from hemagglutinin__InfluenzaA__ADI99720
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccugaucacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgggcaggagggaagaaugaacuacuauuggacccugguugaacccggcgacaagauuacguucgaggccacagggaaucugguggugucucgguacgcguuugccauggaacgcaacgcuggauccggcaucauuaucagcgauaccccuguccaugacugcaacacaaccugucaaacccccaaaggcgccaucaauacaucucucccuuuccagaacauucaccccaucacgauugggaagugcccgaaguaugugaaaagcaccaagcugagacuugcuacaggacugcggaauguuccuuccauccagucucgcggccucuuuggggccauugccggauucaucgagggcggguggaccggaaugguggacggcugguacggcuaucaucaccagaacgaacaagggagcggauacgcugcggaucugaaauccacacagaaugccaucgacgagauuaccaacaaggucaauagcgugaucgagaaaaugaacacgcaguuuacagcuguuggcaaggaguucaaucaccuugagaagagaauugaaaaccugaauaaaaagguggaugacggguuccucgauaucuggaccuacaacgccgagcugcugguccuccuggaaaaugagcggacccuugacuaucaugauucuaacgugaaaaaucuguacgagaagguccgcucccagcucaaaaacaacgccaaggaaauuggaaauggcuguuuugaguucuaucacaagugcgacaacacauguauggaaagcgugaaaaaugggaccuacgauuaucccaaguacucugaggaagcuaaacugaacagagaggagaucgacggcguuaaacuugaauccacacggaucuaucaaauucuggccaucuacagcacgguggcguccucucucguccuggugguuagccugggagcuauuuccuuuuggaugugcucuaauggcagccuccagugccgcaucuguauuuga

SEQ ID NO: 188165 - RNA, 1701 nt, Artificial Sequence; identical to SEQ ID NO: 185693
  derived and/or modified sequence opt5 from hemagglutinin__InfluenzaA__ADI99730

SEQ ID NO: 188166 - RNA, 1701 nt, Artificial Sequence; identical to SEQ ID NO: 185693
  derived and/or modified sequence opt5 from hemagglutinin__InfluenzaA__ADJ00497

SEQ ID NO: 188167 - RNA, 1701 nt, Artificial Sequence; identical to SEQ ID NO: 185693
  derived and/or modified sequence opt5 from hemagglutinin__InfluenzaA__ADJ00498

SEQ ID NO: 188168 - RNA, 1701 nt, Artificial Sequence; identical to SEQ ID NO: 186887
  derived and/or modified sequence opt5 from hemagglutinin__InfluenzaA__ADJ00501

SEQ ID NO: 188169 - RNA, 1701 nt, Artificial Sequence; identical to SEQ ID NO: 186857
  derived and/or modified sequence opt5 from hemagglutinin__InfluenzaA__ADJ18163

SEQ ID NO: 188170 - RNA, 1701 nt, Artificial Sequence; identical to SEQ ID NO: 186857
  derived and/or modified sequence opt5 from hemagglutinin__InfluenzaA__ADJ18165

SEQ ID NO: 188171 - RNA, 1701 nt, Artificial Sequence
  derived and/or modified sequence opt5 from hemagglutinin__InfluenzaA__ADJ18167
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuugucccuaugccggcgcgaaaucuuuuuacaagaaucugaucuggcucguuaaaaagggcaacagcuauccuaaacuguccaagagcuacauuaaugacaaggggaaagaagugcuuguccuguggggaauccaucaccccuccaccucugccgaucaacagagccucuaccagaacgcugacgccuauguguucgugggcacauccagauacagcaagaaauuuaagccugagauugcuauccggccgaaaguccgcgauagagaggggcggaugaauuauuacuggacccugguugaacccggagacaagauuacguucgaggccacaggcaaccugguggugccucgcuaugcguuugccauggaaagaaacgcugggucuggaaucauuaucuccgauacccccguccacgacugcaauacaaccugucagaccccuaaaggcgccaucaacacaagccuccccuuccaaaauauucauccgaucacgauuggcaagugcccuaaguacgugaaaucuaccaagcugcggcuugcuacagggcugcgcaacauccccagcauucaguccagaggacucuuuggcgccaucgccggguucaucgagggaggcuggaccgggaugguugacggaugguauggcuaccaccaucagaaugaacagggcucuggguacgcugcggaucugaaaagcacacaaaacgccauugacaagaucaccaauaaagugaacuccgucauugagaagaugaauacgcaguuuacagcugugggaaaggaguucaaccaccuugaaaaacggaucgagaaucugaacaagaaaguugaugacggcuuccucgauauuuggaccuauaaugccgaacugcuggugcuccuggagaacgaacgcacccuugacuaccacgauagcaaugucaagaaccuguaugagaaagugagaucucagcucaagaacaaugccaaggagaucgggaacggauguuuugaguucuaccauaaaugcgacaauacauguauggaguccgucaagaacggcaccuaugauuacccuaaauauagcgaagaggcuaagcugaaucgggaagagaucgacggggugaaacuugagucuacacgcauuuaccagauccuggccauuuacuccacgguugcgagcucccucgugcuggucgugucucugggcgcuaucagcuuuuggaugugcuccaacggaucucuccaaugcagaauuuguaucuga

SEQ ID NO: 188172 - RNA, 1701 nt, Artificial Sequence
  derived and/or modified sequence opt5 from hemagglutinin__InfluenzaA__ADJ18169
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgauagagaggggcggaugaauuacuauuggacccugguugaacccggagacaagauuacguucgaggccacaggcaaccugguggugccucgcuacgcguuugccauggaaagaaacgcugggucuggaaucauuaucuccgauacccccguccaugacugcaauacaaccugucagaccccuaaaggcgccaucaacacaagccuccccuuccaaaauauucacccgaucacgauuggcaagugcccuaaguaugugaaaucuaccaagcugcggcuugcuacagggcugcgcaacguucccagcauccaguccagaggacucuuuggcgccauugccggguucaucgagggaggcuggaccgggaugguggacggaugguacggcuaucaucaccagaaugaacagggcucuggguacgcugcggaucugaaaagcacacaaaacgccaucgacaagauuaccaauaaagucaacuccgugaucgagaagaugaauacgcaguuuacagcuguuggaaaggaguucaaccaccuugaaaaacggauugagaaucugaacaagaaaguggaugacggcuuccucgauaucuggaccuacaaugccgaacugcugguccuccuggagaacgaacgcacccuugacuaucaugauagcaaugugaagaaccuguacgagaaagucagaucucagcucaagaacaaugccaaggagauugggaacggauguuuugaguucuaucacaaaugcgacaauacauguauggaguccgugaagaacggcaccuacgauuauccuaaauacagcgaagaggcuaagcugaaucgggaagagaucgacgggguuaaacuugagucuacacgcaucuaucagauucuggccaucuacuccacgguggcgagcucccucguccuggugguuucucugggcgcuauuagcuuuuggaugugcuccaacggaucucuccaaugcagaaucuguauuuga

SEQ ID NO: 188173 - RNA, 1701 nt, Artificial Sequence
  derived and/or modified sequence opt5 from hemagglutinin__InfluenzaA__ADJ18171
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggccguacaucguggagaccagcuccucugacaacggcacgugcuaucccggggauuuuauugacuacgaggaacugcgggagcagcuuagcuccgucagcucuuucgaacgcuuugagaucuucccuaagaccuccagcuggcccaaucacgauucuaacaagggagugacagccgcuuguccucaugccggcgcgaaauccuuuuaucaaaaucugaucuggcucguuaagaaaggcaacagcuaccccaagcugucuaaauccuauauucacgacaaggggaaggaagugcuuguccuguggggaauccaccauccuagcaccuccgccgaucagcagucucucuaccagaaugcugacgccuacguguucgugggcacaagcagauauuccaaaaaguuuaaaccggagauugcuauccggcccaagguccgcgauagacaagggcggaugaacuacuauuggacccugguugagcugggagacaaaauuacguucgaagccacaggcaaucucguggugccucgcuacgcguuugccauggagagaaacgcugggagcggaaucauuaucucugauacccccguccacaacugcaauacaaccugucagaccacaacgggcgccaucaacaccucccugccuuuccagaauauucaucccaucacaauuggcaagugcccgaaauauguuaagagcaccaaacuucggcuggcuacagggcuccgcaacgugccuucuauccagagcagaggacuguuuggcgccauugccggguucaucgaaggaggcuggaccgggaugguggacggaugguacggcuaucaccaccaaaaugagcagggcuccggguacgcugcggaccuuaagucuacgcagaacgccaucgauaagauuacaaauaaagucaacagcgugaucgaaaagaugaauacccaguuuaccgcuguuggaaaagaguucaaccaucuggagaagcggauugaaaaucucaacaagaaaguggacgauggcuuccuggacaucuggacauacaaugccgagcugcucguccugcuugaaaacgagcgcacccuggauuaucacgacuccaaugugaagaaccucuacgaaaaagucagaagccaacugaagaacaaugccaaagagauugggaacggauguuuugaguucuaucauaagugcgauaauacauguauggaaucugugaagaacggcacguacgacuaucccaaauacuccgaggaagcuaaacuuaaucgggaggaaaucgaugggguuaagcuggagagcacccgcaucuaucagauucucgccaucuacucuacaguggcguccagccugguccuggugguuucccucggcgcuauuucuuuuuggaugugcagcaacggaucccugcagugcagaaucuguauuuga

SEQ ID NO: 188174 - RNA, 1701 nt, Artificial Sequence; identical to SEQ ID NO: 186857
  derived and/or modified sequence opt5 from hemagglutinin__InfluenzaA__ADJ18173

SEQ ID NO: 188175 - RNA, 1701 nt, Artificial Sequence; identical to SEQ ID NO: 186857
  derived and/or modified sequence opt5 from hemagglutinin__InfluenzaA__ADJ18175

SEQ ID NO: 188176 - RNA, 1701 nt, Artificial Sequence
  derived and/or modified sequence opt5 from hemagglutinin__InfluenzaA__ADJ18177
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgggcaggagggaagaaugaauuacuauuggacccugguugaacccggcgauaagauuacguucgaggccacagggaaccugguggugccucgguacgcguuugccauggaacgcaacgcuggaucuggcaucauuaucuccgacacccccguccaugauugcaauacaaccugucaaaccccuaaaggcgccaucaacacaagccuccccuuccagaauauucacccgaucacgauugggaagugcccuaaguaugugaaaucuaccaagcugagacuugcuacaggacugcggaacauccccagcguucagucccgcggccucuuuggggccauugccggauucaucgagggcggguggaccggaaugguggacggcugguacggcuaucaucaccagaaugaacaagggucuggauacgcugcggaccugaaaagcacacagaacgccaucgauaagauuaccaauaaagucaacuccgugaucgagaagaugaauacgcaguuuacagcuguuggcaaggaguucaaccaccuugagaaaagaauugagaaucugaacaagaaaguggacgauggguuccucgacaucuggaccuacaaugccgaacugcugguccuccuggagaacgaacggacccuugauuaucaugacagcaaugugaagaaccuguacgagaaaguccgcucucagcucaagaacaaugccaaggagauuggaaacggcuguuuugaguucuaucacaaaugcgauaauacauguauggaauccgugaagaacgggaccuacgacuauccuaaauacagcgaagaggcuaagcugaauagagaagagaucgauggcguuaaacuugagucuacacggaucuaucaaauucuggccaucuacuccacgguggcgagcucccucguccuggugguuucucugggagcuauuagcuuuuggaugugcuccaacggcucucuccagugccgcaucuguauuuga

SEQ ID NO: 188177 - RNA, 1701 nt, Artificial Sequence
  derived and/or modified sequence opt5 from hemagglutinin__InfluenzaA__ADJ40444
augaaggccauccuggugguccuccuguacaccuucgcuacagccaacgcggacacgcuuugcauuggcuaucacgcuaauaacagcaccgauacaguugacaccgugcugaaaaagaaugugacagucacccauuccgugaaccuccuggaggauaaacacaaugggaaacuuuguaaacugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggaacugcgggagcagcuuuccagcgucucuuccuucgagcgcuuugaaaucuuccccaagaccagcucuuggccuaaucacgauuccaacaaaggagugacagccgcuuguccccaugccggcgccaagagcuuuuauaaaaaucugaucuggcucguuaagaaaggcaacucuuacccuaagcuguccaagagcuauauuaaugacaaagggaaggaggugcuuguccuguggggaauccaccaccccuccaccucugccgaucaacagagccucuaccagaacgcugacgccuacguguucgugggcacauccagauauagcaaaaaguuuaaaccugaaauugcuauccggccgaagguccgcgaucaggaggggagaaugaauuacuauuggacccugguugagcccggagacaaaauuacguucgaagccacaggcaaccugguggugccucgguacgcguuugccauggagcgcaacgcugggucuggaaucauuaucuccgauacccccguccaugacugcaauacaaccugucaaaccccuaagggcgccaucaacacaagccuccccuuccagaauauucacccgaucacgauuggcaagugcccuaaauaugugaagucuaccaaacugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaucuuaagagcacacagaacgccaucgacgaaauuaccaauaaagucaacuccgugaucgagaagaugaauacgcaguuuacagcuguuggaaaggaguucaaccaccuggaaaagagaauugagaaucugaacaagaaaguggaugacggcuuccucgauaucuggaccuacaaugccgaacugcugguccuccuggagaacgaacggacccuugacuaucaugauagcaaugugaagaaccuguacgagaaaguccgcucucagcucaagaacaaugccaaggagauugggaacggauguuuugaguucuaucacaaaugcgacaauacauguauggaauccgugaagaacggcaccuacgauuauccuaaauacagcgaagaggcuaagcugaauagagaagagaucgacgggguuaaacuugagucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 188178 - RNA, 1701 nt, Artificial Sequence
  derived and/or modified sequence opt5 from hemagglutinin__InfluenzaA__ADJ40454
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaauccuuuuauaagaaucugaucuggcucguuaaaaagggcaacucuuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcaaucaggaggggagaaugaacuacuauuggacccugguugaacccggagauaagauuacguucgaggccacaggcaaccugguggugccucgguacgcguuugccauggaacgcaaugcugggucuggaaucauuaucuccgacacccccguccaugauugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauauccccagcauucagucccgcggacucuuuggcgccaucgccggguucaucgagggaggcuggaccgggaugguugacggaugguacggcuaucaucaccagaacgaacaaggcucuggguacgcugcggaccugaaaagcacacagaaugccauugauaagaucaccaacaaagugaauagcgucauugagaagaugaacacgcaguuuacagcugugggaaaggaguucaaucaccuugagaaaagaaucgagaaccugaauaagaaaguugacgauggcuuccucgacauuuggaccuacaacgccgaacugcuggugcuccuggagaaugaacggacccuugauuaucaugacagcaacgucaagaaccuguacgagaaagugcgcucucagcucaagaauaacgccaaggagaucgggaauggauguuuugaguucuaucacaaaugcgauaacacauguauggaauccgucaagaauggcaccuacgacuauccuaaauacagcgaagaggcuaagcugaacagagaagagaucgaugggguggagcuugaaucuacacggauuuaucaaauccuggccauuuacuccacgguugcgagcucccucgugcuggucgugucucugggcgcuaucagcuuuuggaugugcuccaauggaucucuccagugccgcauuuguaucuga

SEQ ID NO: 188179 - RNA, 1701 nt, Artificial Sequence
  derived and/or modified sequence opt5 from hemagglutinin__InfluenzaA__ADJ40464
augaaggccauccuggugguccuccuguacaccuucgcuacagccaacacggacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacgagauuacgaauaaggucaacuccgugaucgagaaaaugaauacacaguuuaccgccguuggaaaggaguucaaccaccuugagaagagaauugaaaaucugaacaaaaagguggaugacggcuuccucgauaucuggaccuacaaugcugagcugcugauucuccuggaaaacgagcggacacuugacuaucaugauagcaaugucaaaaaccuguacgagaaggugcgcucucagcucaaaaacaaugccaaggaaaucgggaacggauguuuugaguucuaucacaagugcgacaauaccuguauggaauccgucaaaaacggcacauacgauuauccuaaguacagcgaggaagccaaacugaauagagaggagaucgacggggugaaacuugaaucuacgcggauuuaucaaauccuggcuauuuacuccaccguugccagcucccucgugcuggucgugucucugggcgcgaucagcuuuuggaugugcuccaacggaucucuccagugccgcauuuguaucuga

SEQ ID NO: 188180 - RNA, 1701 nt, Artificial Sequence
  derived and/or modified sequence opt5 from hemagglutinin__InfluenzaA__ADJ40474
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaccugaaaagcacacagaacgccaucgaugagauuaccaauaaggucaacuccgugaucgaaaagaugaauacgcaguuuacagcuguuggaaaggaguucaaccaccuugaaaagagaauugagaaucugaacaaaaagguggacgauggcuuccucgacaucuggaccuacaaugccgaacugcugguccuccuggagaacgagcggacccuugauuaucaugacagcaaugugaaaaaccuguacgaaaagguccgcagacagcucaaaaacaaugccaaggagauugggaacggauguuuugaguucuaucacaagugcgauaauacauguauggagucugugaaaaacggcaccuacgacuauccuaaguacuccgaagaggcuaaacugaaucgggaggaaaucgaugggguuaaacuugagagcacacgcaucuaucaaauucuggccaucuacucuacgguggcguccagccucguccuggugguuucccugggcgcuauuucuuuuuggaugugcagcaacggaucccuccagugcagaaucuguauuuga

SEQ ID NO: 188181 - RNA, 1701 nt, Artificial Sequence
  derived and/or modified sequence opt5 from hemagglutinin__InfluenzaA__ADJ40494
augaaggccauccuggugguccuccuguacaccuucgcuacagccaacgcggacacgcuuugcauuggcuaucacgcuaauaacagcaccgauacaguugacaccgugcuggagaagaaugugacagucacccauuccguggaucuccuggaagacaagcacaacgggaaacuuuguaagcugagaggaguugcuccccuccaucugggcaaaugcaauaucgccggguggauucugggaaacccugagugugaaucucucagcacagccuccucuuggagcuacaucguggagaccuccucuagcgauaauggcacgugcuauccgggggacuuuauugauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagacccugaucuggcucguuaaaaagggcaacagcuacccuaaacuguccaagagcuauauuaaugauaaggggaaagaagugcuuguccuguggggaauccaccaccccuccacaucugccgaccaacagagccucuaccagaacgcugaugccuacguguucgugggcaccuccagauauagcaagaaauuuaagccugagauugcuauccggccgaaaguccgcgaccaggaggggagaaugaauuacuauuggacgcugguugaacccggagauaagauuacauucgaggccaccggcaaccugguggugccucgguacgcguuugccauggaacgcaaugcugggucuggaaucauuaucuccgacacacccguccaugacugcaacaccaccugucaaacaccuaaaggcgccaucaacacgagccuccccuuccagaauauucacccgaucaccauuggcaagugcccuaaguaugugaaaucuacaaagcugagacuugcuaccgggcugcggaacguucccagcauccagucccgcggacucuuuggcgccauugccggguucaucgagggaggcuggacagggaugguggauggaugguacggcuaucaucaccagaaugaacaaggcucuggguacgcugcggaccugaaaagcacccagaacgccaucgaugagauuacgaauaaggucaacuccgugaucgagaaaaugaauacacaguuuaccgcuguuggaaaggaguucaaccaccuugagaagagaauugaaaaucugaacaaaaagguggacgauggcuuccucgacaucuggaccuacaaugccgagcugcugguccuccuggaaaacgagcggacacuugauuaucaugacagcaaugugaaaaaccuguacgagaagguccgcucucagcucaaaaauaacgccaaggaaauugggaacggauguuuugaguucuaucacaagugcgauaauaccuguauggaauccgugaaaaacggcacauacgacuauccuaaguacagcgaggaagcuaaacugaauagagaggagaucgaugggguuaaacuugaaucuacgcggaucuaucaaauucuggccaucuacuccaccguggcgagcucccucguccuggugguuucucugggcgcuauuagcuuuuggaugugcuccaacggaucucuccagugccgcaucuguauuuga

SEQ ID NO: 188182 - RNA, 1701 nt, Artificial Sequence
  derived and/or modified sequence opt5 from hemagglutinin__InfluenzaA__ADJ40514
augaaggccgugcuggucguucuccuguacaccuucgcuacaacgaacgccgacacccuuugcaucggcuaucacgcgaauaacagcacagauaccguggacacagugcuggagaaaaaugucaccgugacacauuccguuaaccuccuggaagauaagcacaaugggaaacuuuguaagcugagaggaguggcuccccuccaucugggcaaaugcaacauugccggguggauccugggaaauccugagugugaaucucucagcaccgccuccucuuggagcuacauugucgagacguccucuagcgacaacggaaccugcuauccgggggauuuuaucgacuacgaagaacugcgggagcagcuuuccagcgugucuuccuucgaacgcuuugagauuuuccccaagacaagcucuuggccuaaucacgauuccaacaagggaguuaccgcugccuguccccaugcuggcgccaagagcuuuuauaagaaucugaucuggcucgugaaaaagggcaacucuuacccuaaacuguccaagagcuauaucaaugacaaggggaaagaaguccuugugcuguggggcauucaccaccccuccacaucugcggaucaacagagccucuaccagaacgccgacgcuuacguguucgucggcaccuccagauauagcaagaaauuuaagccugagaucgccauucggccgaaaguucgcaaucaggaggggagaaugaacuacuauuggacgcugguggaacccggagauaagaucacauucgaggcuaccggcaaccugguggucccucgguacgccuuugcgauggaacgcaaugccgggucuggaauuaucauuuccgacacacccgugcaugauugcaacaccaccugucaaacaccuaaaggcgcuaucaauacgagccuccccuuccagaacauccacccgauuaccaucggcaagugcccuaaguauguuaaaucuacaaagcugagacuugccaccgggcugcggaaugugcccagcauucagucccgcggacucuuuggcgcuaucgccggguucauugagggaggcuggacagggauggucgacggaugguacggcuaucaucaccagaacgaacaaggcucuggguacgccgcugaccugaaaagcacccagaaugcgaucgaugagaucacgaacaagguuaauuccgugauugagaaaaugaacacacaguuuaccgccgugggaaaggaguucaaucaccuugagaagagaaucgaaaaccugaauaaaaaggucgacgauggcuuccucgacauuuggaccuacaacgcugagcugcuggugcuccuggaaaaugagcggacacuugauuaucaugacagcaacgucaaaaaccuguacgagaaggugcgcucucagcucaaaaauaacgccaaggaaaucgggaauggauguuuugaguucuaucacaagugcgauaacaccuguauggaauccguuaaaaauggcacauacgacuauccuaaguacagcgaggaagccaaacugaacagagaggagauugauggggugaaacuugaaucuacgcggaucuaucaaauccuggcuauuuacuccaccgucgccagcucccucgugcugguugugucucugggcgcgaucagcuuuuggaugugcuccaauggaucucuccagugccgcauuuguaucuga

SEQ ID NO: 188183 - RNA, 1701 nt, Artificial Sequence; identical to SEQ ID NO: 185693
  derived and/or modified sequence opt5 from hemagglutinin__InfluenzaA__ADJ40524

SEQ ID NO: 188184 - RNA, 1701 nt, Artificial Sequence; identical to SEQ ID NO: 186046
  derived and/or modified sequence opt5 from hemagglutinin__InfluenzaA__ADJ40534

SEQ ID NO: 188185 - RNA, 1701 nt, Artificial Sequence
  derived and/or modified sequence opt5 from hemagglutinin__InfluenzaA__ADJ40554
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaaaugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaauaccagcucuuggccuaaccacgauuccaauaagggagugacagccgcuuguccccaugccggcgccaagagcuuuuauaaaaaccugaucuggcucguuaagaaaggcaauucuuacccuaagcuguccaaaagcuauauuaacgacaaggggaaggaagugcuuguccuguggggaauccaccaccccuccaccucugccgaucaacagagccucuaccagaaugcugacgccuacguguucgugggcacauccagauauagcaaaaaguuuaaaccugagauugcuauccggccgaagguccgcgaucaggaggggagaaugaacuacuauuggacccugguugaacccggagacaaaauuacguucgaggccacaggcaaccugguggugccucgguacgcguuugccauggaacgcaaugcugggucuggaaucauuaucuccgauacccccguccaugacugcaacacaaccugucaaaccccuaagggcgccaucaauacaagccuccccuuccagaacauucacccgaucacgauuggcaaaugcccuaaguaugugaagucuaccaaacugagacuugcuacagggcugcggaauguucccagcauccagucccgcggacucuuuggcgccauugccggguucaucgagggaggcuggaccgggaugguggacggaugguacggcuaucaucaccagaacgaacaaggcucuggguacgcugcggaucuuaagagcacacagaaugccaucgacgagauuaccaacaaagucaauuccgugaucgagaagaugaacacgcaguuuacagcuguuggaaaagaguucaaucaccuggagaagagaauugaaaaccugaauaagaaaguggaugacggcuuccucgauaucuggaccuacaacgccgagcugcugguccuccuggaaaaugagcggacccuugacuaucaugauagcaacgugaagaaccuguacgagaaaguccgcucucagcucaagaauaacgccaaagaaauugggaauggauguuuugaguucuaucacaagugcgacaacacauguauggaauccgugaagaauggcaccuacgauuauccuaaauacagcgaggaagcuaagcugaacagagaggagaucgacgggguuaaacuugaaucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 188186 - RNA, 1701 nt, Artificial Sequence; identical to SEQ ID NO: 185693
  derived and/or modified sequence opt5 from hemagglutinin__InfluenzaA__ADJ40564

SEQ ID NO: 188187 - RNA, 1701 nt, Artificial Sequence; identical to SEQ ID NO: 185693
  derived and/or modified sequence opt5 from hemagglutinin__InfluenzaA__ADJ40574

SEQ ID NO: 188188 - RNA, 1701 nt, Artificial Sequence; identical to SEQ ID NO: 187113
  derived and/or modified sequence opt5 from hemagglutinin__InfluenzaA__ADJ40584

SEQ ID NO: 188189 - RNA, 1701 nt, Artificial Sequence; identical to SEQ ID NO: 185693
  derived and/or modified sequence opt5 from hemagglutinin__InfluenzaA__ADJ40594

SEQ ID NO: 188190 - RNA, 1701 nt, Artificial Sequence; identical to SEQ ID NO: 186262
  derived and/or modified sequence opt5 from hemagglutinin__InfluenzaA__ADJ40604

SEQ ID NO: 188191 - RNA, 1701 nt, Artificial Sequence; identical to SEQ ID NO: 186262
  derived and/or modified sequence opt5 from hemagglutinin__InfluenzaA__ADJ40614

SEQ ID NO: 188192 - RNA, 1701 nt, Artificial Sequence; identical to SEQ ID NO: 185693
  derived and/or modified sequence opt5 from hemagglutinin__InfluenzaA__ADJ40634

SEQ ID NO: 188193 - RNA, 1701 nt, Artificial Sequence; identical to SEQ ID NO: 185693
  derived and/or modified sequence opt5 from hemagglutinin__InfluenzaA__ADJ40644

SEQ ID NO: 188194 - RNA, 1701 nt, Artificial Sequence; identical to SEQ ID NO: 185693
  derived and/or modified sequence opt5 from hemagglutinin__InfluenzaA__ADJ40654

SEQ ID NO: 188195 - RNA, 1701 nt, Artificial Sequence; identical to SEQ ID NO: 185693
  derived and/or modified sequence opt5 from hemagglutinin__InfluenzaA__ADJ40664

SEQ ID NO: 188196 - RNA, 1701 nt, Artificial Sequence; identical to SEQ ID NO: 185693
  derived and/or modified sequence opt5 from hemagglutinin__InfluenzaA__ADJ40674

SEQ ID NO: 188197 - RNA, 1701 nt, Artificial Sequence
  derived and/or modified sequence opt5 from hemagglutinin__InfluenzaA__ADJ41816
augaagaccaucauugcccugagcuacauguucugccucguguuugcucagaaccugcccggcaaugacaacuccacagccacgcuuugucuggggcaccaugcggucccuaauggaacccucguuaaaacaaucaccaacgaucaaauugaggugacaaaugcuaccgaacuggugcagucuagcuccacaggcagaaucugcgacucuccgcaccggauucuugaugggaagaacuguacccugaucgacgcccuccugggagauccccauugcgacggcuuccagaaugagaaaugggaucuguuugucgaacgcagcaaggccuucuccaacuguuauccuuacgacgugcccgauuaugcuucucucagaagccugguugccuccagcgggacgcuugaguuuaucaaugaaggauucaacuggaccggcgugacacagucuggcggguccugcaccuguaaacggggaagcaaugacagcuuuuucucccgccugaacuggcucuacgagagcgagucuaaguauccuguccugaaugugacaaugcccaacaauggcaaguuugauaaacuuuacauuugggggauccaccauccuuccaccgacaaggaacaaacgaaccuguauauuagagcuagcggacggguuacaguguccaccaaacgcucucagcagacagucaucccgaacauuggcagcagacccugggugcgggggcucuccagccgcaucucuauuuacuggaccaucgugaagccuggagauauccugcugauuuccagcaccggcaaucucaucgcccccagaggcuacuucaaaauucggacagggaagucuagcaucaugcgcuccgacgcgccuauuggaacgugcucuagcgaguguaucacccccaacggcuccaucccgaaugacaagccuuuucagaacgucaauaaaauuacauauggggccugccccagauacguuaagcaaaacacccugaaacuugcuacaggaaugcggaaugugccugaaaagcagacccgcggcaucuucggggccauugcuggauuuaucgagaacggcugggagggcaugguggaugggugguauggauucagacaccagaauagcgaaggcacggggcaggccgcggaccugaaaucuacacaagccgcuauugaucagaucaacggaaagcucaaucgggucaucgagaaaaccaacgaaaaguuccaccagauugagaaggaauuuuccgagguggagggcagaauccaagaccuggaaaaauacguugaggauaccaagauugaccuuuggagcuauaaugccgaacugcucguggcucuggagaaccagcauacaaucgaucugaccgacucugaaaugaauaaacucuucgagaagacacgcaaacagcugcgggagaacgccgaagauauggggaacggcuguuuuaagauuuaccacaagugcgacaaugccugcaucggauccauuagaaacggcacguaugaucaugacgucuaccgcgacgaggcucuuaauaaccgguuccagaucaaagggguggaacugaagucuggauacaaagauuggauccucuggauuuccuuugcgaucucuuguuuccugcuuugcguugugcugcucggcuuuauuaugugggccugucaaaaggggaauaucagaugcaacauuuguaucuga

SEQ ID NO: 188198 - RNA, 1701 nt, Artificial Sequence; identical to SEQ ID NO: 185693
  derived and/or modified sequence opt5 from hemagglutinin__InfluenzaA__ADJ56640

SEQ ID NO: 188199 - RNA, 1701 nt, Artificial Sequence; identical to SEQ ID NO: 186491
  derived and/or modified sequence opt5 from hemagglutinin__InfluenzaA__ADJ56650

SEQ ID NO: 188200 - RNA, 1701 nt, Artificial Sequence; identical to SEQ ID NO: 185784
  derived and/or modified sequence opt5 from hemagglutinin__InfluenzaA__ADJ67983

SEQ ID NO: 188201 - RNA, 1701 nt, Artificial Sequence; identical to SEQ ID NO: 185784
  derived and/or modified sequence opt5 from hemagglutinin__InfluenzaA__ADJ67984

SEQ ID NO: 188202 - RNA, 1701 nt, Artificial Sequence; identical to SEQ ID NO: 185784
  derived and/or modified sequence opt5 from hemagglutinin__InfluenzaA__ADJ67985

SEQ ID NO: 188203 - RNA, 1701 nt, Artificial Sequence
  derived and/or modified sequence opt5 from hemagglutinin__InfluenzaA__ADJ80241
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcaaucaggaggggagaaugaacuacuauuggacccugguugaacccggagauaagauuacguucgaggccacaggcaaccugguggugccucgguacgcguuugccauggaacgcaaugcugggucuggaaucauuaucuccgacacccccguccaugauugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggacggaugguacggcuaucaucaccagaacgaacaaggcucuggguacgcugcggaccugaaaagcacacagaaugccaucgauaagauuaccaacaaagucaauuccgugaucgagaagaugaacacgcaguuuacagcuguuggaaaggaguucaaucaccuugagaaaagaauugagaaccugaauaagaaaguggacgauggcuuccucgacaucuggaccuacaacgccgaacugcugguccuccuggagaaugaacggacccuugauuaucaugacagcaacgugaagaaccuguacgagaaaguccgcucucagcucaagaauaacgccaaggagauugggaauggauguuuugaguucuaucacaaaugcgauaacacauguauggaauccgugaagaauggcaccuacgacuauccuaaauacagcgaagaggcuaagcugaacagagaagagaucgaugggguuaaacuugagucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 188204 - RNA, 1701 nt, Artificial Sequence
  derived and/or modified sequence opt5 from hemagglutinin__InfluenzaA__ADJ80242
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggaucuaucaaauucuggccaucuacuccacggcggcuagcucccucgugcuggucgugucucugggcgccauuagcuuuuggaugugcuccaacggaucucuccagugccgcaucuguauuuga

SEQ ID NO: 188205 - RNA, 1701 nt, Artificial Sequence; identical to SEQ ID NO: 187245
  derived and/or modified sequence opt5 from hemagglutinin__InfluenzaA__ADJ80243

SEQ ID NO: 188206 - RNA, 1701 nt, Artificial Sequence; identical to SEQ ID NO: 185693
  derived and/or modified sequence opt5 from hemagglutinin__InfluenzaA__ADJ80634

SEQ ID NO: 188207 - RNA, 1701 nt, Artificial Sequence; identical to SEQ ID NO: 187695
  derived and/or modified sequence opt5 from hemagglutinin__InfluenzaA__ADJ80644

SEQ ID NO: 188208 - RNA, 1701 nt, Artificial Sequence; identical to SEQ ID NO: 187695
  derived and/or modified sequence opt5 from hemagglutinin__InfluenzaA__ADJ80654

SEQ ID NO: 188209 - RNA, 1701 nt, Artificial Sequence; identical to SEQ ID NO: 186857
  derived and/or modified sequence opt5 from hemagglutinin__InfluenzaA__ADJ80674

SEQ ID NO: 188210 - RNA, 1701 nt, Artificial Sequence; identical to SEQ ID NO: 186857
  derived and/or modified sequence opt5 from hemagglutinin__InfluenzaA__ADJ80684

SEQ ID NO: 188211 - RNA, 1701 nt, Artificial Sequence
  derived and/or modified sequence opt5 from hemagglutinin__InfluenzaA__ADJ80694
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaaucacaacgggaagcuguguaaacuuagaggaguugcgccccugcaucucggcaagugcaauauugccggguggauccugggaaacccugagugugaaucucugagcacagcuuccucuuggagcuacauuguggagaccuccucuagcgacaauggcacgugcuauccgggggauuuuaucgacuacgaagaacuccgggagcagcuguccagcgucucuuccuucgaacgcuuugagaucuuccccaaaaccagcucuuggccuaaccacgauuccaauaagggagugacagccgcuuguccccaugccggcgccaagagcuuuuauaaaaaccuuauuuggcugguuaagaaaggcaauucuuacccuaagcucuccaaaagcuauaucaacgacaaggggaaggaagugcugguccuuuggggcauucaccaccccuccaccucugccgaucaacagagccuguaccagaaugcugacgccuacguguucgugggauccagcagauauucuaaaaaguuuaaaccugagaucgcuauucggccgaagguccgcgaucaggaggggagaaugaacuacuauuggacacucguugaacccggagacaaaaucaccuucgaggccacgggcaaccugguggugccucgguacgcguuugccauggaacgcaaugcuggguccggaauuaucaucagcgauacacccguccaugacugcaacaccacaugucaaaccccuaagggcgccauuaauaccucucugcccuuccagaacauccacccgauuacaaucggcaaaugcccuaaguauguuaagagcacgaaacucagacuggcuaccgggcuucggaaugugcccuccauucagucucgcggacuguuuggcgccaucgccggguucaucgagggaggcuggacagggaugguggacggaugguacggcuaucaucaccagaacgaacaaggcagcggguacgcugcggaucucaaguccacccagaaugccauugacgagaucacaaacaaagucaauagcgugauugagaagaugaacacccaguuuacggcuguuggaaaagaguucaaucaccuggagaagagaaucgaaaaccuuaauaagaaaguggaugacggcuuccuggauauuuggacauacaacgccgagcuccugguccugcucgaaaaugagcggacccuggacuaucaugauucuaacgugaagaaccuuuacgagaaaguccgcucccagcugaagaauaacgccaaagaaguggggaauggauguuuugaguucuaucacaagugcgacaacaccuguauggaaagcguuaagaauggcacauacgauuauccuaaauacucugaggaagcuaagcucaacagagaggagaucgacggggugaaacuggaauccacccggaucuaucaaauucuugccaucuacagcacagcggcuuccucucugguccucgugguuagccugggcgccauuuccuuuuggaugugcucuaauggaagccugcagugccgcaucuguauuuga

SEQ ID NO: 188212 - RNA, 1701 nt, Artificial Sequence; identical to SEQ ID NO: 186857
  derived and/or modified sequence opt5 from hemagglutinin__InfluenzaA__ADJ80704

SEQ ID NO: 188213 - RNA, 1701 nt, Artificial Sequence
  derived and/or modified sequence opt5 from hemagglutinin__InfluenzaA__ADJ80714
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggagccgcuccccuccaucugggcaaaugcaacaucgccggguggauucugggaaauccugagugugaaucucucagcacagccuccucuuggagcuacaucguugagaccuccucuagcgacaacggcacgugcuauccgggggauuuuauugacuacgaagaacugcgggagcagcuuuccagcgugucuuccuucgaacgcuuugagaucuuccccaagaccagcucuuggccuaaucacgauuccaacaagggagucacagcugccuguccccaugcgggcgccaagagcuuuuauaaaaaucugaucuggcucgugaaaaagggcaacucuuacccuaaacuguccaagagcuauauuaaugacaaggggaaagaaguucuugugcuguggggaauccaccaccccuccaccucugcugaucaacagagccucuaccagaacgccgacgcuuacgucuucgugggcacauccagauauagcaagaaauuuaagccugagauugccauccggccgaaagugcgcgaucaggaggggagaaugaauuacuauuggacccuggucgaacccggagacaagauuacguucgaggcgacaggcaaccugguugugccucgguacgccuuugcuauggaacgcaacgccgggucuggaaucauuaucuccgauacccccgugcaugacugcaauacaaccugucaaaccccuaaaggcgcuaucaacacaagccuccccuuccagaauauucacccgaucacgauuggcaagugcccuaaguaugucaaaucuaccaagcugagacuugccacagggcugcggaacgugcccagcauccagucccgcggacucuuuggcgccauugcuggguucaucgagggaggcuggaccgggaugguugacggaugguacggcuaucaucaccagaaugaacaaggcucuggguacgcggccgaucugaaaagcacacagaacgcuaucgacaagauuaccaauaaagugaacuccgucaucgagaagaugaauacgcaguuuacagccgugggaaaggaguucaaccaccuugagaaaagaauugagaaucugaacaagaaaguugaugacggcuuccucgauaucuggaccuacaaugccgaacugcuggugcuccuggagaacgaacggacccuugacuaucaugauagcaaugucaagaaccuguacgagaaagugcgcucucagcucaagaacaaugcuaaggagauugggaacggauguuuugaguucuaucacaaaugcgacaauacauguauggaauccgucaagaacggcaccuacgauuauccuaaauacagcgaagaggccaagcugaauagagaagagaucgacggggugaaacuugagucuacacggaucuaucaaauucuggcgaucuacuccacgguugcuagcucccucgugcuggucgugucucugggcgccauuagcuuuuggaugugcuccaacggaucucuccagugccgcaucuguauuuga

SEQ ID NO: 188214 - RNA, 1701 nt, Artificial Sequence; identical to SEQ ID NO: 185693
  derived and/or modified sequence opt5 from hemagglutinin__InfluenzaA__ADJ80724

SEQ ID NO: 188215 - RNA, 1701 nt, Artificial Sequence; identical to SEQ ID NO: 186857
  derived and/or modified sequence opt5 from hemagglutinin__InfluenzaA__ADJ80734

SEQ ID NO: 188216 - RNA, 1701 nt, Artificial Sequence; identical to SEQ ID NO: 186857
  derived and/or modified sequence opt5 from hemagglutinin__InfluenzaA__ADJ80744

SEQ ID NO: 188217 - RNA, 1701 nt, Artificial Sequence; identical to SEQ ID NO: 186857
  derived and/or modified sequence opt5 from hemagglutinin__InfluenzaA__ADJ80754

SEQ ID NO: 188218 - RNA, 1701 nt, Artificial Sequence
  derived and/or modified sequence opt5 from hemagglutinin__InfluenzaA__ADJ80774
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccaacuccuggucuuacauuguggagaccagcuccucugacaauggcacgugcuauccgggggauuuuaucgacuacgaagaacuccgggagcagcugagcuccgucagcucuuucgaacgcuuugagaucuuccccaagaccuccagcuggccuaaccacgauucuaauaagggagugacagccgcuuguccccaugccggcgcgaaauccuuuuauaagaaccuuauuuggcugguuaaaaagggcaauagcuacccuaaacucucuaaguccuauaucaacgacaaggggaaagaagugcugguccuuuggggcauucaccaccccagcaccuccgccgaucaacagucucuguaccagaaugcugacgccuacguguucgugggaagcuccagauauagcaagaaauuuaagccugagaucgcuauucggccgaaaguccgcgaucaggaggggagaaugaacuacuauuggacacucguugaacccggagacaagaucaccuucgaggccacgggcaaccugguggugccucgguacgcguuugccauggaacgcaaugcugggucuggaauuaucaucuccgauacacccguccaugacugcaacaccacaugucaaaccccuaaaggcgccauuaauaccagccugcccuuccagaacauccacccgauuacaaucggcaagugcccuaaguaugugaaaucuacgaagcucagacuggcuaccgggcuucggaauguucccagcauucagucccgcggacuguuuggcgccaucgccggguucaucgagggaggcuggacagggaugguggacggaugguacggcuaucaucaccagaacgaacaaggcucuggguacgcugcggaucucaaaagcacccagaaugccauugacgagaucacaaacaaggucaauuccgugauugagaaaaugaacacccaguuuacggcuguuggaaaggaguucaaucaccuggagaagagaaucgaaaaccuuaauaaaaagguggaugacggcuuccuggauauuuggacauacaacgccgagcuccugguccugcucgaaaaugagcggacccuggacuaucaugauagcaacgugaaaaaccuuuacgagaagguccgcucucagcugaaaaauaacgccaaggaaguggggaauggauguuuugaguucuaucacaagugcgacaacaccuguauggaauccguuaaaaauggcacauacgauuauccuaaguacagcgaggaagcuaaacucaacagagaggagaucgacggggugaagcuggaaucuacccggaucuaucaaauucuugccaucuacuccacagcggcuagcucccugguccucgugguuucucugggcgccauuagcuuuuggaugugcuccaauggaucucugcagugccgcaucuguauuuga

SEQ ID NO: 188219 - RNA, 1701 nt, Artificial Sequence
  derived and/or modified sequence opt5 from hemagglutinin__InfluenzaA__ADJ80784
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccacaauauucauccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaccaccagaaugaacagggcucuggguacgcugcggaucugaaaagcacacaaaacgccaucgacaagauuaccaauaaagucaacuccgugaucgagaagaugaauacgcaguuuacagcuguuggaaaggaguucaaccaucuugagaaaagaauugagaaucugaacaagaaaguggaugacggcuuccucgauaucuggaccuacaaugccgaacugcugguccuccuggagaacgaacggacccuugacuaucacgauagcaaugugaagaaccuguacgagaaaguccgcucucagcucaagaacaaugccaaggagauugggaacggauguuuugaguucuaucauaaaugcgacaauacauguauggaauccgugaagaacggcaccuacgauuauccuaaauacagcgaagaggcuaagcugaauagagaagagaucgacgggguuaaacuugagucuacacggaucuaucagauucuggccaucuacuccacgguggcgagcucccucguccuggugguuucucugggcgcuauuagcuuuuggaugugcuccaacggaucucuccaaugccgcaucuguauuuga

SEQ ID NO: 188220 - RNA, 1701 nt, Artificial Sequence; identical to SEQ ID NO: 186857
  derived and/or modified sequence opt5 from hemagglutinin__InfluenzaA__ADJ80794

SEQ ID NO: 188221 - RNA, 1701 nt, Artificial Sequence; identical to SEQ ID NO: 187695
  derived and/or modified sequence opt5 from hemagglutinin__InfluenzaA__ADJ80804

SEQ ID NO: 188222 - RNA, 1701 nt, Artificial Sequence
  derived and/or modified sequence opt5 from hemagglutinin__InfluenzaA__ADJ80814
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuugucccagagccggcgcgaaaucuuuuuauaagaaucugaucuggcucguuaaaaagggcaacagcuacccuaaacuguccaagagcuauauuaaugacaaggggaaagaagugcuuguccuguggggaauccaucaccccuccaccucugccgaucaacagagccucuaccagaacgcugacgccuacguguucgugggcacaucccgguauagcaagaaauuuaagccugagauugcuauccgcccgaaagucagagaucaggaggggcggaugaauuacuauuggacccugguugaacccggagacaagauuacguucgaggccacaggcaaccugguggugccucgcuacgcguuugccaucgaaagaaacgcugggucuggaauuaucaucuccgauacccccguccacgacugcaauacaaccugucaaaccccuaaaggcgccauuaacacaagccuccccuuccagaauauccauccgauuacgaucggcaagugcccuaaguaugugaaaucuaccaagcugcggcuugcuacagggcugcgcaacguucccagcauucaguccagaggacucuuuggcgccaucgccggguucaucgagggaggcuggaccgggaugguggacggaugguacggcuaucaccaucagaaugaacaaggcucuggguacgcugcggaucugaaaagcacacagaacgccauugacaagaucaccaauaaagucaacuccgugauugagaagaugaauacgcaguuuacagcuguuggaaaggaguucaaccaccuugaaaaacggaucgagaaucugaacaagaaaguggaugacggcuuccucgauauuuggaccuacaaugccgaacugcugguccuccuggagaacgaacgcacccuugacuaucacgauagcaaugugaagaaccuguacgagaaagucagaucucagcucaagaacaaugccaaggagaucgggaacggauguuuugaguucuaucauaaaugcgacaauacauguauggaguccgugaagaacggcaccuacgauuauccuaaauacagcgaagaggcuaagcugaaucgggaagagaucgacgggguuaaacuugagucuacacgcauuuaucaaauccuggccauuuacuccacgguggcgagcucccucguccuggugguuucucugggcgcuaucagcuuuuggaugugcuccaacggaucucuccagugcagaauuuguaucuga

SEQ ID NO: 188223 - RNA, 1701 nt, Artificial Sequence
  derived and/or modified sequence opt5 from hemagglutinin__InfluenzaA__ADJ80834
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucuacagaucaacagagccucuaccagaacgccgacgcuuacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacucuggguccggaaucauuaucagcgauacacccguccauuauugcaauaccaccugucaaacaccuaaaggcgccaucaacacgucucuccccuuccagaauauucacccgaucaccauuggcaagugcccuaaguacgugaaaagcacaaagcugagacuugcuaccgggcugcggaacguucccuccauccagucucgcggacucuuuggcgccauugcuggguucaucgagggaggcuggacagggaugguggacggaugguauggcuaccaucaccagaaugaacaaggcagcggguacgccgccgaccugaaauccacccagaacgcuaucgaugagauuacgaauaaggucaacagcgugaucgagaaaaugaauacacaguuuaccgcgguuggaaaggaguucaaccaccuugagaagagaauugaaaaucugaacaaaaagguggacgauggcuuccucgacaucuggaccuauaaugccgagcugcugguccuccuggaaaacgagcggacacuugauuaccaugacucuaaugugaaaaaccuguaugagaagguccgcucccagcucaaaaacaaugcuaaggaaauugggaacggauguuuugaguucuaccacaagugcgauaauaccuguauggaaagcgugaaaaacggcacauaugacuacccuaaguauucugaggaagccaaacugaauagagaggagaucgaugggguuaaacuugaauccacgcggaucuaccaaauucuggccaucuacagcaccguggcuuccucucucguccuggugguuagccugggcgccauuuccuuuuggaugugcucuaacggaagccuccagugccgcaucuguauuuga

SEQ ID NO: 188224 - RNA, 1701 nt, Artificial Sequence; identical to SEQ ID NO: 187895
  derived and/or modified sequence opt5 from hemagglutinin__InfluenzaA__ADJ80848

SEQ ID NO: 188225 - RNA, 1701 nt, Artificial Sequence
  derived and/or modified sequence opt5 from hemagglutinin__InfluenzaA__ADJ80858
augaagaccauccuggugguccuccuguacacauucgccacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaaaaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacaagauuacgaauaaagucaacuccgugaucgagaagaugaauacacaguuuaccgccguuggaaaggaguucaaccaccuugagaaaagaauugagaaucugaacaagaaaguggaugacggcuuccucgauaucuggaccuacaaugcugaacugcugguccuccuggagaacgaacggacacuugacuaucaugauagcaaugugaagaaccuguacgagaaaguccgcucucagcucaagaacaaugccaaggagauugggaacggauguuuugaguucuaucacaaaugcgacaauaccuguauggaauccgugaagaacggcacauacgauuauccuaaauacagcgaagaggccaagcugaauagagaagagaucgacgggguuaaacuugagucuacgcggaucuaucaaauucuggcuaucuacuccaccguggccagcucccucguccuggugguuucucugggcgcgauuagcuuuuggaugugcuccaacggaucucuccagugccgcaucuguauuuga

SEQ ID NO: 188226 - RNA, 1701 nt, Artificial Sequence
  derived and/or modified sequence opt5 from hemagglutinin__InfluenzaA__ADJ80868
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuugucccaaugccggcgcgaaaucuuuuuauaagaaccugaucuggcucguuaaaaagggcaauagcuacccuaaacuguccaagagcuauauuaacgacaaggggaaagaagugcuuguccuguggggaauccaucaccccuccaccucugccgaucaacagagccucuaccagaaugcugacgccuacguguucgugggcacauccagauauagcaagaaauuuaagccugagauugcuauccggccgaaaguccgcgaucaggaggggagaaugaacuacuauuggacccugguugaacccggaggcaagauuacguucgaggccacagggaaccugguggugccucgguacgcguuugccauggaacgcaaugcuggaucuggcaucauuaucuccgacacccccguccacgauugcaacacaaccugucaaaccccuaaaggcgccaucaauacaagccuccccuuccagaacauucauccgaucacgauugggaagugcccuaaguaugugaaaucuaccaagcugagacuugcuacaggacugcggaauguucccagcauccagucccgcggccucuuuggggccauugccggauucaucgagggcggguggaccggaaugguggacggcugguacggcuaucaccaucagaacgaacaagggucuggauacgcugcggaccugaaaagcacacagaaugccaucgauaagauuaccaacaaagucaauuccgugaucgagaagaugaacacgcaguuuacagcuguuggcaaggaguucaaucaccuugagaaaagaauugagaaccugaauaagaaaguggacgauggguuccucgacaucuggaccuacaacgccgaacugcugguccuccuggagaaugaacggacccuugauuaucacgacagcaacgugaagaaccuguacgagaaaguccgcucucagcucaagaauaacgccaaggagauuggaaauggcuguuuugaguucuaucauaaaugcgauaacacauguauggaauccgugaagaaugggaccuacgacuauccuaaauacagcgaagaggcuaagcugaacagagaagagaucgauggcguuaaacuugagucuacacggaucuaucaaauucuggccaucuacuccacgguggcgagcucccucguccuggugguuucucugggagcuauuagcuuuuggaugugcuccaauggcucucuccagugccgcaucuguauuuga

SEQ ID NO: 188227 - RNA, 1701 nt, Artificial Sequence; identical to SEQ ID NO: 186857
  derived and/or modified sequence opt5 from hemagglutinin__InfluenzaA__ADJ80883

SEQ ID NO: 188228 - RNA, 1701 nt, Artificial Sequence; identical to SEQ ID NO: 186857
  derived and/or modified sequence opt5 from hemagglutinin__InfluenzaA__ADJ80893

SEQ ID NO: 188229 - RNA, 1701 nt, Artificial Sequence; identical to SEQ ID NO: 186857
  derived and/or modified sequence opt5 from hemagglutinin__InfluenzaA__ADJ80910

SEQ ID NO: 188230 - RNA, 1701 nt, Artificial Sequence; identical to SEQ ID NO: 185693
  derived and/or modified sequence opt5 from hemagglutinin__InfluenzaA__ADJ80927

SEQ ID NO: 188231 - RNA, 1701 nt, Artificial Sequence
  derived and/or modified sequence opt5 from hemagglutinin__InfluenzaA__ADJ80937
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaauccuuuuauaagaaucugaucuggcucguuaaaaagggcaacucuuacccuaaacuguccaagagcuauauuaaugacaaggggaaagaagugcuuguccuguggggaauccaccaccccuccaccucugccgaucaacagagccucuaccagaacgcugacgccuacgcuuucgugggcacauccagauauagcaagaaauuuaagccugagauugccauccggccgaaagugcgcgaucaggaggggagaaugaauuacuauuggacccuggucgaacccggagacaagauuacguucgaggcgacaggcaaccugguugugccucgguacgccuuugcuauggaacgcaacgccgggucuggaaucauuaucuccgauacccccgugcauaauugcaacacaaccugucaaaccccuaaaggcgcuaucaauacaagccuccccuuccagaacauucacccgaucacgauuggcaagugcccuaaguaugucaaaucuaccaagcugagacuugccacagggcugcggaaugugcccagcauccagucccgcggacucuuuggcgccauugcuggguucaucgagggaggcuggaccgggaugguugacggaugguacggcuaucaucaccagaacgaacaaggcucuggguacgcggccgaccugaaaagcacacagaaugcuaucgaugagauuaccaacaaggugaauagcgucaucgagaaaaugaacacgcaguuuacagccgugggaaaggaguucaaucaccuugagaagagaauugaaaaccugaauaaaaagguugacgauggcuuccucgacaucuggaccuacaacgccgagcugcuggugcuccuggaaaaugagcggacccuugauuaucaugacagcaacgucaaaucucuguacgagaaggugcgcucccagcucaaaaacaaugcuaaggaaauugggaacggauguuuugaguucuaucacaagugcgauaauacauguauggaaagcgucaaaaacggcaccuacgacuauccuaaguacucugaggaagccaaacugaauagagaggagaucgauggggugaaacuugaauccacacggaucuaucaaauucuggcgaucuacagcacgguugcuuccucucucgugcuggucgugagccugggcgccauuuccuuuuggaugugcucuaacggaagccuccagugccgcaucuguauuuga

SEQ ID NO: 188232 - RNA, 1701 nt, Artificial Sequence; identical to SEQ ID NO: 186857
  derived and/or modified sequence opt5 from hemagglutinin__InfluenzaA__ADJ80947

SEQ ID NO: 188233 - RNA, 1701 nt, Artificial Sequence; identical to SEQ ID NO: 186857
  derived and/or modified sequence opt5 from hemagglutinin__InfluenzaA__ADJ80967

SEQ ID NO: 188234 - RNA, 1701 nt, Artificial Sequence; identical to SEQ ID NO: 186857
  derived and/or modified sequence opt5 from hemagglutinin__InfluenzaA__ADJ80977

SEQ ID NO: 188235 - RNA, 1701 nt, Artificial Sequence
  derived and/or modified sequence opt5 from hemagglutinin__InfluenzaA__ADJ80993
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuugucccaaugccggcgcgaaaucuuuuuauaagaaccugaucuggcucguuaaaaagggcaauagcuacccuaaacuguccaagagcuauauuaacgacaaggggaaagaagugcuuguccuguggggaauccaucaccccuccaccucugccgaucaacagagccucuaccagaaugcugacgccuacguguucgugggcacauccagauauagcaagaaauuuaagccugagauugcuauccggccgaaaguccgcgaucaggaggggagaaugaacuacuauuggacccugguugaacccggagacaagauuacguucgaggccacaggcaaccugguggugccucgguacgcguuugccauggaacgcaaugcugggucuggaaucauuaucuccgauacccccguccacgacugcaacacaaccugucaaaccccuaaaggcgccaucaauacaagccuccccuuccagaacauucauccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggacggaugguacggcuaucaccaucagaacgaacaaggcucuggguacgcugcggaucugaaaagcacacagaaugccaucgacaagauuaccaacaaagucaauuccgugaucgagaagaugaacacgcaguuuacagcuguuggaaaggaguucaaucaccuugagaaaagaauugagaaccugaauaagaaaguggaugacggcuuccucgauaucuggaccuacaacgccgaacugcugguccuccuggagaaugaacggacccuugacuaucacgauagcaacgugaagaaccuguacgagaaaguccgcucucagcucaagaauaacgccaaggagauugggaauggauguuuugaguucuaucauaaaugcgacaacacauguauggaauccgugaagaauggcaccuacgauuauccuaaauacagcgaagaggcuaagcugaacagagaagagaucgacgggguuaaacuugagucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 188236 - RNA, 1701 nt, Artificial Sequence
  derived and/or modified sequence opt5 from hemagglutinin__InfluenzaA__ADJ81003
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacaagauuaccaauaaagucaacuccgugaucgagaagaugaauacgcaguuuacagcuguuggaaaggaguucaaccaccuugaaaagagaauugagaaucugaacaagaaaguggaugacggcuuccucgauaucuggaccuacaaugccgaacugcugguccuccuggagaacgaacggacccuugacuaucaugauagcaaugugaagaaccuguacgagaaaguccgcucucagcucaagaacaaugccaaggagauugggaacggauguuuugaguucuaucacaaaugcgacaauacauguauggaguccgugaagaacggcaccuacgauuauccuaaauacagcgaagaggcuaagcugaauagagagaaaaucgacgggguuaaacuugaaucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 188237 - RNA, 1701 nt, Artificial Sequence; identical to SEQ ID NO: 187895
  derived and/or modified sequence opt5 from hemagglutinin__InfluenzaA__ADJ81013

SEQ ID NO: 188238 - RNA, 1701 nt, Artificial Sequence
  derived and/or modified sequence opt5 from hemagglutinin__InfluenzaA__ADJ81023
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagauguuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacugaauaaguccuauaucaacgacaaggggaaagaagugcuuguccuguggggcauucaccaccccagcaccuccgccgaucaacagucucucuaccagaaugcugacgccuacguguucgugggaacaagcagauauuccaagaaauuuaagccugagaucgcuauucggccgaaaguccgcgaucaggaggggagaaugaacuacuauuggacccugguugaacccggagacaagaucacguucgaggccacaggcaaccugguggugccucgguacgcguuugccauggaacgcaaugcugggagcggaauuaucauuucugauacccccguccaugacugcaacacaaccugucaaaccccuaaaggcgccaucaauacaucccuccccuuccagaacauccacccgauuacgaucggcaagugcccuaaguaugugaaaagcaccaagcugagacuugcuacagggcugcggaauguucccucuauucagagccgcggacucuuuggcgccaucgccggguucauugagggaggcuggaccgggaugguggacggaugguacggcuaucaucaccagaacgaacaaggcuccggguacgcugcggaucugaaaucuacacagaaugccaucgacgagaucaccaacaaggucaauagcgugauugagaaaaugaacacgcaguuuacagcuguuggaaaggaguucaaucaccuugagaagagaaucgaaaaccugaauaaaaagguggaugacggcuuccucgauauuuggaccuacaacgccgagcugcugguccuccuggaaaaugagcggacccuugacuaucaugauuccaacgugaaaaaccuguacgagaagguccgcagccagcucaaaaauaacgccaaggaaaucgggaauggauguuuugaguucuaucacaagugcgacaacacauguauggaaucugugaaaaauggcaccuacgauuauccuaaguacuccgaggaagcuaaacugaacagagaggagauugacgggguuaaacuugaaagcacacggaucuaucaaauccuggccauuuacucuacgguggcguccagccucguccuggugguuucccugggcgcuaucucuuuuuggaugugcagcaauggaucccuccagugccgcauuuguaucuga

SEQ ID NO: 188239 - RNA, 1701 nt, Artificial Sequence; identical to SEQ ID NO: 186857
  derived and/or modified sequence opt5 from hemagglutinin__InfluenzaA__ADJ81033

SEQ ID NO: 188240 - RNA, 1701 nt, Artificial Sequence; identical to SEQ ID NO: 185693
  derived and/or modified sequence opt5 from hemagglutinin__InfluenzaA__ADJ81043

SEQ ID NO: 188241 - RNA, 1701 nt, Artificial Sequence
  derived and/or modified sequence opt5 from hemagglutinin__InfluenzaA__ADJ81053
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaaaaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacaagauuacgaauaaagucaacuccgugaucgagaagaugaauacacaguuuaccgccguuggaaaggaguucaaccaccuugagaaaagaauugagaaucugaacaagaaaguggaugacggcuuccucgauaucuggaccuacaaugcugaacugcugguccuccuggagaacgaacggacacuugacuaucaugauagcaaugugaagaaccuguacgagaaaguccgcucucagcucaagaacaaugccaaggagauugggaacggauguuuugaguucuaucacaaaugcgacaauaccuguauggaauccgugaagaacggcacauacgauuauccuaaauacagcgaagaggccaagcugaauagagaagagaucgacgggguuaaacuugagucuacgcggaucuaucaaauucuggcuaucuacuccaccguggccagcucccucguccuggugguuucucugggcgcgauuagcuuuuggaugugcuccaacggaucucuccagugccgcaucuguauuuga

SEQ ID NO: 188242 - RNA, 1701 nt, Artificial Sequence; identical to SEQ ID NO: 186857
  derived and/or modified sequence opt5 from hemagglutinin__InfluenzaA__ADJ81063

SEQ ID NO: 188243 - RNA, 1701 nt, Artificial Sequence; identical to SEQ ID NO: 186637
  derived and/or modified sequence opt5 from hemagglutinin__InfluenzaA__ADJ84772

SEQ ID NO: 188244 - RNA, 1701 nt, Artificial Sequence
  derived and/or modified sequence opt5 from hemagglutinin__InfluenzaA__ADJ88782
augaagaccaucauugcccugagcuacaugcucugccugguguucgcucagaaacuucccggcaacgacaauuccacagccacgcugugucucgggcaccaugcggucccuaacggaaccaucguuaagacaauuaccaaugaucaaaucgaggugacaaacgcuaccgaacuggugcagucuagcuccacaggcgagauuugcgacucuccgcaccagauccuugauggggaaaauuguacccugaucgacgcccuccugggagauccccagugcgacggcuuucaaaacaaaaagugggaucuguucgucgagagaagcaaagccuauuccaauuguuacccuuaugacgugcccgauuacgcuucucuccggagccugauugccuccagcgggacgcuugaauuuaacaaugagucuuucaacuggaccggaguuacacagaauggcaccuccagcgcuugcauccgcagaucuaacaauuccuuuuucagccggcugaacuggcucacacaucugaaguuuaaguauccugcccuuaaugugaccaugcccaacaacgagcaguucgacaaacuguacauuuggggcguccaccauccugggacggauaaugaccagaucuuucucuaugcgcaagccucuggacgcauuacaguguccaccaagagaagccagcagacaguuaucccgaacauuggcucccggccccgcgugagaaauaucccuucucggaucagcauuuacuggaccaucgucaaacccggggauauucugcugaucaacuccaccggaaaucucauugcuccucgcggcuacuucaagaucagaagcgggaaaucuuccaucaugcggagcgacgcccccauuggaaaguguaacucugaaugcaucacaccgaauggcagcauuccuaacgacaagcccuuucagaaugugaaccgcaucacguauggcgcuuguccuagauacgugaaacaaaauacccugaaacuugccacagggaugcggaacguccccgagaagcagacccgcggaauuuucggcgcgaucgccggguuuaucgaaaauggaugggagggcaugguugaugggugguauggauucagacaccagaacuccgagggccggggccaagcugccgaccugaagucuacacaggcugccauugaucagaucaaugggaaacucaacagacugauuggaaagaccaacgaaaaauuccaccagaucgagaaggaauuuagcgagguggaaggccgcauucaagaccuugagaaguacguggaggauacgaaaaucgaccugugguccuauaaugccgaacuccuggucgcucuggagaaccagcauacaauugaucucaccgacagcgaaaugaauaagcuguucgagaaaaccaagaaacagcuuggggaaaacgcggaggauaugggaaauggcugcuuuaagaucuaccacaagugugacaacgccugcaucgggucuauucggaauggcacauaugaucaugacguguacagagacgaggcucugaacaaucgcuuccagaucaaaggaguugaacucaaguccggcuacaaagauuggauucuguggaucagcuuugccauuucuugcuuccuucuguguguggcccuccugggguuuaucaugugggcuugccaaaagggaaacauccgguguaauauuugcaucuga

SEQ ID NO: 188245 - RNA, 1701 nt, Artificial Sequence
  derived and/or modified sequence opt5 from hemagglutinin__InfluenzaA__ADK21733
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucuacagaucaacagagccucuaccagaacgccgacgcuuacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccgcucaugacugcaauaccaccugucaaacaccuaaaggcgccaucaacacgagccuccccuuccagaauauucacccgaucaccauuggcaagugcccuaaguaugucaaaucuacaaagcugagacuugcuaccgggcugcggaacgugcccagcauccagucccgcggacucuuuggcgccauugccggguucaucgagggaggcuggacagggaugguugacggaugguacggcuaucaucaccagaaugaacaaggcucuggguacgcugcggaucugaaaagcacccagaacgccaucgacaagauuacgaauaaagugaacuccgucaucgagaagaugaauacacaguuuaccgcugugggaaaggaguucaaccaccuugagaaaagaauugagaaucugaacaagaaaguugaugacggcuuccucgauaucuggaccuacaaugccgaacugcuggugcuccuggagaacgaacggacacuugacuaucaugauagcaaugucaagaaccuguacgagaaagugcgcucucagcucaagaacaaugccaaggagauugggaacggauguuuugaguucuaucacaaaugcgacaauaccuguauggaauccgucaagaacggcacauacgauuauccuaaauacagcgaagaggcuaagcugaauagagaagagaucgacggggugaaacuugagucuacgcggaucuaucaaauucuggccaucuacuccaccguugcgagcucccucgugcuggucgugucucugggcgcuauuagcuuuuggaugugcuccaacggaucucuccagugccgcaucuguauuuga

SEQ ID NO: 188246 - RNA, 1701 nt, Artificial Sequence
  derived and/or modified sequence opt5 from hemagglutinin__InfluenzaA__ADK21743
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaauccuuuuauaagaaucugaucuggcucguuaaaaagggcaacucuuacccuaaaauuuccaauagcuauaucaacgacaaggggaaggaagugcugguccuuuggggcauucaccaccccuccaccucugccgaucaacagagccuguaccagaaugcugacgccuacguguucgugggaacauccagauauagcaaaaaguuuaaaccugagaucgcuauucggccgaagguccgcgaucaggaggggagaaugaacuacuauuggacccucguugaacccggagacaaaaucacguucgaggccacaggcaaccugguggugccucgguacgcguuugccauggaacgcaaugcugggucuggaauuaucaucuccgauacccccgcccaugacugcaacacaaccugucaaaccccuaagggcgcuauuaauacaagccugcccuuccagaacauccacccgauuacgaucggcaaaugcccuaaguaugucaagucuaccaaacucagacuggccacagggcuucggaaugugcccagcauucagucccgcggacuguuuggcgccaucgcuggguucaucgagggaggcuggaccgggaugguugacggaugguacggcuaucaucaccagaacgaacaaggcucuggguacgcggccgaucucaagagcacacagaaugcuauugacgagaucaccaacaaagugaauagcgucauugagaagaugaacacgcaguuuacagccgugggaaaagaguucaaucaccuggagaagagaaucgaaaaccuuaauaagaaaguugaugacggcuuccuggauauuuggaccuacaacgccgagcuccuggugcugcucgaaaaugagcggacccuggacuaucaugauagcaacgucaagaaccuuuacgagaaagugcgcucucagcugaagaauaacgcuaaagaaaucgggaauggauguuuugaguucuaucacaagugcgacaacacauguauggaauccgucaagaauggcaccuacgauuauccuaaauacagcgaggaagccaagcucaacagagaggagaucgacggggugaaacuggaaucuacacggauuuaucaaauccuugcgauuuacuccacgguugcuagcucccuggugcucgucgugucucugggcgccaucagcuuuuggaugugcuccaauggaucucugcagugccgcauuuguaucuga

SEQ ID NO: 188247 - RNA, 1701 nt, Artificial Sequence
  derived and/or modified sequence opt5 from hemagglutinin__InfluenzaA__ADK21753
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaagggaacgcuggaucuggcaucauuaucuccgauacccccguccaugacugcaauacaaccugucaaaccccuaaaggcgccaucaacacaagccuccccuuccagaauauucacccgaucacgauugggaagugcccuaaguaugugaaaucuaccaagcugcgccuugcuacaggacugagaaacguucccagcauccagucccggggccucuuuggggccauugccggauucaucgagggcggguggaccggaaugguggacggcugguacggcuaucaucaccagaaugaacaagggucuggauacgcugcggaucugaaaagcacacagaacgccaucgacaagauuaccaauaaagucaacuccgugaucgagaagaugaauacgcaguuuacagcuguuggcaaggaguucaaccaccuugaaaaacgcauugagaaucugaacaagaaaguggaugacggguuccucgauaucuggaccuacaaugccgaacugcugguccuccuggagaacgaaagaacccuugacuaucaugauagcaaugugaagaaccuguacgagaaaguccggucucagcucaagaacaaugccaaggagauuggaaacggcuguuuugaguucuaucacaaaugcgacaauacauguauggaguccgugaagaacgggaccuacgauuauccuaaauacagcgaagaggcuaagcugaaucgcgaagagaucgacggcguuaaacuugagucuacaagaaucuaucaaauucuggccaucuacuccacgguggcgagcucccucguccuggugguuucucugggagcuauuagcuuuuggaugugcuccaacggcucucuccagugccggaucuguauuuga

SEQ ID NO: 188248 - RNA, 1701 nt, Artificial Sequence
  derived and/or modified sequence opt5 from hemagglutinin__InfluenzaA__ADK21763
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccaaguauagcaaaaaguuuaaaccugagauugcuaucagaccgaagguccgggaucaggaggggcgcaugaauuacuauuggacccugguugaacccggagacaaaauuacguucgaggccacaggcaaccugguggugccuagauacgcguuugccauggaacggaacgcugggucuggaaucauuaucuccgauacccccguccaugacugcaauacaaccugucaaaccccuaagggcgccaucaacacaagccuccccuuccagaauauucacccgaucacgauuggcaagugcccuaaauaugugaagucuaccaaacugcgccuugcuacagggcugagaaacguucccagcauccagucccggggacucuuuggcgccauugccggguucaucgagggaggcuggaccgggaugguggacggaugguacggcuaucaucaccagaaugaacaaggcucuggguacgcugcggaucuuaagagcacacagaacgccaucgacgagauuaccaauaaagucaacuccgugaucgagaagaugaauacgcaguuuacagcuguuggaaaggaguucaaccaccuggagaaacgcauugaaaaucugaacaagaaaguggaugacggcuuccucgauaucuggaccuacaaugccgagcugcugguccuccuggaaaacgagagaacccuugacuaucaugauagcaaugugaagaaccuguacgagaaaguccggucucagcucaagaacaaugccaaggaaauugggaacggauguuuugaguucuaucacaaaugcgacaauacauguauggaauccgugaagaacggcaccuacgauuauccuaaauacagcgaggaagcuaagcugaaucgcgaggagaucgacgggguuaaacuugaaucuacaagaaucuaucaaauucuggccaucuacuccacgguggcgagcucccucguccuggugguuucucugggcgcuauuagcuuuuggaugugcuccaacggaucucuccagugccggaucuguauuuga

SEQ ID NO: 188249 - RNA, 1701 nt, Artificial Sequence; identical to SEQ ID NO: 186857
  derived and/or modified sequence opt5 from hemagglutinin__InfluenzaA__ADK21773

SEQ ID NO: 188250 - RNA, 1701 nt, Artificial Sequence; identical to SEQ ID NO: 186857
  derived and/or modified sequence opt5 from hemagglutinin__InfluenzaA__ADK21783

SEQ ID NO: 188251 - RNA, 1701 nt, Artificial Sequence; identical to SEQ ID NO: 185693
  derived and/or modified sequence opt5 from hemagglutinin__InfluenzaA__ADK21813

SEQ ID NO: 188252 - RNA, 1701 nt, Artificial Sequence; identical to SEQ ID NO: 187113
  derived and/or modified sequence opt5 from hemagglutinin__InfluenzaA__ADK21823

SEQ ID NO: 188253 - RNA, 1701 nt, Artificial Sequence
  derived and/or modified sequence opt5 from hemagglutinin__InfluenzaA__ADK21833
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccgucagagacugcaauacaaccugucaaaccccuaaaggcgccaucaacacaagccuccccuuccagaauauucauccgaucacgauuggcaagugcccuaaguaugugaaaucuaccaagcugcggcuugcuacagggcugcgcaacguucccagcauccaguccagaggacucuuuggcgccauugccggguucaucgagggaggcuggaccgggaugguggacggaugguacggcuaucaccaucagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagcggauugaaaaucugaacaaaaagguggaugacggcuuccucgauaucuggaccuacaaugccgagcugcugguccuccuggaaaacgagcgcacccuugacuaucacgauagcaaugugaaaaaccuguacgagaaggucagaucucagcucaaaaacaaugccaaggaaauugggaacggauguuuugaguucuaucauaagugcgacaauacauguauggaauccgugaaaaacggcaccuacgauuauccuaaguacagcgaggaagcuaaacugaaucgggaggagaucgacgggguuaaacuugaaucuacacgcaucuaucaaauucuggccaucuacuccacgguggcgagcucccucguccuggugguuucucugggcgcuauuagcuuuuggaugugcuccaacggaucucuccagugcagaaucuguauuuga

SEQ ID NO: 188254 - RNA, 1701 nt, Artificial Sequence; identical to SEQ ID NO: 186857
  derived and/or modified sequence opt5 from hemagglutinin__InfluenzaA__ADK21843

SEQ ID NO: 188255 - RNA, 1701 nt, Artificial Sequence; identical to SEQ ID NO: 186046
  derived and/or modified sequence opt5 from hemagglutinin__InfluenzaA__ADK21853

SEQ ID NO: 188256 - RNA, 1701 nt, Artificial Sequence; identical to SEQ ID NO: 187342
  derived and/or modified sequence opt5 from hemagglutinin__InfluenzaA__ADK21863

SEQ ID NO: 188257 - RNA, 1701 nt, Artificial Sequence; identical to SEQ ID NO: 186140
  derived and/or modified sequence opt5 from hemagglutinin__InfluenzaA__ADK21873

SEQ ID NO: 188258 - RNA, 1701 nt, Artificial Sequence
  derived and/or modified sequence opt5 from hemagglutinin__InfluenzaA__ADK21883
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccuaaauacgcguuugccauggaacggaacgcugggucuggaaucauuaucuccgauacccccguccaugacugcaauacaaccugucaaaccccuaagggcgccaucaacacaagccuccccuuccagaauauucacccgaucacgauuggcaagugcccuaaauaugugaagucuaccaaacugcgccuugcuacagggcugagaaacauccccagcauucagucccggggacucuuuggcgccaucgccggguucaucgagggaggcuggaccgggaugguugacggaugguacggcuaucaucaccagaaugaacaaggcucuggguacgcugcggaucuuaagagcacacagaacgccauugacgagaucaccaauaaagugaacuccgucauugagaagaugaauacgcaguuuacagcugugggaaaggaguucaaccaccuggagaaacgcaucgaaaaucugaacaagaaaguugaugacggcuuccucgauauuuggaccuacaaugccgagcugcuggugcuccuggaaaacgagagaacccuugacuaucaugauagcaaugucaagaaccuguacgagaaagugcggucucagcucaagaacaaugccaaggaaaucgggaacggauguuuugaguucuaucacaaaugcgacaauacauguauggaauccgucaagaacggcaccuacgauuauccuaaauacagcgaggaagcuaagcugaaucgcgaggagaucgacggggugaaacuugaaucuacaagaauuuaucaaauccuggccauuuacuccacgguugcgagcucccucgugcuggucgugucucugggcgcuaucagcuuuuggaugugcuccaacggaucucuccagugccggauuuguaucuga

SEQ ID NO: 188259 - RNA, 1701 nt, Artificial Sequence; identical to SEQ ID NO: 185693
  derived and/or modified sequence opt5 from hemagglutinin__InfluenzaA__ADK21893

SEQ ID NO: 188260 - RNA, 1701 nt, Artificial Sequence; identical to SEQ ID NO: 187290
  derived and/or modified sequence opt5 from hemagglutinin__InfluenzaA__ADK21903

SEQ ID NO: 188261 - RNA, 1701 nt, Artificial Sequence; identical to SEQ ID NO: 187403
  derived and/or modified sequence opt5 from hemagglutinin__InfluenzaA__ADK21913

SEQ ID NO: 188262 - RNA, 1701 nt, Artificial Sequence
  derived and/or modified sequence opt5 from hemagglutinin__InfluenzaA__ADK21923
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggaacauccagauauagcaagaaauuuaagccugagaucgcuauucggccgaaaguccgcgaucaggaggggagaaugaauuacuauuggacccucguugaacccggagacaagaucacguucgaggccacaggcaaccugguggugccucgguacgcguuugccauggaacgcaacgcugggucuggaauuaucaucuccgauacccccguccaugacugcaauacaaccugucaaaccccuaaaggcgccauuaacacaagccugcccuuccagaauauccacccgauuacgaucggcaagugcccuaaguaugugaaaucuaccaagcucagacuggcuacagggcuucggaacguucccagcauucagucccgcggacuguuuggcgccaucgccggguucaucgagggaggcuggaccgggaugguggacggaugguacggcuaucaucaccagaaugaacaaggcucuggguacgcugcggaucucaaaagcacacagaacgccauugacgagaucaccaauaaggucaacuccgugauugagaaaaugaauacgcaguuuacagcuguuggaaaggaguucaaccaccuggagaagagaaucgaaaaucuuaacaaaaagguggaugacggcuuccuggauauuuggaccuacaaugccgagcuccugguccugcucgaaaacgagcggacccuggacuaucaugauagcaaugugaaaaaccuuuacgagaaggcccgcucucagcugaaaaacaaugcuaaggaaaucgggaacggauguuuugaguucuaucacaagugcgacaauacauguauggaauccgucaaaaacggcaccuacgauuauccuaaguacagcgaggaagccaaacucaauagagagaagaucgacggggugaaacuggagucuacacggauuuaucaaauccuugcgauuuacuccacgguugcuagcacccuggugcucgucgugucccugggcgccaucucuuuuuggaugugcagcaacggaucccugcagugccgcauuuguaucuga

SEQ ID NO: 188263 - RNA, 1701 nt, Artificial Sequence
  derived and/or modified sequence opt5 from hemagglutinin__InfluenzaA__ADK21933
augaaggccauccuggugguccuccuguacaccuucgcuacagccaacgcggacacgcuuugcauuggcuaucacgcuaauaacagcaccgauacaguugacaccgugcuggagaagaaugugacagucacccauuccguggaucuccuggaagacaagcacaacgggaaacuuuguaagcugagaggaguugcuccccuccaucugggcaaaugcaauaucgccggguggauucugggaaacccugagugugaaucucucagcacagccuccucuuggagcuacaucguggagaccuccucuagcgauaauggcacgugcuauccgggggacuuuauugauuacgaagaacugcgggagcagcuuuccagcgucucuuccuucgaacgcuuugagaucuuccccaagaccagcucuuggccuaaccacgacuccaauaagggagugacagccgcuugucccaacgccggcgcgaaaucuuuuuauaagaaucugaucuggcucguuaaaaagggcaacagcuacccuaaacuguccaagagcuauauuaaugauaaggggaaagaagugcuuguccuguggggaauccaucaccccuccaccucugccgaccaacagagccucuaccagaacgcugaugccuacguguucgugggcacauccagauauagcaagaaauuuaagccugagauugcuauccggccgaaaguccgcgaccaggaggggagaaugaauuacuauuggacccugguugaacccggagauaagauuacguucgaggccacaggcaaccugguggugccucgguacgcguuugccauggaacgcaacgcugggucuggaaucauuaucuccgacacccccguccacgacugcaauacaaccugucaaaccccuaaaggcgccaucaacacaagccuccccuuccagaauauucauccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggauggaugguacggcuaucaccaucagaaugaacaaggcucuggguacgcugcggaccugaaaagcacacagaacgccaucgaugagauuaccaauaaggucaacuccgugaucgagaaaaugaauacgcaguuuacagcuguuggaaaggaguucaaccaccuugagaagagaauugaaaaucugaacaaaaagguggacgauggcuuccucgacaucuggaccuacaaugccgagcugcugguccuccuggaaaacgagcggacccuugauuaucacgacagcaaugugaaaaaccuguacgagaagguccgcucucagcucaaaaacaaugccaaggaaauugggaacggauguuuugaguucuaucauaagugcgauaauacauguauggaauccgugaaaaacggcaccuacgacuauccuaaguacagcgaggaagcuaaacugaauagagaggagaucgaugggguuaaacuugaaucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 188264 - RNA, 1701 nt, Artificial Sequence; identical to SEQ ID NO: 185693
  derived and/or modified sequence opt5 from hemagglutinin__InfluenzaA__ADK21943

SEQ ID NO: 188265 - RNA, 1701 nt, Artificial Sequence
  derived and/or modified sequence opt5 from hemagglutinin__InfluenzaA__ADK21953
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugaccacgaggagcugcgggagcagcuuuccagcgucucuuccuucgaacgcuuugagaucuuccccaagaccagcucuuggccuaaucaugauuccaacaagggagugacagccgcuuguccccacgccggcgcgaaaucuuuuuacaagaaucugaucuggcucguuaaaaagggcaacagcuauccuaaacuguccaagagcuacauuaaugacaaggggaaagaagugcuuguccugugggccauccaccaucccuccaccucugcugaucaacagagccucuaucagaacgccgacgcuuacguguucgugggaacauccagauacagcaagaaauuuaagccugagauugccauccggccgaaaguccgcgaucaggagggcagaaugaauuauuacuggacccugguugaacccggggacaagauuacguucgaggcgacaggaaaccugguggugccucgguaugccuuugcuauggaacgcaacgccggcucugggaucauuaucuccgauacccccguccacgacugcaauacaaccugucaaaccccuaaaggagcuaucaacacaagccuccccuuccagaauauucauccgaucacgauuggcaagugcccuaaguacgugaaaucuaccaagcugagacuugccacaggccugcggaacguucccagcauccagucccgcgggcucuuuggagccauugcuggcuucaucgaagggggauggaccggcaugguggacgggugguauggauaccaccaccagaaugaacaaggcucuggcuaugcggccgaucugaaaagcacacagaacgcuaucgacgagauuaccaauaaggucaacuccgugaucgagaaaaugaauacgcaguuuacagccguugggaaggaguucaaccaucuugaaaagagaauugaaaaucugaacaaaaagguggaugacggauuccucgauaucuggaccuacaaugccgagcugcugguccuccuggaaaacgagcggacccuugacuaccacgauagcaaugugaaaaaccuguaugagaagguccgcucucagcucaaaaacaaugcuaaggaaauuggcaacggguguuuugaguucuaccauaagugcgacaauacauguauggaauccgugaaaaacggaaccuaugauuacccuaaguauagcgaggaagccaaacugaauagagaggagaucgacggcguuaaacuugaaucuacacggaucuaccaaauucuggcgaucuauuccacgguggcuagcucccucguccuggugguuucucugggggccauuagcuuuuggaugugcuccaacggcucucuccagugccgcaucuguauuuga

SEQ ID NO: 188266 - RNA, 1701 nt, Artificial Sequence; identical to SEQ ID NO: 187880
  derived and/or modified sequence opt5 from hemagglutinin__InfluenzaA__ADK32390

SEQ ID NO: 188267 - RNA, 1701 nt, Artificial Sequence; identical to SEQ ID NO: 187880
  derived and/or modified sequence opt5 from hemagglutinin__InfluenzaA__ADK32400

SEQ ID NO: 188268 - RNA, 1701 nt, Artificial Sequence
  derived and/or modified sequence opt5 from hemagglutinin__InfluenzaA__ADK32420
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccagaauauucacucuaucacgauuggcaagugcccgaaguaugugaaaagcaccaagcugagacuugcuacagggcugcggaacguuccuuccauccagucucgcggacucuuuggcgccauugccggguucaucgaaggaggcuggaccgggaugguggacggaugguacggcuaucaucaccagaaugagcaaggcagcggguacgcugcggaccugaaauccacacagaacgccaucgaugagauuaccaauaaggucaacagcgugaucgaaaagaugaauacgcaguuuacagcuguuggaaaggaguucaaccaccuugaaaagagaauugagaaucugaacaaaaagguggacgauggcuuccucgacaucuggaccuacaaugccgaacugcugguccuccuggagaacgagcggacccuugauuaucaugacucuaaugugaaaaaccuguacgaaaagguccgcaaccagcucaaaaauaacgccaaggagauugggaauggauguuuugaguucuaucacaagugcgauaacacauguauggaguccgugaaaaauggcaccuacgacuaucccaaguacagcgaagaggcuaaacugaacagagaggaaaucgaugggguuaaacuugagucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 188269 - RNA, 1701 nt, Artificial Sequence; identical to SEQ ID NO: 187245
  derived and/or modified sequence opt5 from hemagglutinin__InfluenzaA__ADK32430

SEQ ID NO: 188270 - RNA, 1701 nt, Artificial Sequence
  derived and/or modified sequence opt5 from hemagglutinin__InfluenzaA__ADK32440
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacggaauuaccaauaaggucaacuccgugaucgagaaaaugaauacgcaguuuacagcuguuggcaaggaguucaaccaccuugaaaagagaauugagaaucugaacaaaaagguggaugacggguuccucgauaucuggaccuacaaugccgaacugcugguccuccuggagaacgaacggacccuugacuaucaugauagcaaugugaaaaaccuguacgagaagguccgcucucagcucaaaaacaaugccaaggagauuggaaacggcuguuuugaguucuaucacaagugcgacaauacauguauggaguccgugaaaaacgggaccuacgauuauccuaaguacagcgaagaggcuaaacugaauagagaagagaucgacggcguuaaacuugagucuacacggaucuaucaaauucuggccaucuacuccacgguggcgagcucccucguccuggugguuucucugggagcuauuagcuuuuggaugugcuccaacggcucucuccagugccgcaucuguauuuga

SEQ ID NO: 188271 - RNA, 1701 nt, Artificial Sequence
  derived and/or modified sequence opt5 from hemagglutinin__InfluenzaA__ADK32450
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggauccagcagauauucuaagaaauuuaagccugagaucgcuauucggccgaaaguccgcgaucaggaggggagaaugaauuacuauuggacacucguugaacccggagacaagaucaccuucgaggccacgggcaaccugguggugccucgguacgcguuugccauggaacgcaacgcuggguccggaauuaucaucagcgaugcccccguccaugacugcaauacaaccugucaaacaccuaaaggcgcuauuaacaccucucugcccuuccagaauauccacccgauuaccaucggcaagugcccuaaguaugugaaaagcacaaagcucagacuggccacggggcuucggaacguucccuccauucagucucgcggacuguuuggcgccaucgcuggguucaucgagggaggcuggaccgggaugguggacggaugguacggcuaucaucaccagaaugaacaaggcagcggguacgcggccgaucucaaauccacacagaacgcuauugacgagaucaccaauaaggucaacagcgugauugagaaaaugaauacacaguuuaccgccguuggaaaggaguucaaccaccuggagaagagaaucgaaaaucuuaacaaaaagguggaugacggcuuccuggauauuuggacguacaaugccgagcuccugguccugcucgaaaacgagcggacacuggacuaucaugauucuaaugugaaaaaccuuuacgagaagguccgcucccagcugaaaaacaaugcuaaggaaguggggaacggauguuuugaguucuaucacaagugcgacaauaccuguauggaaagcguuaaaaacggcaccuacgauuauccuaaguacucugaggaagccaaacucaauagagaggagaucgacggggugaagcuggaauccacacggaucuaucaaauucuugcgaucuacagcaccgcugccuccucucugguccucgugguuagccugggcgccauuuccuuuuggaugugcucuaacggaagccugcagugccgcaucuguauuuga

SEQ ID NO: 188272 - RNA, 1701 nt, Artificial Sequence
  derived and/or modified sequence opt5 from hemagglutinin__InfluenzaA__ADK32460
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacgcuuucgugggcacauccagauauagcaagaaauuuaagccugagauugccauccggccgaaagugcgcgaucaggaggggagaaugaauuacuauuggacccuggucgaacccggagacaagauuacguucgaggcgacaggcaaccugguugugccucgguacgccuuugcuauggaacgcaacgccgggucuggaaucauuaucuccgauacccccgugcaugacugcaauacaaccugucaaaccccuaaaggcgcuaucaacacaagccuccccuuccagaauauucacccgaucacgauuggcaagugcccuaaguaugucaaaucuaccaagcugagacuugccacagggcugcggaacgugcccagcauccagucccgcggacucuuuggcgccauugcuggguucaucgagggaggcuggaccgggaugguugacggaugguacggcuaucaucaccagaaugaacaaggcucuggguacgcggccgaucugaaaagcacacagaacgcuaucgacgagauuaccaauaaggugaacuccgucaucgagaaaaugaauacgcaguuuacagccgugggaaaggaguucaaccaccuugagaagagaauugaaaaucugaacaaaaagguugaugacggcuuccucgauaucuggaccuacaaugccgagcugcuggugcuccuggaaaacgagcggacccuugacuaucaugauagcaaugucaaaaaccuguacgagaaggugcgcucucagcucaaaaacaaugcuaaggaaauugggaacggauguuuugaguucuaucacaagugcgacaauacauguauggaauccgucaaaaacggcaccuacgauuauccuaaguacagcgaggaagccaaacugaauagagaggagaucgacggggugaaacuugaaucuacacggaucuaucaaauucuggcgaucuacuccacgguugcuagcucccucgugcuggucgugucucugggcgccauuagcuuuuggaugugcuccaacggaucucuccagugccgcaucuguauuuga

SEQ ID NO: 188273 - RNA, 1701 nt, Artificial Sequence; identical to SEQ ID NO: 186857
  derived and/or modified sequence opt5 from hemagglutinin__InfluenzaA__ADK32470

SEQ ID NO: 188274 - RNA, 1701 nt, Artificial Sequence
  derived and/or modified sequence opt5 from hemagglutinin__InfluenzaA__ADK32480
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccgcccaugacugcaauacaaccugucaaaccccuaaaggcgcuaucaacacaagccuccccuuccagaauauucacccgaucacgauuggcaagugcccuaaguaugucaaaucuaccaagcugagacuugccacagggcugcggaacgugcccagcauccagucccgcggacucuuuggcgccauugcuggguucaucgagggaggcuggaccgggaugguugacggaugguacggcuaucaucaccagaaugaacaaggcucuggguacgcggccgaucugaaaagcacacagaacgcuaucgacaagauuaccaauaaagugaacuccgucaucgagaagaugaauacgcaguuuacagccgugggaaaggaguucaaccaccuugagaaaagaauugagaaucugaacaagaaaguugaugacggcuuccucgauaucuggaccuacaaugccgaacugcuggugcuccuggagaacgaacggacccuugacuaucaugauagcaaugucaagaaccuguacgagaaagugcgcucucagcucaagaacaaugcuaaggagauugggaacggauguuuugaguucuaucacaaaugcgacaauacauguauggaauccgucaagaacggcaccuacgauuauccuaaauacagcgaagaggccaagcugaauagagaagagaucgacggggugaaacuugagucuacacggaucuaucaaauucuggcgaucuacuccacgguugcuagcucccucgugcuggucgugucucugggcgccauuagcuuuuggaugugcuccaacggaucucuccagugccgcaucuguauuuga

SEQ ID NO: 188275 - RNA, 1701 nt, Artificial Sequence; identical to SEQ ID NO: 186857
  derived and/or modified sequence opt5 from hemagglutinin__InfluenzaA__ADK32490

SEQ ID NO: 188276 - RNA, 1701 nt, Artificial Sequence; identical to SEQ ID NO: 186857
  derived and/or modified sequence opt5 from hemagglutinin__InfluenzaA__ADK32502

SEQ ID NO: 188277 - RNA, 1701 nt, Artificial Sequence; identical to SEQ ID NO: 187329
  derived and/or modified sequence opt5 from hemagglutinin__InfluenzaA__ADK32637

SEQ ID NO: 188278 - RNA, 1701 nt, Artificial Sequence; identical to SEQ ID NO: 186857
  derived and/or modified sequence opt5 from hemagglutinin__InfluenzaA__ADK32647

SEQ ID NO: 188279 - RNA, 1701 nt, Artificial Sequence; identical to SEQ ID NO: 187021
  derived and/or modified sequence opt5 from hemagglutinin__InfluenzaA__ADK32657

SEQ ID NO: 188280 - RNA, 1701 nt, Artificial Sequence; identical to SEQ ID NO: 187245
  derived and/or modified sequence opt5 from hemagglutinin__InfluenzaA__ADK32677

SEQ ID NO: 188281 - RNA, 1701 nt, Artificial Sequence
  derived and/or modified sequence opt5 from hemagglutinin__InfluenzaA__ADK32687
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaaauuuuuauaagaaccugaucuggcucguuaaaaagggcaauagcuacccuaaacugucuaaguccuauauuaacgacaaggggaaagaagugcuuguccuguggggaauccaccaccccagcaccuccgccgaucaacagucucucuaccagaaugcugacgccuacguguucgugggcacaagcagauauuccaagaaauuuaagccugagauugcuauccggccgaaaguccgcgaucaggaggggagaaugaacuacuauuggacccugguugaacccggagacaagauuacguucgaggccacaggcaaccugguggugccucgguacgcguuugccauggaacgcaaugcugggagcggaaucauuaucucugauacccccguccaugacugcaacacaaccugucaaaccccuaaaggcgccaucaauacaucccuccccuuccagaacauucacccgaucacgauuggcaagugcccuaaguaugugaaaagcaccaagcugagacuugcuacagggcugcggaauguucccucuauccagagccgcggacucuuuggcgccauugccggguucaucgagggaggcuggaccgggaugguggacggaugguacggcuaucaucaccagaacgaacaaggcuccggguacgcugcggaucugaaaucuacacagaaugccaucgacaagauuaccaacaaagucaauagcgugaucgagaagaugaacacgcaguuuacagcuguuggaaaggaguucaaucaccuugagaaaagaauugagaaccugaauaagaaaguggaugacggcuuccucgauaucuggaccuacaacgccgaacugcugguccuccuggagaaugaacggacccuugacuaucaugauuccaacgugaagaaccuguacgagaaaguccgcagccagcucaagaauaacgccaaggagauugggaauggauguuuugaguucuaucacaaaugcgacaacacauguauggaaucugugaagaauggcaccuacgauuauccuaaauacuccgaagaggcuaagcugaacagagaagagaucgacgggguuaaacuugagagcacacggaucuaucaaauucuggccaucuacucuacgguggcguccagccucguccuggugguuucccugggcgcuauuucuuuuuggaugugcagcaauggaucccuccagugccgcaucuguauuuga

SEQ ID NO: 188282 - RNA, 1701 nt, Artificial Sequence; identical to SEQ ID NO: 187484
  derived and/or modified sequence opt5 from hemagglutinin__InfluenzaA__ADK32697

SEQ ID NO: 188283 - RNA, 1701 nt, Artificial Sequence; identical to SEQ ID NO: 186857
  derived and/or modified sequence opt5 from hemagglutinin__InfluenzaA__ADK32776

SEQ ID NO: 188284 - RNA, 1701 nt, Artificial Sequence; identical to SEQ ID NO: 187245
  derived and/or modified sequence opt5 from hemagglutinin__InfluenzaA__ADK33621

SEQ ID NO: 188285 - RNA, 1701 nt, Artificial Sequence
  derived and/or modified sequence opt5 from hemagglutinin__InfluenzaA__ADK33631
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaaguuaagcacaaugggaaacuuuguaagcugagaggaguggcuccccuccaucugggcaaaugcaacaucgccggguggauucugggaaauccugagugugaaucucucagcacagccuccucuuggagcuacaucgucgagaccuccucuagcgauaacggcacgugcuauccgggggacuuuauuaauuacgaagaacugcgggagcagcuuuccagcgugucuuccuucgaacgcuuugagaucuuccccaagaccagcucuuggccuaaccacgauuccaauaagggaguuacagccgcuuguccccaugccggcgcgaaauccuuuuauaagaaccugaucuggcucgugaaaaagggcaauucuuacccuaaacuguccaagagcuauauuaacgacaaggggaaagaaguccuugugcuguggggaauccaccaccccuccaccucugccgaucaacagagccucuaccagaaugcugacgccuacguguucgucggcacauccagauauagcaagaaauuuaagccugagauugcuauccggccgaaaguucgcgaucaggaggggagaaugaacuacuauuggacccugguggaacccggagacaagauuacguucgaggccacaggcaaccugguggucccucgguacgcguuugccauggaacgcaaugcugggucuggaaucauuaucuccgauacccccgugcaugacugcaacacaaccugucaaaccccuaaaggcgccaucaauacaagccuccccuuccagaacauucacccgaucacgauuggcaagugcccuaaguauguuaaaucuaccaagcugagacuugcuacagggcugcggaaugugcccagcauccagucccgcggacucuuuggcgccauugccggguucaucgagggaggcuggaccgggauggucgauggaugguacggcuaucaucaccagaacgaacaaggcucuggguacgcugcggaccugaaaagcacacagaaugccaucgacaagauuaccaacaaagugaauagcguuaucgagaagaugaacacgcaguuuacagcugugggaaaggaguucaaucaccuugagaaaagaauugagaaccugaauaagaaagucgaugacggcuuccucgauaucuggaccuacaacgccgaacugcuggugcuccuggagaaugaacggacccuugacuaucaugauagcaacgucaagaaccuguacgagaaagugcgcucucagcucaagaauaacgccaaggagauugggaauggauguuuugaguucuaucacaaaugcgacaacacauguauggaauccguuaagaauggcaccuacgauuauccuaaauacagcgaagaggcuaagcugaacagagaagagaucgacggggugaaacuugagucuacacggaucuaucaaauucuggccaucuacuccacggucgcgagcucccucgugcugguugugucucugggcgcuauuagcuuuuggaugugcuccaauggaucucuccagugccgcaucuguauuuga

SEQ ID NO: 188286 - RNA, 1701 nt, Artificial Sequence; identical to SEQ ID NO: 187245
  derived and/or modified sequence opt5 from hemagglutinin__InfluenzaA__ADK33641

SEQ ID NO: 188287 - RNA, 1701 nt, Artificial Sequence; identical to SEQ ID NO: 186857
  derived and/or modified sequence opt5 from hemagglutinin__InfluenzaA__ADK33651

SEQ ID NO: 188288 - RNA, 1701 nt, Artificial Sequence; identical to SEQ ID NO: 186857
  derived and/or modified sequence opt5 from hemagglutinin__InfluenzaA__ADK33661

SEQ ID NO: 188289 - RNA, 1701 nt, Artificial Sequence; identical to SEQ ID NO: 186857
  derived and/or modified sequence opt5 from hemagglutinin__InfluenzaA__ADK33671

SEQ ID NO: 188290 - RNA, 1701 nt, Artificial Sequence
  derived and/or modified sequence opt5 from hemagglutinin__InfluenzaA__ADK33681
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaagcuguacgagaaaguccgcucucagcucaagaacaacgccaaggaaauugggaauggauguuuugaguucuaucacaaaugcgacaacacauguauggaauccgugaagaauggcaccuacgauuauccuaaauacagcgaggaagcuaagcugaacagagaggagaucgacgggguuaaacuugaaucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 188291 - RNA, 1701 nt, Artificial Sequence; identical to SEQ ID NO: 187306
  derived and/or modified sequence opt5 from hemagglutinin__InfluenzaA__ADK33691

SEQ ID NO: 188292 - RNA, 1701 nt, Artificial Sequence
  derived and/or modified sequence opt5 from hemagglutinin__InfluenzaA__ADK33701
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacaagauuaccaauaaagucaacuccgugaucgagaagaugaauacgcaguuuacagcuguuggaaaggaguucaaccaccuugagaaaagaauugagaaucugaacaagaaaguggaugacggcuuccucgauaucuggaccuacaaugccgaacugcugguccuccuggagaacgaacggacccuugacuaucaugauagcaaugugaagaaccuguacgagaaaguccgcucucagcucaagaacaaugccaaggagauugggaacggauguuuugaguucuaucacaaaugcgacaauacauguauggaauccgugaagaacggcaccuacgauuauccuaaauacagcgaagaggcuaagcugaauagagaagagaucgacgggguuaaacuugagucuacacggguguaucaaauccuggccauuuacuccacggucgcgagcucccucgugcugguugugucucugggcgcuaucagcuuuuggaugugcuccaacggaucucuccagugccgcauuuguaucuga

SEQ ID NO: 188293 - RNA, 1701 nt, Artificial Sequence
  derived and/or modified sequence opt5 from hemagglutinin__InfluenzaA__ADK33711
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaaauccuugugcuguggggcauucaccaccccuccaccucugccgaucaacagagccucuaccagaacgcugacgccuacgucuucgugggaacauccagauauagcaagaaauuuaagccugagaucgcuauucggccgaaagugcgcgaucaggaggggagaaugaauuacuauuggacccuggucgaacccggagacaagaucacguucgaggccacaggcaaccugguugugccucgguacgcguuugccauggaacgcaacgcugggucuggaauuaucaucuccgauacccccgugcaugacugcaauacaaccugucaaaccccuaaaggcgccauuaacacaagccuccccuuccagaauauccacccgauuacgaucggcaagugcccuaaguaugucaaaucuaccaagcugagacuugcuacagggcugcggaacauucccagcauccagucccgcggacucuuuggcgccaucgccggguucauugagggaggcuggaccgggaugguggacggaugguacggcuaucaucaccagaaugaacaaggcucuggguacgcugcggaucugaaaagcacacagaacgccaucgacgagauuaccaauaagguuaacuccgugaucgagaaaaugaauacgcaguuuacagcugucggaaaggaguucaaccaccuugagaagagaauugaaaaucugaacaaaaagguggaugacggcuuccucgauaucuggaccuacaaugccgagcugcugguucuccuggaaaacgagcggacccuugacuaucaugauagcaaugugaaaaaccuguacgagaagguccgcucucagcucaaaaacaaugccaaggaaaucgggaacggauguuuugaguucuaucacaagugcgacaauacauguauggaauccgugaaaaacggcaccuacgauuauccuaaguacagcgaggaagcuaaacugaauagagaggagauugacggggucaaacuugaaucuacacggaucuaucaaauucuggccaucuacuccacgguggcgagcucccucguucugguggucucucugggcgcuauuagcuuuuggaugugcuccaacggaucucuccagugccgcaucuguauuuga

SEQ ID NO: 188294 - RNA, 1701 nt, Artificial Sequence
  derived and/or modified sequence opt5 from hemagglutinin__InfluenzaA__ADK33721
augaaggccauccuggugguccuccuguacaccuucguuacagcuaacgccgacacgcuuugcauuggcuaucacgcgaauaacagcaccgauacaguggacaccgugcuggagaaaaaugucacagugacccauuccguuaaccuccuggaagauaagcacaaugggaaacuuuguaagcugagaggaguggcuccccuccaucugggcaaaugcaacaucgccggguggauucugggaaauccugagugugaaucucucagcacagccuccucuuggagcuacaucgucgagaccuccucuagcgacaacggcacgugcuauccgggggauuuuauugacuacgaagaacugcgggagcagcuuuccagcgugucuuccuucgaacgcuuugagaucuuccccaagaccagcucuuggccuaaucacgauuccaacaagggaguuacagcugccuguccccaugcuggcgccaagagcuuuuauaagaaucugaucuggcucgugaaaaagggcaacucuuacccuaaacuguccaagagcuauauuaaugacaaggggaaagaaguccuugugcuguggggaauccaccaccccuccaccucugcggaucaacagagccucuaccagaacgccgacgcuuacguguucgucggcacauccagauauagcaagaaauuuaagccugagauugccauccggccgaaaguucgcgaucaggaggggagaaugaauuacuauuggacccugguggaacccggagacaagauuacguucgaggcuacaggcaaccugguggucccucgguacgccuuugcgauggaacgcaacgccgggucuggaaucauuaucuccgauacccccgugcaugacugcaauacaaccugucaaaccccuaaaggcgcuaucaacacaagccuccccuuccagaauauucacccgaucacgauuggcaagugcccuaaguauguuaaaucuaccaagcugagacuugccacagggcugcggaacgugcccagcauccagucccgcggacucuuuggcgcuauugccggguucaucgagggaggcuggaccgggauggucgacggaugguacggcuaucaucaccagaaugaacaaggcucuggguacgccgcugaucugaaaagcacacagcacgcgaucgacgagauuaccaacaagguuaauuccgugaucgagaaaaugaacacgcaguuuacagccgugggaaaggaguucaaucaucuugagaagagaauugaaaaccugaauaaaaaggucgaugacggcuuccucgauaucuggaccuacaacgcugagcugcuggugcuccuggaaaaugagcggacccuugacuaucacgauagcaacgucaaaaaucuguacgagaaggugcgcucucagcucaaaaacaacgccaaggaaauugggaauggauguuuugaguucuaucauaagugcgacaacacauguauggaauccguuaaaaauggcaccuacgauuauccuaaguacagcgaggaagccaaacugaacagagaggagaucgacggggugaaacuugaaucuacacggaucuaucaaauucuggcuaucuacuccacggucgccagcucccucgugcugguugugucucugggcgcgauuagcuuuuggaugugcuccaauggaucucuccagugccgcaucuguauuuga

SEQ ID NO: 188295 - RNA, 1701 nt, Artificial Sequence
  derived and/or modified sequence opt5 from hemagglutinin__InfluenzaA__ADK33731
augaaggccacccuggugguccuccuguacacauucgcuacggccaacgcggacacccuuugcaucggcuaucacgcuaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacguccucuagcggcaacgggaccugcuauccgggagacuuuaucgauuacgaagaacugcgggagcagcuuuccagcgucucuuccuucgaacgcuuugagauuuuccccaagacaagcucuuggccuaaucacgacuccaacaagggcgugaccgccgcuuguccccaugccggcgcgaaaucuuuuuauaagaaucugaucuggcucguuaaaaaggggaacagcuacccuaaacuguccaagagcuauaucaaugauaagggaaaagaagugcuuguccuguggggcauucaccaccccuccacaucugccgaccaacagagccucuaccagaacgcugaugccuacgcuuucguggggaccuccagauauagcaagaaauuuaagccugagaucgccauucggccgaaagugcgcgaccaggagggaagaaugaauuacuauuggacgcuggucgaacccggcgauaagaucacauucgaggcgaccgggaaccugcucguuccucgguacgccuuugcuauggaacgcaacgccggaucuggcauuaucauuuccgacacacccgugcaugauugcaauaccaccugucaaacaccuaaaggcgcuaucaacacgagccugcccuuccagaauauccacccgauuaccaucgggaagugcccuaaguaugugaaaucuacaaaacuuagacuggccaccggacuccggaacguccccagcauucagucccgcggccuguuuggggccaucgcuggauucauugagggcggguggacaggaaugguggacggcugguacggcuaucaucaccagaaugaacaagggucuggauacgcggccgaccuuaagagcacccagaacgcuaucgaugagaucacgaauaagguuaacuccgugauugagaaaaugaauacacaguuuaccgccgucggcaaggaguucaaccaccuggagaagagaaucgaaaaucucaacaaaaagguggacgauggguuccuggacauuuggaccuacaaugccgagcugcucguucugcuugaaaacgagcggacacuggauuaucaugacagcaaugugaaaaaccucuacgagaagguccgcucucagcugaaaaacaaugcuaaggaaaucggaaacggcuguuuugaguucuaucacaagugcgauaauaccuguauggaauccgugaaaaacgggacauacgacuauccuaaguacagcgaggaagccaaacuuaauagagaggagauugauggcgucaagcuggaaucuacgcggaucuaucaaauccucgcgauuuacuccaccguggcuagcucccugguucugguggucucucucggagccaucagcuuuuggaugugcuccaacggcucucugcagugccgcauuuguaucuga

SEQ ID NO: 188296 - RNA, 1701 nt, Artificial Sequence; identical to SEQ ID NO: 187860
  derived and/or modified sequence opt5 from hemagglutinin__InfluenzaA__ADK33741

SEQ ID NO: 188297 - RNA, 1701 nt, Artificial Sequence; identical to SEQ ID NO: 185693
  derived and/or modified sequence opt5 from hemagglutinin__InfluenzaA__ADK33751

SEQ ID NO: 188298 - RNA, 1701 nt, Artificial Sequence
  derived and/or modified sequence opt5 from hemagglutinin__InfluenzaA__ADK33761
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagccuugcuacagggcugagaaacguucccuccauccagucucggggacucuuuggcgccauugccggguucaucgagggaggcuggaccgggaugguggacggaugguacggcuaucaucaccagaaugaacaaggcagcggguacgcugcggaucugaaauccacacagaacgccaucgacgagauuaccaauaaggucaacagcgugaucgagaaaaugaauacgcaguuuacagcuguuggaaaggaguucaaccaccuugagaagcgcauugaaaaucugaacaaaaagguggaugacggcuuccucgauaucuggaccuacaaugccgagcugcugguccuccuggaaaacgagagaacccuugacuaucaugauucuaaugugaaaaaccuguacgagaagguccggucccagcucaaaaacaaugccaaggaaauugggaacggauguuuugaguucuaucacaagugcgacaauacauguauggaaagcgugaaaaacggcaccuacgauuauccuaaguacucugaggaagcuaaacugaaucgcgaggagaucgacgggguuaaacuugaauccacaagaaucuaucaaauucuggccaucuacagcacgguggcguccucucucguccuggugguuagccugggcgcuauuuccuuuuggaugugcucuaacggaagccuccagugccggaucuguauuuga

SEQ ID NO: 188299 - RNA, 1701 nt, Artificial Sequence; identical to SEQ ID NO: 186857
  derived and/or modified sequence opt5 from hemagglutinin__InfluenzaA__ADK33771

SEQ ID NO: 188300 - RNA, 1701 nt, Artificial Sequence; identical to SEQ ID NO: 186857
  derived and/or modified sequence opt5 from hemagglutinin__InfluenzaA__ADK33781

SEQ ID NO: 188301 - RNA, 1701 nt, Artificial Sequence; identical to SEQ ID NO: 186794
  derived and/or modified sequence opt5 from hemagglutinin__InfluenzaA__ADK33791

SEQ ID NO: 188302 - RNA, 1701 nt, Artificial Sequence; identical to SEQ ID NO: 188292
  derived and/or modified sequence opt5 from hemagglutinin__InfluenzaA__ADK33801

SEQ ID NO: 188303 - RNA, 1701 nt, Artificial Sequence
  derived and/or modified sequence opt5 from hemagglutinin__InfluenzaA__ADK33811
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagcacgccaucgacgagauuaccaacaaggucaauuccgugaucgagaaaaugaacacgcaguuuacagcuguuggaaaggaguucaaucaucuugagaagagaauugaaaaccugaauaaaaagguggaugacggcuuccucgauaucuggaccuacaacgccgagcugcugguccuccuggaaaaugagcggacccuugacuaucacgauagcaacgugaaaaaucuguacgagaagguccgcucucagcucaaaaacaacgccaaggaaauugggaauggauguuuugaguucuaucauaagugcgacaacacauguauggaauccgugaaaaauggcaccuacgauuauccuaaguacagcgaggaagcuaaacugaacagagaggagaucgacgggaucaaacuugaaucuacacggauuuaucaaauccuggccauuuacuccacgguugcgagcucccucgugcuggucgugucucugggcgcuaucagcuuuuggaugugcuccaauggaucucuccagugccgcauuuguaucuga

SEQ ID NO: 188304 - RNA, 1701 nt, Artificial Sequence
  derived and/or modified sequence opt5 from hemagglutinin__InfluenzaA__ADK33821
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuuaccauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacgagauuacgaauaaggucaacuccgugaucgagaaaaugaauacacaguuuaccgccguuggaaaggaguucaaccaccuugagaagagaauugaaaaucugaacaaaaagguggaugacggcuuccucgauaucuggaccuacaaugcugagcugcugguccuccuggaaaacgagcggacacuugacuaucaugauagcaaugugaaaaaccuguacgagaagguccgcaaccagcucaaaaauaacgccaaggaaauugggaauggauguuuugaguucuaucacaagugcgacaacaccuguauggaaucugugaaaaauggcacauacgauuauccuaaguacuccgaggaagccaaacugaacagagaggagaucgacgggguuaaacuugaaagcacgcggaucuaucaaauucuggcuaucuacucuaccguggccuccagccucguccuggcggugucccugggcgcuauuucuuuuuggaugugcagcaauggaucccuccagugccgcaucuguauuuga

SEQ ID NO: 188305 - RNA, 1701 nt, Artificial Sequence
  derived and/or modified sequence opt5 from hemagglutinin__InfluenzaA__ADK33831
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaaucgcgccccuccaucugggcaaaugcaacauugccggguggauccugggaaauccugagugugaaucucucagcacagcuuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaauaccagcucuuggccuaaccacgauuccaauaagggagucacagccgcuuguccccaugccggcgccaagagcuuuuauaaaaaccugauuuggcucgugaagaaaggcaauucuuacccuaagcuguccaaaagcuauaucaacgacaaggggaaggaaguucuugugcuguggggcauucaccaccccuccaccucugccgaucaacagagccucuaccagaaugcugacgccuacgucuucgugggaacauccagauauagcaaaaaguuuaaaccugagaucgcuauucggccgaaggugcgcgaucaggaggggagaaugaacuacuauuggacccuggucgaacccggagacaaaaucacguucgaggccacaggcaaccugguugugccucgguacgcguuugccauggaacgcaaugcugggucuggaauuaucaucuccgauacccccgugcaugacugcaacacaaccugucaaaccccuaagggcgccauuaauacaagccuccccuuccagaacauccacccgauuacgaucggcaaaugcccuaaguaugucaagucuaccaaacugagacuugcuacagggcugcggaaugugcccagcauucagucccgcggacucuuuggcgccaucgccggguucaucgagggaggcuggaccgggaugguugacggaugguacggcuaucaucaccagaacgaacaaggcucuggguacgcugcggaucuuaagagcacacagaaugccauugacgagaucaccaacaaagucaauuccgugauugagaagaugaacacgcaguuuacagcugugggaaaagaguucaaucaccuggagaagagaaucgaaaaccugaauaagaaaguugaugacggcuuccucgauauuuggaccuacaacgccgagcugcuggugcuccuggaaaaugagcggacccuugacuaucaugauagcaacgucaagaaccuguacgagaaagugcgcucucagcucaagaauaacgccaaagaaaucgggaauggauguuuugaguucuaucacaagugcgacaacacauguauggaauccgucaagaauggcaccuacgauuauccuaaauacagcgaggaagcuaagcugaacagagaggagaucgacggggugaaacuugaaucuacacggauuuaucaaauccuggccauuuacuccacgguugcgagcucccucgugcuggucgugucucugggcgcuaucagcuuuuggaugugcuccaauggaucucuccagugccgcauuuguaucuga

SEQ ID NO: 188306 - RNA, 1701 nt, Artificial Sequence; identical to SEQ ID NO: 187113
  derived and/or modified sequence opt5 from hemagglutinin__InfluenzaA__ADK33841

SEQ ID NO: 188307 - RNA, 1701 nt, Artificial Sequence; identical to SEQ ID NO: 187860
  derived and/or modified sequence opt5 from hemagglutinin__InfluenzaA__ADK33851

SEQ ID NO: 188308 - RNA, 1701 nt, Artificial Sequence; identical to SEQ ID NO: 185693
  derived and/or modified sequence opt5 from hemagglutinin__InfluenzaA__ADK33861

SEQ ID NO: 188309 - RNA, 1701 nt, Artificial Sequence
  derived and/or modified sequence opt5 from hemagglutinin__InfluenzaA__ADK33871
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccuggugaucccucgguacgcguuugccauggagcgcaacgcugggucuggaauuaucaucuccgacacccccgugcaugauugcaauacaaccugucaaaccccuaaaggcgccauuaacacaagccuccccuuccagaauauccacccgauuacgaucggcaagugcccuaaguaugucaaaucuaccaagcugagacuugcuacagggcugcggaacgugcccagcauucagucccgcggacucuuuggcgccaucgccggguucaucgaaggaggcuggaccgggaugguugacggaugguacggcuaucaucaccagaaugagcaaggcucuggguacgcugcggaccugaaaagcacacagaacgccauugaugagaucaccaauaaggugaacuccgucauugaaaagaugaauacgcaguuuacagcugugggaaaggaguucaaccaccuugaaaagagaaucgagaaucugaacaaaaagguugacgauggcuuccucgacauuuggaccuacaaugccgaacugcuggugcuccuggagaacgagcggacccuugauuaucaugacagcaaugucaaaaaccuguacgaaaaggugcgcucucagcucaaaaacaaugccaaggagaucgggaacggauguuuugaguucuaucacaagugcgauaauacauguauggaguccgucaaaaacggcaccuacgacuauccuaaguacagcgaagaggcuaaacugaauagagaggaaaucgauggggugaaacuugagucuacacggauuuaucaaauccuggccauuuacuccacgguugcgagcucccucgugcugcuggucucucucggcgcuaucagcuuuuggaugugcuccaacggaucucugcagugccgcauuuguaucuga

SEQ ID NO: 188310 - RNA, 1701 nt, Artificial Sequence
  derived and/or modified sequence opt5 from hemagglutinin__InfluenzaA__ADK33881
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggaacauccagauauagcaagaaauuuaagccugagaucgcuauucggccgaaaguccgcgaucaggaggggagaaugaauuacuauuggacccucguugaacccggagacaagaucacguucgaggccacaggcaaccugguggugccucgguacgcguuugccauggaacgcaacgcugggucuggaauuaucaucuccgauacccccguccaugacugcaauacaaccugucaaaccccuaaaggcgccauuaacacaagccugcccuuccagaauauccacccgauuacgaucggcaagugcccuaaguaugugaaaucuaccaagcucagacuggcuacagggcuucggaacguucccagcauucagucccgcggacuguuuggcgccaucgccggguucaucgagggaggcuggaccgggaugguggacggaugguacggcuaucaucaccagaaugaacaaggcucuggguacgcugcggaucucaaaagcacacagaacgccauugacgagaucaccaauaaggucaacuccgugauugagaaaaugaauacgcaguuuacagcuguuggaaaggaguucaaccaccuggagaagagaaucgaaaaucuuaacaaaaagguggaugacggcuuccuggauauuuggaccuacaaugccgagcuccugguccugcucgaaaacgagcggacccuggacuaucaugauagcaaugugaaaaaccuuuacgagaagguccgcucucagcugaaaaacaaugccaaggaaaucgggaacggauguuuugaguucuaucacaagugcgacaauacauguauggaauccgugaaaaacggcaccuacgauuauccuaaguacagcgaggaagcuaaacucaauagagaggagaucgacgggguuaagcuggaaucuacaaaaauuuaucaaauccuugccauuuacuccacgguggcgagcucccugguccucgugguuucucugggcgcuaucagcuuuuggaugugcuccaacggaucucugcagugccggauuuguaucuga

SEQ ID NO: 188311 - RNA, 1701 nt, Artificial Sequence
  derived and/or modified sequence opt5 from hemagglutinin__InfluenzaA__ADK33891
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaaucgcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccaagagcuauaucaaugacaaggggaaagaaguucuugugcuguggggcauucaccaccccuccaccucugccgaucaacagagccucuaccagaacgcugacgccuacgucuucgugggaacauccagauauagcaagaaauuuaagccugagaucgcuauucggccgaaagugcgcgaucaggaggggagaaugaauuacuauuggacccuggucgaacccggagacaagaucacguucgaggccacaggcaaccugguugugccucgguacgcguuugccauggaacgcaacgcugggucuggaauuaucaucuccgauacccccgugcaugacugcaauacaaccugucaaaccccuaaaggcgccauuaacacaagccuccccuuccagaauauccacccgauuacgaucggcaagugcccuaaguaugucaaaucuaccaagcugagacuugcuacagggcugcggaacgugcccagcauucagucccgcggacucuuuggcgccaucgccggguucaucgagggaggcuggaccgggaugguugacggaugguacggcuaucaucaccagaaugaacaaggcucuggguacgcugcggaucugaaaagcacacagaacgccauugacgagaucaccaauaaggugaacuccgucauugagaaaaugaauacgcaguuuacagcugugggaaaggaguucaaccaccuugagaagagaaucgaaaaucugaacaaaaagguugaugacggcuuccucgauauuuggaccuacaaugccgagcugcuggugcuccuggaaaacgagcggacccuugacuaucaugauagcaaugucaaaaaccuguacgagaaggugcgcaaccagcucaaaaauaacgccaaggaaaucgggaauggauguuuugaguucuaucacaagugcgacaacacauguauggaaucugucaaaaauggcaccuacgauuauccuaaguacuccgaggaagcuaaacugaacagagaggagaucgacggggugaaacuugaaagcacacggauuuaucaaauccuggccauuuacucuacgguugcguccagccucgugcuggucgugucccugggcgcuaucucuuuuuggaugugcagcaauggaucccuccagugccgcauuuguaucuga

SEQ ID NO: 188312 - RNA, 1701 nt, Artificial Sequence; identical to SEQ ID NO: 187860
  derived and/or modified sequence opt5 from hemagglutinin__InfluenzaA__ADK33901

SEQ ID NO: 188313 - RNA, 1701 nt, Artificial Sequence
  derived and/or modified sequence opt5 from hemagglutinin__InfluenzaA__ADK33911
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagggaagcacaauggaaaacuuuguaagcugagaggcguugcuccccuccaucuggggaaaugcaacaucgccggauggauucugggcaauccugagugugaaucucucagcacagccuccucuuggagcuacaucguggagaccuccucuagcgauaacgggacgugcuauccgggagacuuuauugauuacgaagaacugcgggagcagcuuuccagcgucucuuccuucgaacgcuuugagaucuuccccaagaccagcucuuggccuaaucacgacuccaacaagggcgugacagccgcuuguccccaugccggcgcgaaaucuuuuuauaagaaucugaucuggcucauuaaaaaggggaacagcuacccuaaacuguccaagagcuauaucaaugauaagggaaaagaaguucuugugcuguggggcauucaccaccccuccaccucugccgaccaacagagccucuaccagaacgcugaugccuacgucuucguggggacauccagauauagcaagaaauuuaagccugagaucgcuauucggccgaaagugcgcgaccaggagggaagaaugaauuacuauuggacccuggucgaacccggcgauaagaucacguucgaggccacagggaaccugguugugccucgguacgcguuugccauggaacgcaacgcuggaucuggcauuaucaucuccgacacccccgugcaugauugcaauacaaccugucaaaccccuaaaggcgccauuaacacaagccuccccuuccagaauauccacccgauuacgaucgggaagugcccuaaguaugucaaaucuaccaagcugagacuugcuacaggacugcggaacauucccagcauccagucccgcggccucuuuggggccaucgccggauucauugagggcggguggaccggaaugguggacggcugguacggcuaucaucaccagaaugaacaagggucuggauacgcugcggaccugaaaagcacacagaacgccaucgaugagauuaccaauaagguuaacuccgugaucgagaaaaugaauacgcaguuuacagcugucggcaaggaguucaaccaccuugagaagagaauugaaaaucugaacaaaaagguggacgauggguuccucgacaucuggaccuacaaugccgagcugcugguucuccuggaaaacgagcggacccuugauuaucaugacagcaaugugaaaaaccuguacgagaagguccgcucucagcucaaaaacaaugccaaggaaaucggaaacggcuguuuugaguucuaucacaagugcgauaauacauguauggaauccgugaaaaacgggaccuacgacuauccuaaguacagcgaggaagcuaaacugaauagagaggagauugauggcgucaaacuugaaucuacacggaucuaucaaauucuggccaucuacuccacgguggcgagcucccucguucugguggucucucugggagcuauuagcuuuuggaugugcuccaacggcucucuccagugccgcaucuguauuuga

SEQ ID NO: 188314 - RNA, 1701 nt, Artificial Sequence
  derived and/or modified sequence opt5 from hemagglutinin__InfluenzaA__ADK33931
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaccugaaaagcacacagaacgccaucgaugagauuaccaauaaggucaacuccgugaucgaaaagaugaauacgcaguuuacagcuguuggaaaggaguucaaccaccuugaaaagagaauugagaaucugaacaaaaagguggacgauggcuuccucgacaucuggaccuacaaugccgaacugcugguccuccuggagaacgagcggacccuugauuaucaugacagcaaugugaaaaaccuguacgaaaagguccgcucucagcucaaaaacaaugccaaggagauugggaacggauguuuugaguucuaucacaagugcgauaauacauguauggaguccgugaaaaacggcaccuacgacuauccuaaguacagcgaagaggcuaaacugaauagagaggaaaucgaugggguuaaacuugagucuacacggaucuaucaaauucuggccaucuacuccacgguggcgagcucccucguccugcuggugucucucggcgcuauuagcuuuuggaugugcuccaacggaucucugcagugccgcaucuguauuuga

SEQ ID NO: 188315 - RNA, 1701 nt, Artificial Sequence
  derived and/or modified sequence opt5 from hemagglutinin__InfluenzaA__ADK33941
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucgucauuuccgauacccccgugcaugacugcaauacaaccugucaaaccccuaaaggcgccaucaacacaagccuccccuuccagaauauccacccgauuacgaucggcaagugcccuaaguauguuaaaucuaccaagcugagacuugcuacagggcugcggaacauucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacaagauuaccaauaaagucaacuccgugaucgagaagaugaauacgcaguuuacagcuguuggaaaggaguucaaccaccuugagaaaagaauugagaaucugaacaagaaaguggaugacggcuuccucgauaucuggaccuacaaugccgaacugcugguccuccuggagaacgaacggacccuugacuaucaugauagcaaugugaagaaccuguacgagaaaguccgcucucagcucaagaacaaugccaaggagauugggaacggauguuuugaguucuaucacaaaugcgacaauacauguauggaauccgugaagaacggcaccuacgauuauccuaaauacagcgaagaggcuaagcugaauagagaagagaucgacgggguuaaacuugagucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 188316 - RNA, 1701 nt, Artificial Sequence; identical to SEQ ID NO: 188313
  derived and/or modified sequence opt5 from hemagglutinin__InfluenzaA__ADK33951

SEQ ID NO: 188317 - RNA, 1701 nt, Artificial Sequence; identical to SEQ ID NO: 186857
  derived and/or modified sequence opt5 from hemagglutinin__InfluenzaA__ADK33961

SEQ ID NO: 188318 - RNA, 1701 nt, Artificial Sequence; identical to SEQ ID NO: 186637
  derived and/or modified sequence opt5 from hemagglutinin__InfluenzaA__ADK45312

SEQ ID NO: 188319 - RNA, 1701 nt, Artificial Sequence
  derived and/or modified sequence opt5 from hemagglutinin__InfluenzaA__ADK45410
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagcccauuccaauuguuauccuuacgacgugcccgauuaugcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaccugaaguuuaaguacccugcccuuaaugucaccaugcccaacaacgagcaguucgacaaacuguauauuuggggcgugcaucacccugggacggauaaugaccagaucuuucucuacgcgcaagccucuggacgcauuacaguuuccaccaagagaagccagcagacagugaucccgaacauuggcucccggccccgcgucagaaauaucccuucucggaucagcauuuauuggaccaucgugaaacccggggauauucugcugaucaacuccaccggaaaucucauugcuccucgcggcuacuucaagaucagaagcgggaaaucuuccaucaugcggagcgacgcccccauuggaaaguguaacucugaaugcaucacaccgaauggcagcauuccuaacgacaagcccuuucagaaugugaaccgcaucacguacggcgcuuguccuagauaugucaaacaaaauacccugaaacuugccacagggaugcggaacguucccgagaagcagacccgcggaauuuucggcgcgaucgccggguuuaucgaaaauggaugggagggcaugguggaugggugguacggauucagacaccagaacuccgagggccggggccaagcugccgaccugaagucuacacaggcugccauugaucagaucaaugggaaacucaacagacugauuggaaagaccaacgaaaaauuccaucagaucgagaaggaauuuagcgagguggaaggccgcauucaagaccuugagaaguaugucgaggauacgaaaaucgaccugugguccuacaaugccgaacuccugguggcucuggagaaccagcacacaauugaucucaccgacagcgaaaugaauaagcuguucgagaaaaccaagaaacagcuucgggaaaacgcggaggauauggggaauggaugcuuuaagaucuaucauaagugugacaacacaugcaucggcucuauuagaaaugggaccuacgaucacgacguuuaucgcgacgaggcccugaacaaucgguuccagaucaaaggcguggaacucaaguccggauacaaagauuggauucuguggaucagcuuugcuauuucuugcuuccuucugugugucgcccuccugggcuuuaucaugugggccugccaaaaggggaacaucagauguaauauuugcaucuga

SEQ ID NO: 188320 - RNA, 1701 nt, Artificial Sequence
  derived and/or modified sequence opt5 from hemagglutinin__InfluenzaA__ADK45421
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauccgcagaucuaagaacuccuuuuucagccggcugaauuggcucacacaucugaacuuuaaauauccugcccuuaaugucaccaugcccaacaacgagcaguucgacaagcuguacauuuggggcgugcaccauccugggacggauaaagaccagaucuuucucuaugcgcaagccucuggacgcauuacaguuuccaccaagagaagccagcagacagugaucccgaauauuggcucccggccccgcaucagaaacaucccuucucggauuagcaucuacuggaccauugucaaacccggggauauccugcugauuaauuccaccggaaaccucaucgcuccucgcggcuacuucaagaucagaagcgggaagucuuccauuaugcggagcgacgcccccaucggaaaauguaauucugagugcauuacaccgaacggcagcaucccuaaugacaagcccuuucagaacgugaaucgcauuacguauggcgcuuguccuagauacgugaaacaauccacccugaaacuugccacagggaugcggaacguccccgaaaaacagacccgcggaaucuucggcgcgaucgccggguuuauugagaauggaugggaaggcaugguugaugggugguauggauucagacaccagaacucugagggccggggccaagcugccgaccucaagagcacacaggcugccaucgaucagauuaaugggaaacugaacagacugaucggaaagaccaaugagaaguuccaccagauugaaaaagaguuuuccgaaguggagggccgcauccaagaccuugaaaaguacguggaggauacgaaaauugaccuguggagcuauaacgccgagcuccuggucgcucuggaaaaccagcauacaaucgaucucaccgacucugagaugaauaagcuguucgaaaagaccaagaagcagcuucgggagaacgcggaagauauggggaauggaugcuuuaaaaucuaccacaagugugacaacgccugcauuggcuccaucagaaaugggacauaugaucaugacguguaccgcgacgaggcucugaacaaucgguuccagauuaaaggcguugagcucaagagcggauacaaagauuggauccuguggauuucuuuugccaucuccugcuuccuucuguguguggcccuccugggcuuuaucaugugggcuugccaaaaggggaacauuagauguaauaucugcauuuga

SEQ ID NO: 188321 - RNA, 1701 nt, Artificial Sequence
  derived and/or modified sequence opt5 from hemagglutinin__InfluenzaA__ADK45432
augaagaccaucauugcccugagcuacacacucugccugguguucgcucagaaacuucccagaaacgacaauuccacggccacccugugucucggccaccaugcggucccuaacgggacaaucguuaagaccauuacaaaugaucaaaucgaggugaccaacgcuacagaacuggugcagucuagcuccaccggagagauuugcgacaauccgcaccagauccuugauggcgaaaacuguacgcugaucgacgcccuccugggggauccccagugcgacggauuucaaaauaaaaagugggaucuguucgucgagcggucuaaagccuauagcaacuguuacccuuaugacgugcccgauuacgcuucccuccgcucucugguugccagcuccggcacccuugaauuuaauaacgagagcuucaauuggacaggggugacccagaacggaacaucuuccgcuugcauuagacggagcaauaacuccuuuuucucucgccugaauuggcucacccaucugaaguuuaaguauccugcccuuaacgucacgaugcccaacaaugagcaguucgacaaacuguacaucuggggcgugcaccauccuggcacagauaacgaccagauuuuucucuaugcgcaagccagcgggagaaucaccguuucuacaaagcggucccagcagaccgugauuccgaauaucggaagccgccccagaguccggaacauuccuucccgcaucucuaucuacuggaccauugugaaacccggcgauauccugcugauuaauagcacagggaaccucaucgcuccuagaggauacuucaagauucgguccggcaaaagcucuaucaugcgcuccgacgcccccaucgggaaguguaauagcgaaugcauuacgccgaacggaucuaucccuaaugacaagcccuuucagaacgugaauagaauuaccuauggcgcuuguccucgguacgucaaacaaaacacacugaaacuugccaccggcaugcgcaauguucccgagaagcagacaagagggaucuucggagcgauugccggcuuuaucgaaaacgggugggagggaaugguggauggcugguauggguuccggcaccagaauagcgagggaagaggccaagcugccgaccugaaguccacccaggcugccaucgaucagauuaacggcaaacucaaccgccugaucgggaagacgaaugaaaaauuccaccagauugagaaggaauuuucugagguggaaggacggauccaagaccuugagaaguacgucgaggauacaaaaauugaccuguggagcuauaacgccgaacuccugguggcucuggagaaucagcauaccaucgaucucaccgacuccgaaaugaacaagcuguucgagaaaacaaagaaacagcuuagagaaaaugcggaggauaugggcaacgggugcuuuaagauuuaccacaagugugacaaugccugcaucggaagcauccgcaacggcaccuaugaucaugacguuuaccgggacgaggcucugaauaacagauuccagauuaaagggguggaacucaagucuggcuacaaagauuggauccuguggauuuccuuugccaucagcugcuuccuucugugugucgcccuccugggauuuauuaugugggcuugccaaaagggcaauauccgcuguaacaucugcauuuga

SEQ ID NO: 188322 - RNA, 1701 nt, Artificial Sequence; identical to SEQ ID NO: 185458
  derived and/or modified sequence opt5 from hemagglutinin__InfluenzaA__ADK45443

SEQ ID NO: 188323 - RNA, 1701 nt, Artificial Sequence; identical to SEQ ID NO: 187857
  derived and/or modified sequence opt5 from hemagglutinin__InfluenzaA__ADK48798

SEQ ID NO: 188324 - RNA, 1701 nt, Artificial Sequence; identical to SEQ ID NO: 186857
  derived and/or modified sequence opt5 from hemagglutinin__InfluenzaA__ADK62683

SEQ ID NO: 188325 - RNA, 1701 nt, Artificial Sequence
  derived and/or modified sequence opt5 from hemagglutinin__InfluenzaA__ADK62693
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugaguguggcucucucagcacagccuccucuuggagcuacaucguggaaaccuccucuagcgacaacgggacgugcuauccgggagauuuuauugacuacgaggaacugcgggagcagcuuuccagcgucucuuccuucgagcgcuuugaaaucuuccccaagaccagcucuuggccuaaucacgauuccaacaagggcgugacagccgcuuguccccaugccggcgcgaaaucuuuuuauaagaaucugaucuggcucguuaaaaaggggaacagcuacccuaaacuguccaagagcuauauuaaugacaagggaaaagaggugcuuguccuguggggcauccaccaccccuccaccucugccgaucaacagagccucuaccagaacgcugacgccuacguguucguggggacauccagauauagcaagaaauuuaagccugaaauugcuauccggccgaaaguccgcgagcaggagggaagaaugaauuacuauuggacccugguugaacccggcgauaagauuacguucgaggccacagggaaccugguggugccucgguacgcguuugccauggaacgcaacgcuggaucuggcaucauuaucuccgacacccccguccaugauugcaauacaaccugucaaaccccuaaaggcgccaucaacacaagccuccccuuccagaaugugcacccgauuacgaucgggaagugcccuaaguauguuaaaucuaccaagcugagacuugcuacaggacugcggaacgugcccagcauucagucccgcggccucuuuggggccaucgccggauucauugagggcggguggaccggaauggucgacggcugguacggcuaucaucaccagaaugaacaagggucuggauacgcugcggaccugaaaagcacacagaacgccaucgaugagaucaccaauaaggugaacuccguuauugagaaaaugaauacgcaguuuacagcugugggcaaggaguucaaccaccuugaaaagagaaucgaaaaucugaacaaaaaggucgacgauggguuccucgacauuuggaccuacaaugccgagcugcuggugcuccuggaaaacgagcggacccuugauuaucaugacagcaaugucaaaaaccuguacgagaaggugcgcucucagcucaaaaacaaugccaaggaaaucggaaacggcuguuuugaguucuaucacaagugcgauaauacauguauggaauccguuaaaaacgggaccuacgacuauccuaaguacagcgaggaagcuaaacugaauagagaggagauugauggcgugaaacuugaaucuacacggaucuaucaaauccuggccauuuacuccacggucgcgagcucccucgugcugguugugucucugggagcuaucagcuuuuggaugugcuccaacggcucucuccagugccgcauuuguaucuga

SEQ ID NO: 188326 - RNA, 1701 nt, Artificial Sequence; identical to SEQ ID NO: 186794
  derived and/or modified sequence opt5 from hemagglutinin__InfluenzaA__ADK62703

SEQ ID NO: 188327 - RNA, 1701 nt, Artificial Sequence
  derived and/or modified sequence opt5 from hemagglutinin__InfluenzaA__ADK64992
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggaucaaacuugaaucuacacggauuuaucaaauccuggccauuuacuccacgguugcgagcucccucgugcuggucgugucucugggcgcuaucagcuuuuggaugugcuccaacggaucucuccaguaccgcauuugcaucuga

SEQ ID NO: 188328 - RNA, 1701 nt, Artificial Sequence
  derived and/or modified sequence opt5 from hemagglutinin__InfluenzaA__ADK65001
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugggaggcguugcuccccuccaucuggggaaaugcaacaucgccggauggauucugggcaauccugagugugaaucucucagcacagccuccucuuggagcuacaucguggagaccuccucuagcgacaacgggacgugcuauccgggagauuuuauugacuacgaagaacugagagagcagcuuuccagcgucucuuccuucgaacgguuugagaucuuccccaagaccagcucuuggccuaaucacgauuccaacaagggcgugacagccgcuuguccccaugccggcgcgaaaucuuuuuauaagaaucugaucuggcucguuaaaaaggggaacagcuacccuaaacuguccaagagcuauauuaaugacaagggaaaagaagugcuuguccuguggggcauccaccaccccuccaccucugccgaucaacagagccucuaccagaacgcugacgccuacguguucguggggacaucccgcuauagcaagaaauuuaagccugagauugcuaucagaccgaaaguccgggaucaggagggacgcaugaauuacuauuggacccugguugaacccggcgacaagauuacguucgaggccacagggaaccugguggugccuagauacgcguuugccauggaacggaacgcuggaucuggcaucauuaucuccgauacccccguccaugacugcaauacaaccugucaaaccccuaaaggcgccaucaacacaagccuccccuuccagaauauucacccgaucacgauugggaagugcccuaaguaugugaaaucuaccaagcugcgccuugcuacaggacugagaaacguucccagcauccagucccggggccucuuuggggccauugccggauucaucgagggcggguggaccggaaugguggacggcugguacggcuaucaucaccagaaugaacaagggucuggauacgcugcggaucugaaaagcacacagaacgccaucgacgagauuaccaauaaggucaacuccgugaucgagaaaaugaauacgcaguuuacagcuguuggcaaggaguucaaccaccuugagaagcgcauugaaaaucugaacaaaaagguggaugacggguuccucgauaucuggaccuacaaugccgagcugcugguccuccuggaaaacgagagaacccuugacuaucaugauagcaaugugaaaaaccuguacgagaagguccggucucagcucaaaaacaaugccaaggaaauuggaaacggcuguuuugaguucuaucacaagugcgacaauacaugucuggaauccgugaaaaacgggaccuacgauuauccuaaguacagcgaggaagcuaaacuuaaucgcgaggagaucgacggcguuaagcuggaaucuacaagaaucuaucaaauucucgccaucuacuccacgguggcgagcucccugguccuggugguuucucucggagcuauuagcuuuuggaugugcuccaacggcucucugcagugccggaucuguauuuga

SEQ ID NO: 188329 - RNA, 1701 nt, Artificial Sequence
  derived and/or modified sequence opt5 from hemagglutinin__InfluenzaA__ADK65009
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcagauauuccaagaaauuuaagccggagauugcuauccggcccaaaguccgcgaucaggaggggagaaugaauuacuauuggacccugguugaaccuggagacaagauuacguucggcgccacagggaaccugguggugccccgguacgcguuugccauggagcgcaacgcuggaagcggcaucauuaucucugauaccccuguccaugacugcaauacaaccugucaaacccccaaaggcgccaucaacacaucccucccguuccagaauauucacccuaucacgauugggaagugccccaaguaugugaaaagcaccaagcugagacuugcuacaggacugcggaacguuccuucuauccagagccgcggccucuuuggggccauugccggauucaucgaaggcggguggaccggaaugguggacggcugguacggcuaucaucaccagaaugagcaaggguccggauacgcugcggaucugaaaucuacacagaacgccaucgacgaaauuaccaauaaggucaacagcgugaucgagaaaaugaauacgcaguuuacagcuguuggcaaggaguucaaccaccuugaaaagagaauugagaaucugaacaaaaagguggaugacggguuccucgauaucuggaccuacaaugccgaacugcugguccuccuggagaacgaacggacccuugacuaucaugauuccaaugugaaaaaccuguacgagaagguccgcagccagcucaaaaacaaugccaaggagauuggaaacggcuguuuugaguucuaucacaagugcgacaauacauguauggagucugugaaaaacgggaccuacgauuaucccaaguacuccgaagaggcuaaacugaauagagaagagaucgacggcguuaaacuugagagcacacggaucuaucaaauucuggccaucuacucuacgguggcguccagccucguccuggugguuucccugggagcuauuucuuuuuggaugugcagcaacggcucccuccagugccgcaucuguauuuga

SEQ ID NO: 188330 - RNA, 1701 nt, Artificial Sequence
  derived and/or modified sequence opt5 from hemagglutinin__InfluenzaA__ADK87287
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauccgcagaucuaagaacuccuuuuucagccggcugaauuggcucacacaucugaacuuuaaauauccugcccuuaaugucaccaugcccaacaacgagcaguucgacaagcuguacauuuggggcgugcaccauccugggacggauaaagaccagaucuuucucuaugcgcaagccucuggacgcauuacaguuuccaccaagagaagccagcagacagcuaucccgaauauuggcucccggccccgcgugagaaacaucccuucucggaucagcauuuacuggaccaucgucaaacccggggauauucugcugaucaauuccaccggaaaccucauugccccucgcggcuacuucaagaucagaagcgggaagucuuccaucaugcggagcgacgcucugauuggaaaauguaauucugagugcaucacacccaacggcagcauuccgaaugacaagccuuuucagaacgugaaucgcaucacguauggcgccugucccagauacgugaaacaaaacacccuuaagcuggcgacagggaugcggaaugucccugaaaaacagacccgcggaauuuucggcgccaucgcuggguuuaucgagaacggaugggaaggcaugguugaugggugguauggauucagacaccaaaauuccgagggccggggccaggccgcugaccucaagucuacacaggccgccauugaucagaucaacgggaaacugaauagacuuauuggaaagaccaacgagaaguuccaccagaucgaaaaagaguuuagcgaaguggagggccgcauucaagaccuggaaaaguacguggaggauacgaaaaucgaccucugguccuauaacgcugagcugcuggucgcgcucgaaaaucagcauacaauugaucugaccgacagcgagaugaacaaacuuuucgaaaagaccaagaagcagcugcgggagaaugccgaagauauggggaacggaugcuuuaaaaucuaccacaagugugacaaugcuugcaucggcucuauuagaaacgggacauaugaucaugacguguaccgcgacgaggcccucaauaaccgguuccagaucaaaggcguugagcugaaguccggauacaaagauuggauucuuuggaucagcuuugccauuucuugcuuccugcucuguguggcucugcugggcuuuaucaugugggccugccaaaaggggaauaucagauguaacauuugcaucuga

SEQ ID NO: 188331 - RNA, 1701 nt, Artificial Sequence
  derived and/or modified sequence opt5 from hemagglutinin__InfluenzaA__ADK87288
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauccgcagaucuaagaacuccuuuuucagccggcugaauuggcucacacaucugaacuuuaaauauccugcccuuaaugucaccaugcccaacaacgagcaguucgacaagcuguacauuuggggcgugcaccauccugggacggauaaagaccagaucuuucucuaugcgcaagccacaggacgcauuaccguuucuacaaagagaucccagcagaccgcuaucccgaauauuggcagccggccccgcgugagaaacaucccuucccggaucucuauuuacuggaccaucgucaaacccggggauauucugcugaucaauagcacaggaaaccucauugccccucgcggcuacuucaagaucagauccggaaagagcucuaucaugcgguccgacgcucccauugggaaauguaauagcgagugcaucacgccgaacggcucuauuccuaaugacaagcccuuucagaacgugaaucgcaucaccuauggcgccuguccuagauacgugaaacaaaacacacugaaacuugcgaccgggaugcggaauguccccgaaaaacagacacgcggaauuuucggcgccaucgcuggguuuaucgagaacggaugggaaggcaugguugaugggugguauggauucagacaccagaauagcgagggccggggccaagccgcugaccugaaguccacccaggccgccauugaucagaucaacgggaaacucaauagacugauuggaaagacgaacgagaaguuccaccagaucgaaaaagaguuuucugaaguggagggccgcauucaagaccuugaaaaguacguggaggauacaaaaaucgaccuguggagcuauaacgcugagcuccuggucgcgcuggaaaaucagcauaccauugaucucaccgacuccgagaugaacaagcuguucgaaaagacaaagaagcagcuucgggagaaugccgaagauauggggaacggaugcuuuaaaaucuaccacaagugugacaaugcuugcaucggcagcauuagaaacgggaccuaugaucaugacguguaccgcgacgaggcccugaauaaccgguuccagaucaaaggcguugagcucaagucuggauacaaagauuggauucuguggaucuccuuugccauuagcugcuuccuucuguguguggcucuccugggcuuuaucaugugggccugccaaaaggggaauaucagauguaacauuugcaucuga

SEQ ID NO: 188332 - RNA, 1701 nt, Artificial Sequence
  derived and/or modified sequence opt5 from hemagglutinin__InfluenzaA__ADK87289
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuuggauuuaacaaugagucuuucaacuggaccggcgugacacagaauggcaccuccagcgcuugcauccgcagaucuaagaacuccuuuuucagccggcugaauuggcucacacaucugaacuuuaaauauccugcccuuaaugucaccaugcccaacaacgaacaguucgacaagcuguacauuuggggagugcaccauccugggacggauaaagaccagaucuuucucuaugcgcaagccucuggccgcauuacaguuuccaccaagagaagccagcagacagcuaucccgaauauugggucccggccccgcgugagaaacaucccuucucggaucagcauuuacuggaccaucgucaaacccggagauauucugcugaucaauuccaccggcaaccucauugccccucgcggguacuucaagaucagaagcggaaagucuuccaucaugcggagcgacgcucccauuggcaaauguaauucugagugcaucacaccgaacggcagcauuccuaaugacaagcccuuucagaacgugaaucgcaucacguauggggccuguccuagauacgugaaacaaaacacccugaaacuugcgacaggaaugcggaauguccccgagaaacagacccgcggcauuuucggggccaucgcuggauuuaucgaaaacggcugggaggggaugguugauggaugguauggcuucagacaccaaaauuccgaaggccgggggcaggccgcugaccugaagucuacacaggccgccauugaucagaucaacggaaaacucaauagacugauuggcaagaccaacgagaaguuccaccagaucgagaaagaauuuagcgagguggaagggcgcauucaagaccuuggaaaguacguggaggauacgaaaaucgaccugugguccuauaacgcugaacuccuggucgcgcuggagaaucagcauacaauugaucucaccgacagcgagaugaacaagcuguucgaaaagaccaagaagcagcuucgggagaaugccgaagauaugggcaacgggugcuuuaaaaucuaccacaagugugacaaugcuugcaucggcucuauuagaaacggaacauaugaucaugacguguaccgcgacgaggcccugaauaaccgguuccagaucaaaggcguugaacucaaguccggguacaaagauuggauucuguggaucagcuuugccauuucuugcuuccuucuguguguggcucuccugggauuuaucaugugggccugccaaaagggcaauaucagauguaacauuugcaucuga

SEQ ID NO: 188333 - RNA, 1701 nt, Artificial Sequence
  derived and/or modified sequence opt5 from hemagglutinin__InfluenzaA__ADK87291
augaagaccaucauugcccugagcuacauccagugccucguguucgcucaaaaacugcccggcaacgacaauuccacagccacgcuuugucuggggcaccaugcggucccuaacggaaccauuguuaagacaaucaccaaugaucagauugaggugacaaacgcuaccgaacucgugcagucuagcuccacaggcgagaucugcgacucuccgcaccagauccuggaugggaaaaauuguacccuuauugacgcccugcucggagauccccaaugcgacggcuuucagaacaagaaaugggaucuguucgucgaaagaagcaaggccuauuccaauuguuacccuuaugacgugcccgauuacgcuucucugcggagccucguugccuccagcgggacgcuggaguuuaacaaugaaucuuucaacuggaccggagugacacagaauggcaccuccagcgcuugcauccgcagaucuaagaacuccuuuuucagccggcuuaauuggcugacacaucucaacuuuaaauauccugcccugaaugucaccaugcccaacaacgagcaguucgacaagcuguacauuuggggcgugcaccauccugggacggauaaagaccaaaucucucuguaugcgcaggccuccggacgcauuacaguuagcaccaagagaucccagcagacagcuaucccgaauauuggcucucggccccgcgugagaaacaucccuagccggaucuccauuuacuggaccaucgucaaacccggggauauucuccugaucaauagcaccggaaaccugauugccccucgcggcuacuuuaagaucagaucugggaaguccagcaucaugcggucugacgcucccauuggaaaauguaauagcgagugcaucacaccgaacggcuccauuccuaaugacaagcccuuccaaaacgugaaucgcaucacguauggcgccuguccuagauacgugaaacagaacacccucaagcuggcgacagggaugcggaauguccccgaaaaacagacccgcggaauuuuuggcgccaucgcuggguucaucgagaacggaugggaaggcaugguugaugggugguauggauuuagacaccaaaauucugagggccggggccaggccgcugaccuuaagagcacacaggccgccauugaucagaucaacgggaaacugaauagacucauuggaaagaccaacgagaaguuccaccaaaucgaaaaagaguucuccgaaguggagggccgcauucaggaccuggggaaguacguggaagauacgaaaaucgaccuuuggagcuauaacgcugagcugcucgucgcgcuggagaaucagcauacaauugaucugaccgacucugaaaugaacaagcucuuugagaaaaccaagaagcagcugcgggaaaaugccgaggauaugggaaacggcugcuucaaaaucuaccacaagugugacaaugcuugcaucggguccauuagaaacggcacauaugaucaugacguguaccgcgacgaagcccuuaauaaccgguuucaaaucaaaggaguugagcuuaagagcggcuacaaagauuggauucucuggaucucuuucgccauuuccugcuuucugcuuuguguggcucugcucggguucaucaugugggccugccagaagggaaauaucagauguaacauuugcaucuga

SEQ ID NO: 188334 - RNA, 1701 nt, Artificial Sequence
  derived and/or modified sequence opt5 from hemagglutinin__InfluenzaA__ADK87293
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacaggacggcaccuccagcgcuugcauccgcagaucuaaaaauuccuuuuucagcaagcugaacuggcucacacaucugaauuuuaaguauccugcccuuaacgucaccaugcccaauaacgagcaguucgauaaacuguacauuuggggcgugcaccauccugggacggacaaggaucagacauuucucuaugcgcaagccucuggacggaucaccguuuccacaaaacgcagccagcagaccgcuauuccgaacaucggcuccagaccccgggugcgcaauauuccuucuagaaucagcaucuacuggaccauugucaagcccggggacauccugcugauuaacuccacaggaaaucucaucgccccucggggcuacuucaagauucgcagcgggaaaucuuccaucaugagaagcgacgcucccaucggaaaguguaacucugagugcauuacgccgaauggcagcaucccuaacgauaaacccuuucagaaugugaaccggauuaccuauggcgccuguccucgcuacgugaagcaaaauacacugaaacuugcgaccgggaugagaaacguccccgaaaagcagacacggggaaucuucggcgccauugcuggguuuaucgagaauggaugggaaggcaugguugacgggugguauggauuccgccaccagaacuccgagggcagaggccaagccgcugaucugaaaucuacccaggccgccaucgaccagauuaaugggaagcucaaccggcugaucggaaagacgaaugagaaauuccaccagauugaaaaggaguuuagcgaaguggagggcagaauccaagaucuugaaaaauacguggaggacacaaagauugaucugugguccuauaacgcugagcuccuggucgcgcuggaaaaccagcauaccaucgaccucaccgauagcgagaugucuaaacuguucgaaaagacaaagaaacagcuucgcgagaaugccgaagacauggggaacggaugcuuuaagauuuaccacaaaugugauaaugcuugcaucggcuccauccggaacgggaccuaugaccaugacguguacagagaugaggcccugaauaaccgcuuccagauuaagggcguugagcucaaaagcggauacaaggacuggauccuguggauuucuuuugccaucuccugcuuccuucuguguguggcucuccugggcuuuauuaugugggccugccaaaaggggaauauccgguguaacaucugcauuuga

SEQ ID NO: 188335 - RNA, 1701 nt, Artificial Sequence
  derived and/or modified sequence opt5 from hemagglutinin__InfluenzaA__ADK87295
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggucucuugaguuuaacaaugaauccuucaacuggacgggagugacccagaauggcacaagcucugcuugcauccgcagauccaagaacagcuuuuucucucggcugaauuggcucacccaucugaacuuuaaauauccugcccuuaaugucacaaugcccaacaacgagcaguucgacaagcuguacauuuggggcgugcaccauccugggaccgauaaagaccagaucuuucucuaugcgcaagccuccggacgcauuacgguuagcacaaagagaucccagcagaccgcuaucccgaauauuggcucucggccccgcgugagaaacaucccuagccggaucuccauuuacuggacaaucgucaaacccggggauauucugcugaucaauagcaccggaaaccucauugccccucgcggcuacuucaagaucagaucugggaaguccagcaucaugcggucugacgcucccauuggaaaauguaauagcgagugcaucaccccgaacggcuccauuccuaaugacaagcccuuucagaacgugaaucgcaucacauauggcgccuguccuagauacgugaaacaaaacacgcugaaacuugcgaccgggaugcggaauguccccgaaaaacagacacgcggaauuuucggcgccaucgcuggguuuaucgagaacggaugggaaggcaugguugaugggugguauggauucagacaccagaauagcgagggccggggccaagccgcugaccugaagucuacccaggccgccauugaucagaucaacgggaaacucaauagacugauuggaaagacaaacgagaaguuccaccagaucgaaaaagaguuuuccgaaguggagggccgcauucaagaccuugaaaaguacguggaggauaccaaaaucgaccuguggagcuauaacgcugagcuccuggucgcgcuggaaaaucagcauacgauugaucucacagacucugagaugaacaagcuguucgaaaagaccaagaagcagcuucgggagaaugccgaagauauggggaacggaugcuuuaaaaucuaccacaagugugacaaugcuugcaucggcuccauuagaaacgggaccuaugaucaugacguguaccgcgacgaggcccugaauaaccgguuccagaucaaaggcguugagcucaagagcggauacaaagauuggauucuguggaucucuuuugccauuuccugcuuccuucuguguguggcucuccugggcuuuaucaugugggccugccaaaaggggaauaucagacgcaacauuuguaucuga

SEQ ID NO: 188336 - RNA, 1701 nt, Artificial Sequence
  derived and/or modified sequence opt5 from hemagglutinin__InfluenzaA__ADK87296
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcagauauuccaagaaauuuaagccggagauugcuauccggcccaaaguccgcgaucaggaggggagaaugaauuacuauuggacccugguugaaccuggagacaagauuacguucgaggccacaggcaaccugguggugccccggugcgcguuugccauggaacgcaacgcugggagcggaaucauuaucucugauaccccuguccaugacuguaauacaaccugccaaacccccaaaggcgccaucaacacaucccucccguuccagaauauucacccuaucacgauuggcaagugucccaaguacgugaaaagcaccaagcugagacuugcuacagggcugcggaacguuccuucuauccagagccgcggacucuuuggcgccauugccggguucaucgagggaggcuggaccgggaugguggacggaugguauggcuaccaucaccagaaugaacaaggcuccggguaugcugcggaucugaaaucuacacagaacgccaucgacgagauuaccaauaaggucaacagcgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaccaugauuccaaugugaaaaaccuguaugagaagguccgcagccagcucaaaaacaaugccaaggaaauugggaacggaugcuuugaguucuaccacaagugugacaauacaugcauggaaucugugaaaaacggcaccuaugauuaccccaaguauuccgaggaagcuaaacugaauagagaggagaucgacgggguuaaacuugaaagcacacggaucuaccaaauucuggccaucuauucuacgguggcguccagccucguccuggugguuucccugggcgcuauuucuuuuuggaugugcagcaacggaucccuccagugucgcaucugcauuuga

SEQ ID NO: 188337 - RNA, 1701 nt, Artificial Sequence
  derived and/or modified sequence opt5 from hemagglutinin__InfluenzaA__ADK87298
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacuccggcacgugcuauccgggggauuuuauugacuacgaagaacugcgggagcagcuuagcucugucuccagcuucgaacgcuuugagaucuuccccaagaccucuuccuggccuaaccacgaucccaauaagggagugacagccgcuuguccucaugccggcgcgaaaucuuuuuauaagaaccugaucuggcucguuaaaaagggcaauagcuaccccaaacuguccaagagcuauauuaacgacaaggggaaagaagugcuuguccuguggggaauccaccacccuuccaccucugccgaucaacagagccucuaccagaaugcugacgccuacguguucgugggcacauccagauauagcaagaaauuuaagccggagauugcuauccggcccaaaguccgcgaucaggaggggagaaugaacuacuauuggacccugguugaaccuggagacaagauuacguucgaggccacaggcaaucugguggugccccgguacgcguuugccauggaacgcaacgcugggucuggaaacaucauuuccgauaccccuguccaugacugcaauacaaccugucaaacccccaaaggcgccaucaacacaagccucccguuccagaauauccacccuauuacgaucggcaagugccccaaguaugugaaaucuaccaagcugagacuugcuacagggcugcggaacguuccuagcauucagucccgcggacucuuuggcgccaucgccggguucauugagggaggcuggaccgggaugguggacggaugguacggcuaucaucaccagaaugaacaaggcucuggguacgcugcggaucugaaaagcacacagaacgccaucgacgagaucaccaauaaggucaaccccgugauugagaaaaugaauacgcaguuuacagcuguuggaaaggaguucaaccaccuugagaagagaaucgaaaaucugaacaaaaagguggaugacggcuuccucgauauuuggaccuacaaugccgagcugcugguccuccuggaaaacgagcggacccuugacuaucaugauuccaaugugaaaaaccuguacgagaagguccgcagccagcucaaaaacaaugccaaggaaaucgggaacggauguuuugaguucuaucacaagugcgacaauacauguauggaaucugugaaaaacggcaccuacgauuaucccaaguacuccgaggaagcuaaacugaauagagaggagauugacgggguuaaacuugaaagcacacggaucuaucaaauccuggccauuuacucuacgguggcguccagccucguccuggugguuucccugggcgcuaucucuuuuuggaugugcagcaacggaucccuccagugccgcauuuguaucuga

SEQ ID NO: 188338 - RNA, 1701 nt, Artificial Sequence
  derived and/or modified sequence opt5 from hemagglutinin__InfluenzaA__ADK87300
augaagaccaucauugcccugagcuacauccucugcaugguguucgcucagaaacugcccggcaacgacaauuccacagccacgcuuugucuggggcaccaugcggucccuaacggaaccauuguuaagacaaucaccaaugaucaaauugaggugacaaacgcuaccgaacucgugcagucuagcuccacaggcgagaucugcgacucuccgcaccagauccuggaugggaaaaauuguacccuuauugacgcccugcucggagauccccagugcgacggcuuucaaaacaagaaaugggaucuguucgucgaaagaagcaaggccuauuccaauuguuacccuuaugacgugcccgauuacgcuucucugcggagccucguugccuccagcgggacgcuggaguuuaacaaugaaucuuucaacuggaccggagugacacagaauggcaccuccagcgcuugcauccgcagaucuaagaacucccuuuuuagccggcugaauuggcucacacaucugaacuucaaauauccugcccuuaaugucaccaugcccaacaacgagcaguuugacaagcuguacauuuggggcgugcaccauccugggacggauaaagaccagaucuuccucuaugcgcaagccucuggacgcauuacaguuuccaccaagagaagccagcagacagcuaucccgaauauuggcucccggccccgcgugagaaacaucccuucucggaucagcauuuacuggaccaucgucaaacccggggauauucugcugaucaauuccaccggaaaccucauugccccucgcggcuacuuuaagaucagaagcgggaagucuuccaucaugcggagcgacgcucccauuggaaaauguaauucugagugcaucgccccgaacggcagcauuccuaaugacaaguccuuccagaacgugaaucgcaucacauauggcgcgugucccagauacgugaaacaaaacacgcugaaacuugccaccgggaugcggaaugucccugaaaaacagacacgcggaauuuuuggcgcuaucgccggguucaucgagaacggaugggaaggcaugguugaugggugguauggauuuagacaccagaauagcgagggccggggccaagcugccgaccugaagucuacccaggccgcuauugaucagaucaacgggaaacucaauagacugauuggaaagacaaacgagaaguuccaccagaucgaaaaagaguucuccgaaguggagggccgcauucaagaccuugaaaaguacguggaggauaccaaaaucgaccuguggagcuauaacgcggagcuccuggucgcccuggaaaaucagcauacgauugaucucacagacucugagaugaacaagcuguuugaaaagaccaagaagcagcuucgggagaaugcugaagauauggggaacggaugcuucaaaaucuaccacaagugugacaaugccugcaucggcuccauuagaaacgggaccuaugaucaugacguguaccgcgacgaggcccugaauaaccgguuucagaucaaaggcguugagcucaagagcggauacaaagauuggauucuguggaucucuuucgcuauuuccugcuuucuucuguguguggcccuccugggcuucaucaugugggcgugccaaaaggggaauaucagauguaacauuugcaucuga

SEQ ID NO: 188339 - RNA, 1701 nt, Artificial Sequence
  derived and/or modified sequence opt5 from hemagglutinin__InfluenzaA__ADK87302
augaagaccaucauugcccugagcuacauccucugcaugguguucgcucagaaacugcccggcaacgacaauuccacagccacgcuuugucuggggcaccaugcggucccuaacggaaccauuguuaagacaaucaccaaugaucaaauugaggugacaaacgcuaccgaacucgugcagucuagcuccacaggcgagaucugcgacucuccgcaccagauccuggaugggaaaaauuguacccuuauugacgcccugcucggagauccccagugcgacggcuuucaaaacaagaaaugggaucuguucgucgaaagaagcaaggccuauuccaauuguuacccuuaugacgugcccgauuacgcuucucugcggagccucguugccuccagcgggacgcuggaguuuaacaaugaaucuuucaacuggaccggagugacacagaauggcaccuccagcgcuugcauccgcagaucuaagaacuccuuuuucagccggcuuaauuggcugacacaucucaacuuuaaauauccugcccugaaugucaccaugcccaacaacgagcaguucgacaaacuuuacauuuggggcgugcaccauccugggacggauaaagaccagaucuuucuguaugcgcaagccucuggacgcauuacaguuuccaccaagagaagccagcagacagcuaucccgaauauuggcucccggccccgcgugagaaacaucccuucucggaucagcauuuacuggaccaucgucaaacccggggauauucuccugaucaauuccaccggaaaccugauugccccucgcggcuacuucaagaucagaagcgggaagucuuccaucaugcggagcgacgcucccauuggaaaauguaauucugagugcaucacaccgaacggcagcauuccuaaugacaagcccuuucagaacgugaaucgcaucacguauggcgccuguccuagauacgugaaacaaaacacccucaagcuggcgacagggaugcggaauguccccgaaaaacagacccgcggaauuuucggcgccaucgcuggguuuaucgagaacggaugggaaggcaugguugaugggugguauggauucagacaccaaaauuccgagggccggggccaggccgcugaccuuaagucuacacaggccgccauugaucagaucaacgggaaacugaauagacucauuggaaagaccaacgagaaguuccaccagaucgaaaaagaguuuagcgaaguggagggccgcauucaagaccuggaaaaguacguggaggauacgaaaaucgaccuuugguccuauaacgcugagcugcucgucgcgcuggaaaaucagcauacaauugaucugaccgacagcgagaugaacaaacucuucgaaaagaccaagaagcagcugcgggagaaugccgaagauauggggaacggaugcuuuaagaucuaccacaagugugacaaugcuugcaucggcucuauuagaaacgggacauaugaucaugacguguaccgcgacgaggcccuuaauaaccgguuccagaucaaaggcguugagcugaaguccggauacaaagauuggauucucuggaucagcuuugccauuucuugcuuccugcuuuguguggcucugcucggcuuuaucaugugggccugccaaaaggggaauaucagaugugacauuugcaucuga

SEQ ID NO: 188340 - RNA, 1701 nt, Artificial Sequence
  derived and/or modified sequence opt5 from hemagglutinin__InfluenzaA__ADK87304
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugaucaaaucgaggugacaaacgcuaccgaacucgugcagucuagcuccacaggcgagaucugcgacucuccgcaccagauucuggaugggaaaaauuguacccuuaucgacgcccugcucggagauccccagugcgacggcuuucaaaacaagaaaugggaucuguucgucgaaagaagcaaggccuauuccaauuguuacccuuaugacgugcccgauuacgcuucucugcggagccucguugccuccagcgggacgcuggaguuuaacaaugaaucuuucaacuggaccggagugacacagaauggcaccuccagcgcuugcauucgcagaucuaagaacuccuuuuucagccggcuuaauuggcugacacaucucaacuuuaaauauccugcccugaaugucaccaugcccaacaacgagcaguucgacaaacuuuacaucuggggcgugcaccauccugggacggauaaggaccagauuuuucuguaugcgcaagccucuggacgcaucacaguuuccaccaagagaagccagcagacagcuauuccgaauaucggcucccggccccgcgugagaaacaucccuucucggauuagcaucuacuggaccauugucaaacccggggauauccuccugauuaauuccaccggaaaccugaucgccccucgcggcuacuucaagaucagaagcgggaagucuuccauuaugcggagcgacgcucccaucggaaaauguaauucuggcugcauuacaccgaacggcagcaucccuaaugacaagcccuuucagaacgugaaucgcauuacguauggggccuguccuagauacgugaaacaaaacacccucaagcuggcgacaggaaugcggaauguccccgagaaacagacccgcggcaucuucggggccaucgcuggauuuauugaaaacggcugggaggggaugguugauggaugguauggcuucagacaccaaaauuccgaaggccgggggcaggccgcugaccuuaagucuacacaggccgccaucgaucagauuaacggaaaacugaauagacucaucggcaagaccaacgagaaguuccaccagauugagaaagaauuuagcgagguggaagggcgcauccaagaccuggagaaguacguggaagauacgaaaauugaccuuugguccuauaacgcugagcugcucgucgcgcuggagaaucagcauacaaucgaucugaccgacagcgaaaugaacaaacucuucgagaagaccaagaagcagcugcgggaaaaugccgaggauaugggaaacggcugcuuuaaaaucuaccacaagugugacaaugcuugcauugggucuaucagaaacggcacauauggacaugauguguaccgcgacgaagcccuuaauaaccgguuccagauuaaaggcguugagcugaaguccggguacaaagacugguuucucuggaucagcuucgccauuucuugcuuucugcuuuguguggcucugcucggauucaucaugugggccugccaaaagggcaauaucagauguaacauuugcaucuga

SEQ ID NO: 188341 - RNA, 1701 nt, Artificial Sequence
  derived and/or modified sequence opt5 from hemagglutinin__InfluenzaA__ADK87306
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcugccgaacuggugcagucuagcuccaccggcgagaucugcgacucuccgcaccagauccuugaugggaaaaauuguacacugauugacgcccuccugggagauccccagugcgacggcuuucaaaacaagaaaugggaucuguucgucgggagaagcaaggcuuauuccaauuguuacccuuaugacgugcccgauuacgccucucuccggagccugguugcuuccagcggaacccuugaauuuaacaaugagucuuucaacuggacgggcgugacccagaauggcacauccagcgccugcauccgcagaucuaagaacuccuuuuucagccggcugaauuggcucacccaucugaacuuuaaauauccugcgcuuaaugucacaaugcccaacaacgaacaguucgacaagcuguacauuuggggagugcaccauccugggaccgauaaagaccagaucuuucucuaugcccaggcuucuggccgcauuacgguuuccacaaagagaagccagcagaccgccaucccgaauauugggucccggccccgcgugagaaacaucccuucucggaucagcauuuacuggacaaucgucaaacccggagauauucugcugaucaauuccaccggcaaccucauugcuccucgcggguacuucaagaucagaagcggaaagucuuccaucaugcggagcgacgcccccauuggcaaauguaauucugagugcaucaccccgaacggcagcauuccuaaugacaagcccuuucagaacgugaaucgcaucacauauggggcguguccuagauacgugaaacaaaacacgcugaagcuggccaccggaguccggaauguucccgagaaacagacacgcggcauuuucggggcuaucgccggauuuaucgaaaacggcugggaggggaugguggauggaugguauggcuucagacaccaaaauuccgaaggccgggggcaagcugccgaccugaagucuacccaggccgcuauggaucagauuaacggaaaacucaauagacugaucggcaagacaaacgagaaacuucaccagaccgagaaggaguucagcgaaguggaagggcgcauucaagaccuggagaaguacgucgaagauacgaaaaucgaccucugguccuauaacgcggagcugcugguggcccucgagagccagcauacaauugaucugaccgacucugaaaugaauaaacuuuuugagaagaccaagaagcagcugcgggaaaacgcugaggauaugggaaauggcugcuucaaaaucuaccacaagugugacaacgccugcauuggguccaucagaaauggcacauaugaucaugacguuuaccgcgacgaagcccucaacaaucgguuucagaucaaaggaguggagcuuaagagcggcuacaaagauuggauucuuuggaucucuuucgcuauuuccugcuuucugcucugugucgcccugcugggguucaucaugugggcgugccaaaagggaaacauuagauguaauaucugcaucuga

SEQ ID NO: 188342 - RNA, 1701 nt, Artificial Sequence
  derived and/or modified sequence opt5 from hemagglutinin__InfluenzaA__ADK87308
augaagaccaucauugcccugagcuacauccucugcaugguguucgcucagaaacugcccggcaacgacaauuccacagccacgcuuugucuggggcaccaugcggucccuaacggaaccauuguuaagacaaucaccaaugaucaaauugaggugacaaacgcuaccgaacucgugcagucuagcuccacaggcgagaucugcgacucuccgcaccagauccuggaugggaaaaauuguacccuuauugacgcccugcucggagauccccagugcgacggcuuucaaaacaagaaaugggaucuguucgucgaaagaagcaaggccuauuccaauuguuacccuuaugacgugcccgauuacgcuucucugcggagccucguugccuccagcgggacgcuggaguuuaacaaugaaucuuucaacuggaccggagugacacagaauggcaccuccagcgcuugcauccgcagaucuaagaacuccuuuuucagccggcuuaauuggcugacacaucucaacuuuaaauauccugcccugaaugucaccaugcccaacaacgagcaguucgacaaacuuuacauuuggggcgugcaccauccugggacggauaaagaccagaucuuucuguaugcgcaagccucuggacgcauuacaguuuccaccaagagaagccagcagacagcuaucccgaauauuggcucccggccccgcgugagaaacaucccuucucggaucagcauuuacuggaccaucgucaaacccggggauauucuccugaucaauuccaccggaaaccugauugccccucgcggcuacuucaagaucagaagcgggaagucuuccaucaugcggagcgacgcucccauuggaaaauguaauucugagugcaucacaccgaacggcagcauuccuaaugacaagcccuuucagaacgugaaucgcaucacguauggcgccuguccuagauacgugaaacaaaacacccucaagcuggcgacagggaugcggaauguccccgaaaaacagacccgcggaauuuucggcgccaucgcuggguuuaucgagaacggaugggaaggcaugguugaugggugguauggauucagacaccaaaauuccgagggccggggccaggccgcugaccuuaagucuacacaggccgccauugaucagaucaacgggaaacugaauagacucauuggaaagaccaacgagaaguuccaccagaucgaaaaagaguuuagcgaaguggagggccgcauucaagaccuggaaaaguacguggaggauacgaaaaucgaccuuugguccuauaacgcugagcugcucgucgcgcuggaaaaucagcauacaauugaucugaccgacagcgagaugaacaaacucuucgaaaagaccaagaagcagcugcgggagaaugccgaagauauggggaacggaugcuuuaagaucuaccacaagugugacaaugcuugcaucggcucuauuagaaacgggacauaugaucaugacguguaccgcgacgaggcccuuaauaaccgguuccagaucaaaggcguugagcugaaguccggauacaaagauuggauucucuggaucagcuuugccauuucuugcuuccugcuuagaguggcucugcucggcuuuaucaugugggccugucaaaaggggaauauccgcugcaacauuuguaucuga

SEQ ID NO: 188343 - RNA, 1701 nt, Artificial Sequence
  derived and/or modified sequence opt5 from hemagglutinin__InfluenzaA__ADK87309
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauccgcagaucuaagaacuccuuuuucagccggcugaauuggcucacacaucugaacuuuaaauauccugcccuuaaugucaccaugcccaacaacgagcaguucgacaagcuguacauuuggggcgugcaccauccugggacggauaaagaccagaucuuucucuaugcgcaagccucuggacgcauuacaguuuccaccaagagaagccagcagacagcuaucccgaauauuggcucccggccccgcgugagaaacaucccuucucggaucagcauuuacuggaccaucgucaaacccggggauauucugcugaucaauuccaccggaaaccucauugccccucgcggcuacuucaagaucagaagcgggaagucuuccaucaugcggagcgacgcucccauuggaaaauguaauucugagugcaucacaccgaacggcagcauuccuaaugacaagcccuuucagaacgugaaucgcaucacguauggcgccuguccuagauacgugaaacaaaacacccugaaacuugcgacagggaugcggaauguccccgaaaaacagacccgcggaauuuucggcgccaucgcuggguuuaucgagaacggaugggaaggcaugguugaugggugguauggauucagacaccaaaauuccgagggccggggccaggccgcugaccugaagucuacacaggccgccauugaucagaucaacgggaaacucaauagacugauuggaaagaccaacgagaaguuccaccagaucgaaaaagaguuuagcgaaguggagggccgcauucaagaccuugaaaaguacguggaggauacgaaaaucgaccugugguccuauaacgcugagcuccuggucgcgcuggaaaaucagcauacaauugaucucaccgacagcgagaugaacaagcuguucgaaaagaccaagaagcagcuucgggagaaugccgaagauauggggaacggaugcuuuaaaaucuaccacaagugugacaaugcuugcaucggcucuauuagaaacgggacauaugaucaugacguguaccgcgacgaggcccugaauaaccgguuccagaucaaaggcguugagcucaaguccggauacaaagauuggauucuguggaucagcuuugccauuucuugcuuccuucuguguguggcucucuccggcuuuaucaugugggccugccaaaaggggaauaucagauguaacauuugcaucuga

SEQ ID NO: 188344 - RNA, 1701 nt, Artificial Sequence
  derived and/or modified sequence opt5 from hemagglutinin__InfluenzaA__ADK87310
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccggaagcuggccuaaucacgaucccaacaagggcgugacagccgcuuguccucaugccggcgcgaaaucuuuuuauaagaaucugaucuggcucguuaaaaaggggaacuccuaccccaaacugagcaagucuuauauuaaugacaagggaaaagaagugcuuguccuguggggcauccaccacccuuccaccagcgccgaucaacagucccucuaccagaacgcugacgccuacguguucguggggacaucuagauauagcaagaaauuuaagccggagauugcuauccggcccaaaguccgcgaucaggagggaagaaugaauuacuauuggacccugguugaaccuggcgacaagauuacguucgaggccacagggaaccugguggugccccgguacgcguuugccauggaacgcaacgcuggauccggcaucauuaucagcgauaccccuguccaugacugcaauacaaccugucaaacccccaaaggcgccaucaacacaucucucccguuccagaauauucacccuaucacgauugggaagugccccaaguaugugaaauccaccaagcugagacuugcuacaggacugcggaacguuccuagcauccagucucgcggccucuuuggggccauugccggauucaucgagggcggguggaccggaaugguggacggcugguacggcuaucaucaccagaaugaacaagggagcggauacgcugcggaucugaaauccacacagaacgccaucgacgagauuaccaauaaggucaacucugugaucgagaaaaugaauacgcaguuuacagcuguuggcaaggaguucaaccaccuugagaagagaauugaaaaucugaacaaaaagguggaugacggguuccucgauaucuggaccuacaaugccgagcugcugguccuccuggaaaacgagcggacccuugacuaucaugauagcaaugugaaaaaccuguacgagaagguccgcucccagcucaaaaacaaugccaaggaaauuggaaacggcuguuuugaguucuaucacaagugcgacaauacauguauggaaagcgugaaaaacgggaccuacgauuaucccaaguacucugaggaagcuaaacugaauagagaggagaucgacggcguuaaacuugaauccacacggaucuaucaaauucuggccaucuacagcacgguggcgucuucccucguccuggugguuagccugggagcuauuuccuuuuggaugugcucuaacggcagccuccagugccgcaucuguauuuga

SEQ ID NO: 188345 - RNA, 1701 nt, Artificial Sequence
  derived and/or modified sequence opt5 from hemagglutinin__InfluenzaA__ADK87311
augaaggccauccuggugguccuccuguacaccuucgcuacagccaacgcggacacgcuuugcauuggcuaucacgcugauaauagcaccgacacaguugauaccgugcuggagagaaacgugacagucacccauuccgugaaucuccuggaagacaaacacaacgggaaacuuuguaagcugcggggaguugcgccccuccaucugggcaagugcaauaucgccggguggauucugggaaacccugagugugaaucucucagcacagcuuccucuuggagcuacaucguggagaccuccucuagcgauaauggcacgugcuauccgggggacuuuauugauuacgaagaacugcgcgagcagcuuuccagcgucucuuccuucgaaagauuugagaucuuccccaaaaccagcucuuggccuaaccacgacuccaauaagggagugacagccgcuuguccccaugccggcgccaagagcuuuuauaaaaaccugaucuggcucguuaagaaaggcaauucuuacccuaagcuguccaaaagcuauauuaacgauaaggggaaggaagugcuuguccuguggggaauccaccaccccuccaccucugccggccaacagagccucuaccagaaugcugacgccuacguguucguggggacaucccgguauagcaaaaaguuuaaaccugagauugcuauccgcccgaaggucagagaucaggagggacggaugaacuacuauuggacccugguugaacccggcgacaaaauuacguucgaggccacagggaaucugguggugccucgcuacgcguuugccauggaaagaaacgcuggaucuggcaucauuaucuccgauacccccguccaugacugcaacacaaccugucaaaccccuaagggcgccaucaauacaagcccgcccuuccagaacauucacccuaucacgauugggaaaugccccaaguaugugaagucuaccaaacuccggcuggcuacaggacuucgcaauguuccuagcauccaguccagaggccuguuuggggccauugccggauucaucgagggcggguggaccggaaugguggacggcugguacggcuaucaucaccagaacgaacaagggucuggauacgcugcggaucucaagagcacacagaaugccaucgacgagauuaccaacaaagucaauuccgugaucgagaagaugaacacgcaguuuacagcuguuggcaaagaguucaaucaccuggagaagcggauugaaaaccuuaauaagaaaguggaugacggguuccuggauaucuggaccuacaacgccgagcuccugguccugcucgaaaaugagcgcacccuggacuaucaugauagcaacgugaagaaucuuuacgagaaagucagaucucagcugaagaacaacgccaaagaaauuggaaauggcuguuuugaguucuaucacaagugcgacaacacauguauggaauccgugaagaaugggaccuacgauuaucccaaauacagcgaggaagcuaagcucaaccgggaggagaucgacggcguuaaacuggaaucuacacgcaucuaucaaauucuugccaucuacuccacgguggcgagcucccugguccucgugguuucucugggagcuauuagcuuuuggaugugcuccaauggcucucugcagugcagaaucuguauuuga

SEQ ID NO: 188346 - RNA, 1701 nt, Artificial Sequence
  derived and/or modified sequence opt5 from hemagglutinin__InfluenzaA__ADK87313
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugaucaaaucgaggugacaaacgcuaccgaacucgugcagucuagcuccacaggcgagaucugcgacucuccgcaccagauucuggaugggaaaaauuguacccuuaucgacgcccugcucggagauccccagugcgacggcuuucaaaacaagaaaugggaucuguucgucgaaagaagcaaggccuauuccaauuguuacccuuaugacgugcccgauuacgcuucucugcggagccucguugccuccagcgggacgcuggaguuuaacaaugaaucuuucaacuggaccggagugacacagaauggcaccuccagcgcuugcauucgcagaucuaagaacuccuuuuucagccggcuuaauuggcugacacaucucaacuuuaaauauccugcccugaaugucaccaugcccaacaacgagcaguucgacaaacuuuacaucuggggcgugcaccauccugggacggauaaggaccagauuuuucuguaugcgcaagccucuggacgcaucgcuguuuccacaaagagaagccagcagaccgccauuccgaauaucggcucccggccccgcgugagaaacaucccuucucggauuagcaucuacuggacaauugucaaacccggggauauccuccugauuaauuccaccggaaaccugaucgcuccucgcggcuacuucaagaucagaagcgggaagucuuccauuaugcggagcgacgcccccaucggaaaauguaauucuggcugcauuaccccgaacggcagcaucccuaaugacaagcccuuucagaacgugaaucgcauuacauauggggcguguccuagauacgugaaacaaaacacgcucaagcuggccaccggaaugcggaauguccccgagaaacagacacgcggcaucuucggggcuaucgccggauuuauugaaaacggcugggaggggaugguugauggaugguauggcuucagacaccaaaauuccgaaggccgggggcaggcugccgaccuuaagucuacccaggccgcuaucgaucagauuaacggaaaacugaauagacucaucggcaagacaaacgagaaguuccaccagauugagaaagaauuuagcgagguggaagggcgcauccaagaccuggagaaguacguggaagauaccaaaauugaccuuugguccuauaacgcggagcugcucgucgcccuggagaaucagcauacgaucgaucugacagacagcgaaaugaacaaacucuucgagaagaccaagaagcagcugcgggaaaaugcugaggauaugggaaacggcugcuuuaaaaucuaccacaagugugacaaugccugcauugggucuaucagaaacggcaccuaugaucaugacguguaccgcgacgaagcccuuaauaaccgguuccagauuaaaggaguugagcugaaguccggcuacaaagauugguuucucuggaucagcuucgcuauuucuugcuuucugcuuuguguggcccugcucggguucaucaugugggcgugccaaaagggaaauaucagauguaacauuugcaucuga

SEQ ID NO: 188347 - RNA, 1701 nt, Artificial Sequence
  derived and/or modified sequence opt5 from hemagglutinin__InfluenzaA__ADK87315
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaggaacugcgggagcagcuuuccagcgucucuuccuucgaacgcuuugagaucuuccccaagaccagcccuuggcccaaucacgauccuaacaagggagugacagccgcuuguccccaugccggcgcgaaaucuuuuuauaagaaucugaucuggcucguuaaaaagggcaacuccuacccuaaacugagcaagucuuauauuaaugacaaggggaaagaagugcuuguccuguggggaauccaccacccguccaccagcgccgaucaacagucccucuaccagaacgcugacgccuacguguucgugggcacaucuagauauagcaagaaauuuaagcccgagauugcuauccggccuaaaguccgcgaucaggaggggagaaugaauuacuauuggacccugguugaacccggagacaagauuacguucgaggccacaggcaaccugguggugccucgguacgcguuugccauggaacgcaacgcuggguccggaaucauuaucagcgauacccccguccaugacugcaauacaaccugucaaaccccgaaaggcgccaucaacacaucucucccuuuccagaauauucaccccaucacgauuggcaagugcccuaaguaugugaaauccaccaagcugagacuugcuacagggcugcggaacguucccagcauccagucucgcggacucuuuggcgccauugccggguucaucgagggaggcuggaccgggaugguggacggaugguacggcuaucaucaccagaaugaacaaggcagcggguacgcugcggaucugaaauccacacagaacgccaucgacgagauuaccaauaaggucaacucugugaucgagaaaaugaauacgcaguuuacagcuguuggaaaggaaagcaaccaccuugagaccagaauugaaaaucugaacaagaaaguggaugacggcuuccucgauaucuggaccuacaaugccgagcugcugguccuccuggaaaacgagcggacacuugacuaucaugauuccaaugugaagaaccuguacgagaaaguccgcagccagcucaagaacaaugccaaagaaauugggaacggauguuucgaguuuuaucacaagugcgacucuaccuguauggaauccgugaagaauggcacauacgauuaucccaaauacagcgaggaagcuaagcugaacagagaggagaucgacgggguuaaacuugaaucuacgcggaucuaucaaauucuggccaucuacuccaccguggcgagcucccucguccuggugguuucucugggcgcuauuagcuucuggaugugcuccaauggaucucuccagugccgcaucuguauuuga

SEQ ID NO: 188348 - RNA, 1701 nt, Artificial Sequence; identical to SEQ ID NO: 186491
  derived and/or modified sequence opt5 from hemagglutinin__InfluenzaA__ADK87317

SEQ ID NO: 188349 - RNA, 1701 nt, Artificial Sequence
  derived and/or modified sequence opt5 from hemagglutinin__InfluenzaA__ADK87319
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcagauauuccaagaaauuuaagccggagauugcuauccggcccaaaguccgcgaucaggaggggagaaugaauuacuauuggacccugguugaaccuggagacaagauuacguucgaggccacaggcaaccugguggugccccgguacgcguuugccauggaacgcaacgcugggagcggaaucauuaucucugauaccccuguccaugacugcaauacaaccugucaaacccccaaaggcgccaucaacacaucccucccguuccagaauauucacccuaucacgauuggcaagugccccaaguaugugaaaagcaccgagcugagacuugcuacagggcugcggaacguuccuucuauccagagccgcggacucuuuggcgccauugccggguucaucgaaggaggcuggaccgggaugguggacggaugguacggcuaucaucaccagaaugagcaaggcuccggguacgcugcggaucugaagucuacacagaacgccaucgacgagauuaccaauaaagucaacagcgugaucgaaaagaugaauacgcaguuuacagcuguuggaaaagaguucaaccaccuugaaaagagaauugagaaucugaacaagaaaguggaugacggcuuccucgauaucuggaccuacaaugccgaacugcugguccuccuggagaacgagcggacccuugacuaucaugauuccaaugugaagaaccuguacgaaaaaguccgcagccagcucaagaacaaugccaaagagauugggaacggauguuuugaguucuaucacaagugcgacaauacauguauggagucugugaagaacggcaccuacgauuaucccaaauacuccgaagaggcuaagcugaauagagaggaaaucgacgggguuaaacuugagagcacacggaucuaucgcauucuggccaucuacucuacgguggcguccagccucguccuggugguuucccugggcgcuauuucuuuuuggaugugcagcaacggaucccuccaaugcagaaucuguauuuga

SEQ ID NO: 188350 - RNA, 1701 nt, Artificial Sequence
  derived and/or modified sequence opt5 from hemagglutinin__InfluenzaA__ADK87321
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugaucaaaucgaggugacaaacgcuaccgaacucgugcagucuagcuccacaggcgagaucugcgacucuccgcaccagauucuggaugggaaaaauuguacccuuaucgacgcccugcucggagauccccagugcgacggcuuucaaaacaagaaaugggaucuguucgucgaaagaagcaaggccuauuccaauuguuacccuuaugacgugcccgauuacgcuucucugcggagccucguugccuccagcgggacgcuggaguuuaacaaugaaucuuucaacuggaccggagugacacagaauggcaccuccagcgcuugcaugcgcagaucuaagaacuccuuuuucagccggcuuaauuggcugacacaucucaacuuuaaauauccugcccugaaugucaccaugcccaacaacgagcaguucgacaaacuuuacauuuggggcgugcaccauccugggacggauaaggaccagaucuuucuguaugcgcaagccucuggacgcauuacaguuuccaccaagagaagccagcagacagcuaucccgaauauuggcucccggccccgcgugagaaacaucccuucucggaucagcgucuacuggaccauugugaaacccggggauauccuccugauuaauuccaccggaaaccugaucgccccucgcggcuacuucaagauuagaagcgggaagucuuccaucaugcggagcgacgcuucuaucggaaaauguaauagcggcugcauuacacccaacggcuccaucccgaaugacaagccuuuucagaacgugaaucgcauuacguauggggccugucccagauacgucaaacaaaacacccucaagcuggcgacaggaaugcggaauguuccugagaaacagacccgcggcaucuucggggccauugcuggauuuaucgaaaacggcugggaggggaugguggauggaugguauggcuucagacaccaaaauucugaaggccgggggcaggccgcugaccuuaagagcacacaggccgccaucgaucagauuaacggaaaacugaauagacucaucggcaagaccaacgagaaguuccaccagauugagaaagaauuucccgagguggaagggcgcauccaagaccuggagaaguacgucgaagauacgaaaauugaccuuugguccuauaacgcugagccccugguggcgcucgagaaucagcauacaaucgaucugaccgacagcgaaaugaacaagcuguucgagaaaaccaagaagcagcuccgggaaaaugccgaggauaugggaaacggcugcuuuaaaauuuaccacaagugugacaaugcuugcaucgggucuaucagaaacggcacauaugaucaugacguuuaccgcgacgaagcccugaauaaccgguuccagauuaaaggaguggagcuuaaguccggcuacaaagauugguuucuguggaucagcuucgccauuucuugcuuucuccugugugucgcccuucugggguucaucaugugggcuugccaaaagggaaauauuagauguaacaucugcaucuga

SEQ ID NO: 188351 - RNA, 1701 nt, Artificial Sequence
  derived and/or modified sequence opt5 from hemagglutinin__InfluenzaA__ADK87323
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauccgcagaucuaagaacuccuuuuucagccggcugaauuggcucacacaucugaacuuuaaauauccugcccuuaaugucaccaugcccaacaacgagcaguucgacaagcuguacauuuggggcgugcaccauccugggacggauaaagaccagaucuuucucuaugcgcaagccucuggacgcauuacaguuuccaccaagagaagccagcagacagcuaucccgaauauuggcucccggccccgcguggggaacaucccuucuagaaucagcauuuacuggaccaucgucaaacccggagauauucugcugaucaauuccaccggcaaccucauugccccucggggguacuucaagauccgcagcggaaagucuuccaucaugagaagcgacgcucccauuggcaaauguaauucugagugcaucacaccgaacggcagcauuccuaaugacaagcccuuucagaacgugaaucggaucacguauggggccuguccucgcuacgugaaacaaaacacccugaaacuugcgacaggaaugagaaauguccccgaaaaacagacccggggcauuuucggggccaucgcuggauuuaucgagaacggcugggaagggaugguugauggaugguauggcuuccgccaccaaaauuccgagggcagagggcaggccgcugaccugaagucuacacaggccgccauugaucagaucaacggaaaacucaaucggcugauuggcaagaccaacgagaaguuccaccagaucgaaaaagaguuuagcgaaguggaggggcgcauucaagaccuugaaaaguacguggaggauacgaaaaucgaccugugguccuauaacgcugagcuccuggucgcgcuggaaaaucagcauacaauugaucucaccgacagcgagaugaacaagcuguucgaaaagaccaagaagcagcuuagagagaaugccgaagauaugggaaacggcugcuuuaaaaucuaccacaagugugacaaugcuugcaucgggucuauucggaacggcacauaugaucaugacguguacagagacgaggcccugaauaaccgcuuccagaucaaaggaguugagcucaaguccggcuacaaagauuggauucuguggaucagcuuugccauuucuugcuuccuucuguguguggcucuccugggguuuaucaugugggccugccaaaagggaaauauccgguguaacauuugcaucuga

SEQ ID NO: 188352 - RNA, 1701 nt, Artificial Sequence
  derived and/or modified sequence opt5 from hemagglutinin__InfluenzaA__ADK87325
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauccgcagaucuaagaacuccuuuuucagccggcugaauuggcucacacaucugaacuuuaaauauccugcccuuaaugucaccaugcccaacaacgagcaguucgacaagcuguacauuuggggcgugcaccauccugggacggauaaagaccagaucuuucucuaugcgcaagccucuggacgcauuacaguuuccaccaagagaagccagcagacagcuaucccgaauauuggcucccggccccgcgugagaaacaucccuucucggaucagcauuuacuggaccaucgucaaacccggggauauucugcugaucaauuccaccggaaaccucauugccccucgcggcuacuucaagaucagaagcgggaagucuuccaucaugcggagcgacgcucccauuggaaaauguaauucugagugcaucacaccgaacggcagcauuccuaaugacaagcccuuucagaacgugaaucgcaucacguauggcgccuguccuagacacgugaaacaaaacacccugaaacuugcgacagggaugcggaauguccccgaaaaacagacccgcggaauuuucggcgccaucgcuggguuuaucgagaacggaugggaaggcaugguugaugggugguacggauucagacaccaaaauuccgagggccggggccaggccgcugaccugaagucuacacaggccgccauugaucagaucaacgggaaacucaauagacugauuggaaagaccaacgagaaguuccaucagaucgaaaaagaguuuagcgaaguggagggccgcauucaagaccuugaaaaguauguggaggauacgaaaaucgaccugugguccuacaacgcugagcuccuggucgcgcuggaaaaucagcacacaauugaucucaccgacagcgagaugaacaagcuguucgaaaagaccaagaagcagcuucgggagaaugccgaagauauggggaacggaugcuuuaaaaucuaucauaagugugacaaugcuugcaucggcucuauuagaaacgggacauacgaucacgacguguaucgcgacgaggcccugaauaaccgguuccagaucaaaggcguugagcucaaguccggauacaaagauuggauucuguggaucagcuuugccauuucuugcuuccuucuguguguggcucuccugggcuuuaucaugugggccugccaaaaggggaauaucagauguaacauuugcaucuga

SEQ ID NO: 188353 - RNA, 1701 nt, Artificial Sequence
  derived and/or modified sequence opt5 from hemagglutinin__InfluenzaA__ADK87326
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauccgcagaucuaagaacuccuuuuucagccggcugaauuggcucacacaucugaacuuuaaauauccugcccuuaaugucaccaugcccaacaacgagcaguucgacaagcuguacauuuggggcgugcaccauccugggacggauaaagaccagaucuuucucuaugcgcaagccucuggacgcauuacaguuuccaccaagagaagccagcagacagcuaucccgaauauuggcucccggccccgcgugagaaacaucccuucucggaucagcauuuacuggaccaucgucaaacccggggauauucugcugaucaauuccaccggaaaccucauugccccucgcggcuacuucaagaucagaagcgggaagucuuccaucaugcggagcgacgcucccauuggaaaauguaauucugagugcaucacaccgaacggcagcauuccuaaugacaagcccuuucagaacgugaaucgcaucacguauggcgccuguccuagauacgugaaacaaaacacccugaaacuugcgacagggaugcggaauguccccgaaaaacagacccgcggaauuuucggcgccaucgcuggguuuaucgagaacggaugggaaggcaugguugaugggugguauggauucagacaccaaaauuccgagggccggggccaggccgcugaccugaagucuacacaggccgccauugaucagaucaacgggaaacucaauagacugauuggaaagaccaacgagaaguuccaccagaucgaaaaagaguuuagcgaaguggagggccgcauucaagaccuugaaaaguacguggaggauacgaaaaucgaccugugguccuauaacgcugagcuccuggucgcgcuggaaaaucagcauacaauugaucucaccgacagcgagaugaacaagcuguucgaaaagaccaagaagcagcuucgggagaaugccgaagauauggggaacggaugcuuuaaaaucuaccacaagugugacaaugcuugcaucggcucuauuagaaacgggacauaugaucaugacguguaccgcgacgaggcccugaauaaccgguuccagaucaaaggcguugagcucaaguccggaugcaaagauuggauucuguggaucagcuuugccauuucuuguuuccuucugugcguggcucuccugggcuuuaccaugugggccugucaaaaggggaauaucagaugcaacaucuguauuuga

SEQ ID NO: 188354 - RNA, 1701 nt, Artificial Sequence
  derived and/or modified sequence opt5 from hemagglutinin__InfluenzaA__ADK87328
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaggagcugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcagauauuccaagaaauuuaagccggagauugcuauccggcccaaaguccgcgaucaggaggggagaaugaauuacuauuggacccugguugaaccuggagacaagauuacguucgaggccacaggcaaccugguggugccccgguacgcguuugccauggaacgcaacgcugggagcggaaucauuaucucugauaccccuguccaugacugcaauacaaccugucaaacccccaaauccgccaucaacacaagccucccguuccagaauauucacccuaucacgauuggcaagugccccaaguaugugaaaucuaccaagcugagacuugcuacaggccugcggaacguuccuagcauccagucccgcgggcucuuuggagccauugccggcuucaucgaagggggauggaccggcaugguggacgggugguacggauaucaucaccagaaugaacaaggcucuggcuacgcugcggaucugaaaagcacacagaacgccaucgacgagauuaccaauaaggucaacuccgugaucgagaaaaugaauacgcaguuuacagcuguugggaaggaguucaaccaccuugaaaagagaauugaaaaucugaacaaaaagguggaugacggauuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauuggcaacggguguuuugaguucuaucacaagugcgacaauacauguauggaauccgugaaaaacggaaccuacgauuaucccaaguacagcgaggaagcuaaacugaauagagaggagaucgacggcguuaaacuugaaucuacacggaucuaucaaauucuggccaucuacuccacgguggcgagcucccucguccuggugguuucucugggggcuauuagcuuuuggaugugcuccaacggcucucuccagugccgcaucuguauuuga

SEQ ID NO: 188355 - RNA, 1701 nt, Artificial Sequence
  derived and/or modified sequence opt5 from hemagglutinin__InfluenzaA__ADK87334
augaagaccaucauugcccugagcuacauccucugccugguguucgcucagaaacuucccggcaacgacaauuccacagccacgcugugucucgggcaccaugcggucccuaacggaaccauuguuaagacaaucaccucugaucaaauugaggugacaaaugcuaccgaacuggugcagagcuccucuacaggcgagaucugcgacagcccgcaccagauccuugaugggaaaaacuguacccugauugacgcccuccugggagauccccagugcgacggcuuucaaaauaagaaaugggaucuguucgucgaaagauccaaggccuauucuaacuguuacccuuaugacgugcccgauuacgcuagccuccggucccugguugccagcucugggacgcuugaguuuaauaacgaauccuucaauuggaccggagugacacagaacggcaccagcucugcuugcauccgcagauccaagaauagcuuuuucucuaaacugaacuggcucacacaucugaauuuuaaguauccugcccuuaacgucaccaugcccaauaacgagcaguucgacaaacuguacauuuggggcgugcggcacccugggacggauaaggaccagaucuuucucuaugcgcaagccuccggacgcauuacaguuagcaccaaaagaucccagcagacagugaucccgaacauuggcucucggccccgcgucagaaauaucccuagccggaucuccaccuacuggaccauugugaagcccggggauauccugcugauuaacagcacaggaaaucucaucgcuccucgcggcuacuucaagauuagaucugggaaauccagcaucaugcggucugacacgcccaucggaaaguguaacagcgagugcauuaccccgaauggcuccaucccuaacgacaaacccuuucagaaugugaaccgcauuacauauggcgccuguccuagauacgucaagcaaaauacccugaaacuugcuacagggaugcggaacguucccgaaaagcagacccgcggaaucuucggcgccauugcgggguuuaucgagaauggaugggaaggcaugguggaugggugguauggauucagacaucagaacucugagggccggggccaagccgcugaccugaaaagcacgcaggccgcuaucgaucagauuaaugggaagcucaacagacugaucggaaagacaaaugagaaauuccaccagauugaaaaggaguuuuccgaaguggagggccgcauccaagaccuugaaaaauacgucgaggauaccaagauugaccuguggagcuauaacgccgagcuccugguggcccuggaaaaccagcacaccaucgaucucacagacucugagaugaauaaacuguucgaaaagaccaagaaacagcuucgggagaacgcugaagauauggggaauggaugcuuuaagauuuaccauaaaugugacaacgcgugcaucggcuccaucagaaaugggacauaugaucacgacguuuaccgcgacgaggcccugaacaaucgguuccagauuaagggcguggagcucaaaagcggauacaaggauuggauccuguggauuucuuuugcuaucuccugcuuccuucugugugucgcccuccugggcuuuauuaugugggccugccaaaaggggaacaucagauguaauaucugcauuuga

SEQ ID NO: 188356 - RNA, 1701 nt, Artificial Sequence
  derived and/or modified sequence opt5 from hemagglutinin__InfluenzaA__ADK87336
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauccgcagaucuaagaacuccuuuuucagcaaacugaauuggcucacacaucugaacuuuaaguauccugcccuuaaugucaccaugcccaacaacgagcaguucgacaaacuguacauuuggggcgugcaccauccugggacggaucgggaccagaucuuucucuaugcgcaagccucuggacgcauuacaguuuccaccaagagaagccagcagacagugaucccgaauauuggcucccggccccgcgucagaaacaucccuucucggaucagcauuuacuggaccaucgugaaacccggggauauucugcugaucaauuccaccggaaaccucauugcuccucgcggcuacuucaagaucagaagcgggaagucuuccaucaugcggagcgacacacccauuggaaaaucuaauagcgaguguaucacgccgaacggcuccauuccuaaugacaagcccuuucagaacgugaaucgcaucaccuauggcgccugcccuagauacgucaaacaaaacacacugaaacuugcuaccgggaugcggaauguucccgaaaaacagacacgcggaauuuucggcgccaucgcgggguuuaucgagaacggaugggaaggcaugguggaugggugguauggauucagacaccagaauagcgagggccggggccaagccgcugaccugaagucuacccaggccgcuauugaucagaucaacgggaaacucaauagacugauuggaaagacgaacgagaaguuccaccagaucgaaaaagaguuuuccgaaguggagggccgcauucaagaccuugaaaaguacgucgaggauacaaaaaucgaccuguggagcuauaacgccgagcuccugguggcccuggaaaaucagcauaccauugaucucaccgacucugagaugaacaagcuguucgaaaagacaaagaagcagcuucgggaggaugcugaagacauggggaauggauguuuuaaaaucuaccacaagugcgauaacgcguguaucggcuccauuagaaaugggaccuaugaccaugacguuuaccgcgaugaggcccugaacaaucgguuccagaucaaaggcguggagcucaagagcggauacaaagacuggauucuguggaucucuuuugcuauuuccugcuuccuucugugcgucgcccuccugggcuuuaucaugugggccugucaaaaggggaacaucagaugcaauauuuguaucuga

SEQ ID NO: 188357 - RNA, 1701 nt, Artificial Sequence; identical to SEQ ID NO: 185693
  derived and/or modified sequence opt5 from hemagglutinin__InfluenzaA__ADK87338

SEQ ID NO: 188358 - RNA, 1701 nt, Artificial Sequence
  derived and/or modified sequence opt5 from hemagglutinin__InfluenzaA__ADK90193
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagugguccuugugcuguggggaauccaccaccccuccaccucugccgaucaacagagccucuaccagaacgcugacgccuacguguucgucggcacauccagauauagcaagaaauuuaagccugaaauugcuauccggccgaaaguucgcgaucaggaggggagaaugaauuacuauuggacccugguggagcccggagacaagauuacguucgaagccacaggcaaccugguggucccucgguacgcguuugccauggagcgcaacgcugggucuggaaucauuaucuccgauacccccgugcaugacugcaauacaaccugucaaaccccuaaaggcgccaucaacacaagccuccccuuccagaauauucacccgaucacgauuggcaagugcccuaaguauguuaaaucuaccaagcugagacuugcuacagggcugcggaacgugcccagcauccagucccgcggacucuuuggcgccauugccggguucaucgaaggaggcuggaccgggauggucgacggaugguacggcuaucaucaccagaaugagcaaggcucuggguacgcugcggaucugaaaagcacacagaacgccaucgacgaaauuaccaauaaggugaacuccguuaucgagaaaaugaauacgcaguuuacagcugugggaaaggaguucaaccaccuugaaaagagaauugagaaucugaacaaaaaggucgaugacggcuuccucgauaucuggaccuacaaugccgaacugcuggugcuccuggagaacgaacggacccuugacuaucaugauagcaaugucaaaaaccuguacgagaaggugcgcucucagcucaaaaacaaugccaaggagauugggaacggauguuuugaguucuaucacaagugcgacaauacauguauggaguccguuaaaaacggcaccuacgauuauccuaaguacagcgaagaggcuaaacugaauagagaagagaucgacggggugaaacuugagucuacacggaucuaucaaauucuggccaucuacuccacggucgcgagcucccucgugcugguugugucucugggcgcuauuagcuuuuggaugugcuccaacggaucucuccagugccgcaucuguauuuga

SEQ ID NO: 188359 - RNA, 1701 nt, Artificial Sequence
  derived and/or modified sequence opt5 from hemagglutinin__InfluenzaA__ADK90194
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccaaguauagcaaaaaguuuaaaccugagauugcuaucagaccgaagguccgggaucaggaggggcgcaugaauuacuauuggacccugguugaacccggagacaaaauuacguucgaggccacaggcaaccugguggugccuagauacgcguuugccauggaacggaacgcugggucuggaaucauuaucuccgauacccccguccaugacugcaauacaaccugucaaaccccuaagggcgccaucaacacaagccuccccuuccagaauauucacccgaucacgauuggcaagugcccuaaauaugugaagucuaccaaacugcgccuugcuacagggcugagaaacguucccagcauccagucccggggacucuuuggcgccauugccggguucaucgagggaggcuggaccgggaugguggacggaugguacggcuaucaucaccagaaugaacaaggcucuggguacgcugcggaucuuaagagcacacagaacgccaucgacgagauuaccaauaaagucaacuccgugaucgagaagaugaauacgcaguuuacagcuguuggaaaggaguucaaccaccuggagaaacgcauugaaaaucugaacaagaaaaucgaugacggcuuccucgauauuuggaccuacaaugccgagcugcuggugcuccuggaaaacgagagaacccuugacuaucaugauagcaaugucaagaaccuguacgagaaagugcggucucagcucaagaacaaugccaaggaaaucgggaacggauguuuugaguucuaucacaaaugcgacaauacauguauggaauccgucaagaacggcaccuacgauuauccuaaauacagcgaggaagcuaagcugaaucgcgaggagaucgacggggugaaacuugaaucuacaagaauuuaucaaauccuggccauuuacuccacgguugcgagcucccucgugcuggucgugucucugggcgcuaucagcuuuuggaugugcuccaacggaucucuccagugccggauuuguaucuga

SEQ ID NO: 188360 - RNA, 1701 nt, Artificial Sequence
  derived and/or modified sequence opt5 from hemagglutinin__InfluenzaA__ADK90195
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucgucauuuccgauacccccgugcaugacugcaauacaaccugucaaaccccuaaaggcgccaucaacacaagccuccccuuccagaauauccacccgauuacgaucggcaagugcccuaaguauguuaaaucuaccaagcugagacuugcuacagggcugcggaacgugcccagcauucagucccgcggacucuuuggcgccaucgccggguucauugagggaggcuggaccgggauggucgacggaugguacggcuaucaucaccagaaugaacaaggcucuggguacgcugcggaucugaaaagcacacagaacgccaucgacgagaucaccaauaaggugaacuccguuauugagaaaaugaauacgcaguuuacagcugugggaaaggaguucaaccaccuugagaagagaaucgaaaaucugaacaaaaagauugaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 188361 - RNA, 1701 nt, Artificial Sequence; identical to SEQ ID NO: 185680
  derived and/or modified sequence opt5 from hemagglutinin__InfluenzaA__ADK90196

SEQ ID NO: 188362 - RNA, 1701 nt, Artificial Sequence
  derived and/or modified sequence opt5 from hemagglutinin__InfluenzaA__ADK90197
augagagccauccugggcgugcuccuguacaccuucgcuacagccaacgcggacacgcuuugcauuggguaucacgcuaauaacagcaccgauacagucgacaccguucuggagaagaaugugacagugacccauuccgucaaccuccuggaagauaaacacaauggaaagcuguguaaacugcggggcguggcgccccuccaucuggggaagugcaacaucgccggauggauucugggcaauccugagugugaaucucucagcacagcuuccucuuggagcuacaucguugagaccuccucuagcgacaacgggacgugcuauccgggagauuuuauugacuacgaagaacugcgcgagcagcuuuccagcgugucuuccuucgaaagauuugagaucuuccccaaaaccagcucuuggccuaaucacgauuccaacaagggcgucacagccgcuuguccccaugccggcgccaagagcuuuuauaaaaaucugaucuggcucgugaagaaagggaacucuuacccuaagcuguccaaaagcuauauuaaugacaagggaaaggaaguucuugugcuguggggcauccaccaccccuccaccucugccgaucaacagagccucuaccagaacgcugacgccuacgucuucguggggacaucccgguauagcaaaaaguuuaaaccugagauugcuauccgcccgaaggugagagaucaggagggacggaugaauuacuauuggacccuggucgaacccggcgacaaaauuacguucgaggccacagggaaccugguugugccucgcuacgcguuugccauggaaagaaacgcuggaucuggcaucauuaucuccgauacccccgugcaugacugcaauacaaccugucaaaccccuaagggcgccaucaacacaagccuccccuuccagaauauucacccgaucacgauugggaaaugcccuaaguaugucaagucuaccaaacugcggcuugcuacaggacugcgcaacgugcccagcauccaguccagaggccucuuuggggccauugccggauucaucgagggcggguggaccggaaugguugacggcugguacggcuaucaucaccagaaugaacaagggucuggauacgcugcggaucuuaagagcacacagaacgccaucgacgagauuaccaauaaagugaacuccgucaucgagaagaugaauacgcaguuuacagcugugggcaaagaguucaaccaccuugagaagcggauugaaaaucugaacaagaaaguugaugacggguuccucgauaucuggaccuacaaugccgagcugcuggugcuccuggaaaacgagcgcacccuugacuaucaugauagcaaugucaagaaccuguacgagaaagugagaucucagcucaagaacaaugccaaagaaauuggaaacggcuguuuugaguucuaucacaagugcgacaauacauguauggaauccgucaagaacgggaccuacgauuauccuaaauacagcgaggaagcuaagcugaaucgggaggagaucgacggcgugaaacuugaaucuacacgcaucuaucaaauucuggccaucuacuccacgguugcgagcucccucgugcuggucgugucucugggagcuauuagcuuuuggaugugcuccaacggcucucuccagugcagaaucuguauuuga

SEQ ID NO: 188363 - RNA, 1701 nt, Artificial Sequence
  derived and/or modified sequence opt5 from hemagglutinin__InfluenzaA__ADK90198
augaaggccauccugggcgugcuccuguacaccuucgcuacagccaacgcggacacgcuuugcauuggguaucacgcuaauaacagcaccgauacagucgacaccguucuggagaagaaugugacagugacccauuccgucaaccuccuggaagauaagcacaauggaaaacuuuguaagcugagaggcguggcuccccuccaucuggggaaaugcaacaucgccggauggauucugggcaauccugagugugaaucucucagcacagccuccucuuggagcuacaucguugagaccuccucuagcgacaacgggacgugcuauccgggagauuuuauugacuacgaagaacugcgggagcagcuuuccagcgugucuuccuucgaacgcuuugagaucuuccccaagaccagcucuuggccuaaucacgauuccaacaagggcgucacagccgcuuguccccaugccggcgcgaaaucuuuuuauaagaaucugaucuggcucgugaaaaaggggaacagcuacccuaaacuguccaagagcuauauuaaugacaagggaaaagaaguucuugugcuguggggcauccaccaccccuccaccucugccgaucaacagagccucuaccagaacgcugacgccuacgucuucguggggacauccagauauagcaagaaauuuaagccugagauugcuauccggccgaaagugcgcgaucaggagggaagaaugaauuacuauuggacccuggucgaacccggcgacaagauuacguucgaggccacagggaaccugguugugccucgguacgcguuugccauggaacgcaacgcuggaucuggcaucauuaucuccgauacccccgugcaugacugcaauacaaccugucaaaccccuaaaggcgccaucaacacaagccuccccuuccagaauauucacccgaucacgauugggaagugcccuaaguaugucaaaucuaccaagcugagacuugcuacaggacugcggaacgugcccagcauccagucccgcggccucuuuggggccauugccggauucaucgagggcggguggaccggaaugguugacggcugguacggcuaucaucaccagaaugaacaagggucuggauacgcugcggaucugaaaagcacacagaacgccaucgacgagauuaccaauaaggugaacuccgucaucgagaaaaugaauacgcaguuuacagcugugggcaaggaguucaaccaccuugagaagagaauugaaaaucugaacaaaaagguugaugacggguuccucgauaucuggaccuacaaugccgagcugcuggugcuccuggaaaacgagcggacccuugacuaucaugauagcaaugucaaaaaccuguacgagaaggugcgcucucagcucaaaaacaaugccaaggaaauuggaaacggcuguuuugaguucuaucacaagugcgacaauacauguauggaauccgucaaaaacgggaccuacgauuauccuaaguacagcgaggaagcuaaacugaauagagaggagaucgacggcgugaaacuugaaucuacacggaucuaucaaauucuggccaucuacuccacgguugcgagcucccucgugcuggucgugucucugggagcuauuagcuuuuggaugugcuccaacggcucucuccagugccgcaucuguauuuga

SEQ ID NO: 188364 - RNA, 1701 nt, Artificial Sequence; identical to SEQ ID NO: 185693
  derived and/or modified sequence opt5 from hemagglutinin__InfluenzaA__ADK90199

SEQ ID NO: 188365 - RNA, 1701 nt, Artificial Sequence
  derived and/or modified sequence opt5 from hemagglutinin__InfluenzaA__ADK90200
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauugccuucgaggcgacgggcaaccugguggugccucgguacgccuuugcuauggaacgcaacgccgggucuggaaucauuaucuccgauacacccguccaugacugcaauaccacaugucaaaccccuaaaggcgcuaucaacaccagccuccccuuccagaauauucacccgaucacaauuggcaagugcccuaaguaugugaaaucuacgaagcugagacuugccaccgggcugcggaacguucccagcauccagucccgcggacucuuuggcgccauugcuggguucaucgagggaggcuggacagggaugguggacggaugguacggcuaucaucaccagaaugaacaaggcucuggguacgcggccgaucugaaaagcacccagaacgcuaucgacgagauuacaaauaaggucaacuccgugaucgagaaaaugaauacccaguuuacggccguuggaaaggaguucaaccaccuugagaagagaauugaaaaucugaacaaaaagguggaugacggcuuccucgauaucuggacauacaaugccgagcugcugguccuccuggaaaacgagcggacccuugacuaucaugauagcaaugugaaaaaccuguacgagaagguccgcucucagcucaaaaacaaugcuaaggaaauugggaacggauguuuugaguucuaucacaagugcgacaauaccuguauggaauccgugaaaaacggcacauacgauuauccuaaguacagcgaggaagccaaacugaauagagaggagaucgacgggguuaaacuugaaucuacccggaucuaucaaauucuggcgguguacuccacagucgcuagcucccucgugcugguugugucucugggcgccaucagcuuuuggaugugcuccaacggaucucuccagugccgcauuuguaucuga

SEQ ID NO: 188366 - RNA, 1701 nt, Artificial Sequence
  derived and/or modified sequence opt5 from hemagglutinin__InfluenzaA__ADK90201
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuguccggccgaaaguucgcgaucaggaggggagaaugaauuacuauuggacccugguggaacccggagacaagaucacguucgaggccacaggcaaccugguggucccucgguacgcguuugccauggaacgcaacgcugggucuggaauuaucauuuccgauacccccgugcaugacugcaauacaaccugucaaaccccuaaaggcgccaucaacacaagccuccccuuccagaauauccacccgauuacgaucggcaagugcccuaaguauguuaaaucuaccaagcugagacuugcuacagggcugcggaacgugcccagcauucagucccgcggacucuuuggcgccaucgccggguucauugagggaggcuggaccgggauggucgacggaugguacggcuaucaucaccagaaugaacaaggcucuggguacgcugcggaucugaaaagcacacagaacgccaucgacgagaucaccaauaaggugaacuccguuauugagaaaaugaauacgcaguuuacagcugugggaaaggaguucaaccaccuugagaagagaaucgaaaaucugaacaaaaaggucgaugacggcuuccucgauauuuggaccuacaaugccgagcugcuggugcuccuggaaaacgagcggacccuugacuaucaugauagcaaugucaaaaaccuguacgagaaggugcgcucucagcucaaaaacaaugccaaggaaaucgggaacggauguuuugaguucuaucacaagugcgacaauacauguauggaauccguuaaaaacggcaccuacgauuauccuaaguacagcgaggaagcuaaacugaauagagaggagauugacggggugaaacuugaaucuacacggaucuaucaaauccuggccauuuacuccacggucgcgagcucccucgugcugguugugucucugggcgcuaucagcuuuuggaugugcuccaacggaucucuccagugccgcauuuguaucuga

SEQ ID NO: 188367 - RNA, 1701 nt, Artificial Sequence
  derived and/or modified sequence opt5 from hemagglutinin__InfluenzaA__ADK90202
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaccgcucucuacagccagcuccuggucuuacaucguggagaccagcuccucugacaacggcacgugcuaucccggggauuuuauugacuacgaggaacugcgggagcagcuuagcuccgucagcucuuucgaacgccuggagaucuuuccuaagaccuccagcuggcccaaucacgauucuaacaagggagugacagccgcuuguccucaugccggcgcgaaauccuucuauaagaaucucaucuggcugguuaaaaagggcaacagcuaccccaaacuuucuaaguccuauauuaaugacaaggggaaagaagugcugguccucuggggaauccaccacccuagcaccuccgccgaucaacagucucuguaccagaacgcugacgccuacguguuugugggcacaagcagauauuccaagaaauucaagccggagauugcuauccggcccaaaguccgcgaucaggaggggagaaugaauuacuauuggacccugguugaaccuggagacaagauuacguuugaggccacaggcaaccucguggugccccgguacgcguucgccauggaacgcaacgcugggagcggaaucauuaucucugauaccccuguccaugacugcaauacaaccugucaaacccccaacggcgccaucaauacaucccugccguuucagaacauucacccuaucacgauuggcaaaugccccaaguauguuaagagcaccaaacuuagacuggcuacagggcuccggaaugugccuucuauccagagccgcggacuguucggcgccauugccggguuuaucgagggaggcuggaccgggaugguggacggaugguacggcuaucaucaccagaacgaacaaggcuccggguacgcugcggaucuuaagucuacacagaaugccaucgacgagauuaccaacaaagucaauagcgugaucgagaagaugaacacgcaguucacagcuguuggaaaagaauuuaaucaccuggagaagagaauugaaaaccucaauaagaaaguggaugacggcuuccuggauaucuggaccuacaacgccgagcugcucguccugcuugaaaaugagcggacccuggacuaucaugauuccaacgugaagaaccucuacgagaaaguccgcagccagcugaagaauaacgccaaagaaauugggaauggauguuucgaguuuuaucacaagugcgacaacacauguauggaaucugugaagaauggcaccuacgauuaucccaaauacuccgaggaagcuaaacuuaacagagaggagaucgacgggguuaagcuggaaagcacacggaucuaucaaauucucgccaucuacucuacgguggcguccagccugguccuggugguuucccucggcgcuauuucuuucuggaugugcagcaauggaucccugcagugccgcaucuguauuuga

SEQ ID NO: 188368 - RNA, 1701 nt, Artificial Sequence; identical to SEQ ID NO: 185873
  derived and/or modified sequence opt5 from hemagglutinin__InfluenzaA__ADK90203

SEQ ID NO: 188369 - RNA, 1701 nt, Artificial Sequence; identical to SEQ ID NO: 186794
  derived and/or modified sequence opt5 from hemagglutinin__InfluenzaA__ADK90204

SEQ ID NO: 188370 - RNA, 1701 nt, Artificial Sequence
  derived and/or modified sequence opt5 from hemagglutinin__InfluenzaA__ADK94191
augaagaccaucauugcccugagcuacauccucugccugguguucgcucagaaacuucccggcaacgacaauuccacagccacgcugugucucgggcaccaugcggucccuaacggaaccguugugaagacaauuaccaaugaucaaaucgaggugacaaacgcuaccgaacugguccagucuagcuccacaggcgagauuugcgacucuccgcaccagauccuugaugggaaaaauuguacccugaucgacgcccuccugggagauccccagugcgacggcuuucaaaacaagaaaugggaucuguucguggaaagaagcaaggccuauuccaauuguuacccuuaugacguucccgauuacgcuucucuccggagccugguggccuccagcgggacgcuugaguuuaacaaugaaucuuucaacuggaccggagucacacagaauggcaccuccagcgcuugcauucgcagaucuaagaacuccuuuuucagccggcugaauuggcucacacaucugaacuuuaaauauccugcccuuaaugugaccaugcccaacaacgagcaguucgacaagcuguacaucuggggcguucaccauccugggacggauaaagaccagauuuuucucuaugcgcaagccucuggacgcaucacaguguccaccaagagaagccagcagacagucauuccgaauaucggcucccggccccgcgugagaaacauuccuucucgggugagcaucuacuggaccaucgucaaacccggggauauucugcugaucaauuccaccggaaaccucauugcuccucgcggcuacuucaagaucagaagcgggaagucuuccauuaugcggagcgacgcccccaucggaaaauguaauucugagugcaucacaccgaacggcagcauuccuaaugacaagcccuuucagaacguuaaucgcaucacguauggcgcuuguccuagauacgugaaacaaaacacccugaaacuugccacagggaugcggaaugugcccgaaaaacagacccgcggaauuuucggcgcgaucgccggguuuauugagaacggaugggaaggcauggucgaugggugguauggauucagacaccaaaauuccgagggccggggccaggcugccgaccugaagucuacacaggcugccaucgaucagaucaacgggaaacucaauagacugauuggaaagaccaacgagaaguuccaccagaucgaaaaagaguuuagcgaaguggagggccgcauucaagaccuugaaaaguacguugaggauacgaaaaucgaccugugguccuauaacgccgagcuccugguggcucuggaaaaucagcauacaauugaucucaccgacagcgagaugaacaagcuguucgaaaagaccaagaagcagcuucgggagaaugcggaagauauggggaacggaugcuuuaaaaucuaccacaagugugacaaugccugcauuggcucuaucagaaacgggacauaugaucaugacgucuaccgcgacgaggcucugaauaaccgguuccagaucaaaggcguggagcucaaguccggauacaaagauuggauucuguggaucagcuuugccauuucuugcuuccuucuguguguugcccuccugggcuuuaucaugugggcuugccaaaaggggaauauuagauguaacaucugcaucuga

SEQ ID NO: 188371 - RNA, 1701 nt, Artificial Sequence
  derived and/or modified sequence opt5 from hemagglutinin__InfluenzaA__ADK94202
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugaucgccuccagcgggacgcuugaauuuaacaaugagucuuucaacuggaccggaguuacacagaauggcaccuccagcgcuugcauucgcagaucuaacaauuccuuuuucagccggcugaacuggcucacacaucugaaguuuaaguauccugcccuuaaugugaccaugcccaacaacgagcaguucgacaaacuguacaucuggggcguccaccauccugggacggauaaugaccagauuuuucucuaugcgcaagccucuggacgcaucacaguguccaccaagagaagccagcagacaguuauuccgaacaucggcucccggccccgcgugagaaauaucccuucucggauuagcaucuacuggaccauugucaaacccggggauauccugcugauuaacuccaccggaaaucucaucgcuccucgcggcuacuucaagaucagaagcgggaaaucuuccauuaugcggagcgacgcccccaucggaaaguguaacucugaaugcauuacaccgaauggcagcaucccuaacgacaagcccuuucagaaugugaaccgcauuacguauggcgcuuguccuagauacgugaaacaaaauacccugaaacuugccacagggaugcggaacguccccgagaagcagacccgcggaaucuucggcgcgaucgccggguuuauugaaaauggaugggagggcaugguugaugggugguauggauucagacaccagaacuccgagggccggggccaagcugccgaccugaagucuacacaggcugccaucgaucagauuaaugggaaacucaacagacugaucggaaagaccaacgaaaaauuccaccagauugagaaggaauuuagcgagguggaaggccgcauccaagaccuugagaaguacguggaggauacgaaaauugaccugugguccuauaaugccgaacuccuggucgcucuggagaaccagcauacaaucgaucucaccgacagcgaaaugaauaagcuguucgagaaaaccaagaaacagcuucgggaaaacgcggaggauauggggaauggaugcuuuaagaucuaccacaagugugacaacgccugcauuggcucuaucagaaaugggacauaugaucaugacguguaccgcgacgaggcucugaacaaucgguuccagauuaaaggcguugaacucaaguccggauacaaagauuggauccuguggauuagcuuugccaucucuugcuuccuucuguguguggcccuccugggcuuuaucaugugggcuugccaaaaggggaacauuagauguaauaucugcauuuga

SEQ ID NO: 188372 - RNA, 1701 nt, Artificial Sequence; identical to SEQ ID NO: 185458
  derived and/or modified sequence opt5 from hemagglutinin__InfluenzaA__ADK94213

SEQ ID NO: 188373 - RNA, 1701 nt, Artificial Sequence; identical to SEQ ID NO: 186637
  derived and/or modified sequence opt5 from hemagglutinin__InfluenzaA__ADK94224

SEQ ID NO: 188374 - RNA, 1701 nt, Artificial Sequence
  derived and/or modified sequence opt5 from hemagglutinin__InfluenzaA__ADK94257
auggagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaagugacaaacgcuaccgagcuggugcagucuagcuccacaggcgaaaucugcgacucuccgcaccagauccuugaugggaagaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaagaacuccuuuuucagccggcugaauuggcucacacaucugaacuuuaaguauccugcccuuaaugucaccaugcccaacaacgagcaguucgacaaacuguacauuuggggcgugcaccauccugggacggauaaggaccagaucuuucucuaugcgcaagccucuggacgcauuacaguuuccaccaaaagaagccagcagacagugaucccgaauauuggcucccggccccgcgucagaaacaucccuucucggaucagcauuuacuggaccaucgugaagcccggggauauucugcugaucaauuccaccggaaaccucauugcuccucgcggcuacuucaaaaucagaagcgggaagucuuccaucaugcggagcgacgcccccauuggaaaguguaauucugaaugcaucacaccgaacggcagcauuccuaaugacaaacccuuucagaacgugaaucgcaucacguauggcgcuuguccuagauacgucaagcaauccacccugaaacuugccacagggaugcggaacguucccgagaagcagacccgcggaauuuucggcgcgaucgccggguuuaucgaaaauggaugggagggcaugguggaugggugguauggauucagacaccagaacucugagggccggggccaagcugccgaccugaaaagcacacaggcugccauugaucagaucaaugggaagcucaacagacugauuggaaaaaccaaugaaaaguuccaccagaucgagaaggaauuuuccgagguggaaggccgcauucaagaccuugagaaauacgucgaggauacgaagaucgaccuguggagcuauaacgccgaacuccugguggcucuggagaaccagcauacaauugaucucaccgacucugaaaugaauaaacuguucgagaagaccaaaaagcagcuucgggaaaacgcggaggauauggggaauggaugcuuuaagaucuaccacaaaugugacaacgccugcaucggcuccauuagaaaugggacauaugaucaugacguuuaccgcgacgaggcucugaacaaucgguuccagaucaagggcguggaacucaaaagcggauacaaggauuggauucuguggaucucuuuugccauuuccugcuuccuucugugugucgcccuccugggcuuuaucaugugggcuugccaaaaagggaacaucagauguaauauuugcaucuga

SEQ ID NO: 188375 - RNA, 1701 nt, Artificial Sequence
  derived and/or modified sequence opt5 from hemagglutinin__InfluenzaA__ADK94268
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauccgcagaucuaagaacuccuuuuucagccggcugaauuggcucacacaucugaacuuuaaauauccugcccuuaaugucaccaugcccaacaacgagcaguucgacaagcuguacauuuggggcgugcaccauccugggacggauaaagaccagaucuuucucuaugcgcaagccucuggacgcauuacaguuuccaccaagagaagccagcagacagugaucccgaauauuggcucccggccccgcgucagaaacaucccuucucggaucagcauuuacuggaccaucgugaaacccggggauauucugcugaucaauuccaccggaaaccucauugcuccucgcggcuacuucaagaucagaagcgggaagucuuccaucaugcggagcgacgcccccauuggaaaauguaauucugagugcaucacaccgaacggcagcauuccuaaugacaagcccuuucagaacgugaaucgcaucacguauggcgcuuguccuagauacgucaaacaauccacccugaaacuugccacagggaugcggaacguucccgaaaaacagacccgcggaauuuucggcgcgaucgccggguuuaucgagaauggaugggaaggcaugguggaugggugguauggauucagacaccagaacucugagggccggggccaagcugccgaccucaagagcacacaggcugccauugaucagaucaaugggaaacugaacagacugauuggaaagaccaaugagaaguuccaccagaucgaaaaagaguuuuccgaaguggagggccgcauucaagaccuugaaaaguacgucgaggauacgaaaaucgaccuguggagcuauaacgccgagcuccugguggcucuggaaaaccagcauacaauugaucucaccgacucugagaugaauaagcuguucgaaaagaccaagaagcagcuucgggagaacgcggaagauauggggaauggaugcuuuaaaaucuaccacaagugugacaacgccugcaucggcuccauuagaaaugggacauaugaucaugacguuuaccgcgacgaggcucugaacaaucgguuccagaucaaaggcguggagcucaagagcggauacaaagauuggauucuguggaucucuuuugccauuuccugcuuccuucugugugucgcccuccugggcuuuaucaugugggcuugccaaaaggggaacaucagauguaauauuugcaucuga

SEQ ID NO: 188376 - RNA, 1701 nt, Artificial Sequence
  derived and/or modified sequence opt5 from hemagglutinin__InfluenzaA__ADK94279
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagccuauuccaacuguuacccuuaugaugugcccgacuacgcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaucugaaguuuaaguauccugcccuuaacgucaccaugcccaacaaugagcaguucgauaaacuguacauuuggggcgugcaccauccugggacggacaacgaucagaucuuucucuaugcgcaagccucuggacgcauuacaguuuccaccaagagaagccagcagacagugaucccgaauauuggcucccggccccgcgucagaaacaucccuucucggaucagcauuuacuggaccaucgugaaacccggggacauucugcugaucaauuccaccggaaaccucauugcuccucgcggcuacuucaagaucagaagcgggaaaucuuccaucaugcggagcgaugcccccauuggaaaguguaauucugaaugcaucacaccgaacggcagcauuccuaaugacaagcccuuucagaacgugaaucgcaucacguauggcgcuuguccuagauacgucaaacaaaacacccugaaacuugccacagggaugcggaauguucccgagaagcagacccgcggaauuuucggcgcgaucgccggguuuaucgaaaacggaugggagggcaugguggacgggugguauggauucagacaccaaaauuccgagggccggggccaggcugccgaucugaagucuacacaggcugccauugaccagaucaacgggaaacucaacagacugauuggaaagaccaaugaaaaauuccaccagaucgagaaggaauuuagcgagguggaaggccgcauucaagaucuugagaaguacgucgaggacacgaaaaucgaucugugguccuauaacgccgaacuccugguggcucuggagaaucagcauacaauugaccucaccgauagcgaaaugaacaagcuguucgagaaaaccaagaaacagcuucgggaaaaugcggaggacauggggaacggaugcuuuaagaucuaccacaagugugauaaugccugcaucggcucuauuagaaacgggacauaugaccaugauguuuaccgcgacgaggcucugaauaaccgguuccagaucaaaggcguggaacucaaguccggauacaaagacuggauucuguggaucagcuuugccauuucuugcuuccuucugugugucgcccuccugggcuuuaucaugugggcuugccaaaaggggaauaucagauguaacauuugcaucuga

SEQ ID NO: 188377 - RNA, 1701 nt, Artificial Sequence; identical to SEQ ID NO: 186637
  derived and/or modified sequence opt5 from hemagglutinin__InfluenzaA__ADK94290

SEQ ID NO: 188378 - RNA, 1701 nt, Artificial Sequence; identical to SEQ ID NO: 186637
  derived and/or modified sequence opt5 from hemagglutinin__InfluenzaA__ADK94301

SEQ ID NO: 188379 - RNA, 1701 nt, Artificial Sequence
  derived and/or modified sequence opt5 from hemagglutinin__InfluenzaA__ADK94323
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauccgcagaucuaagaacuccuuuuucagccggcugaauuggcucacacaucugaacuuuaaauauccugcccuuaaugucaccaugcccaacaacgagcaguucgacaagcuguacauuuggggcgugcaccauccugggacggauaaagaccagaucuuucucuaugcgcaagccucuggacgcauuacaguuuccaccaagagaagccagcagacagugaucccgaauauuggcucccggccccgcaucagaaacaucccuucucggauuagcaucuacuggaccauugucaaacccggggauauccugcugauuaauuccaccggaaaccucaucgcuccucgcggcuacuucaagaucagaagcgggaagucuuccauuaugcggagcgacgcccccaucggaaaauguaauucugagugcauuacaccgaacggcagcaucccuaaugacaagcccuuucagaacgugaaucgcauuacguauggcgcuuguccuagauacgugaaacaaaacacccugaaacuugccacagggaugcggaauguccccgaaaaacagacccgcggaaucuucggcgcgaucgccggguuuauugagaacggaugggaaggcaugguugaugggugguauggauucagacaccaaaauuccgagggccggggccaggcugccgaccugaagucuacacaggcugccaucgaucagauuaacgggaaacucaauagacugaucggaaagaccaacgagaaguuccaccagauugaaaaagaguuuagcgaaguggagggccgcauccaagaccuugaaaaguacguggaggauacgaaaauugaccugugguccuauaacgccgagcuccuggucgcucuggaaaaucagcauacaaucgaucucaccgacagcgagaugaacaagcuguucgaaaagaccaagaagcagcuucgggagaaugcggaagauauggggaacggaugcuuuaaaaucuaccacaagugugacaaugccugcauuggcucuaucagaaacgggacauaugaucaugacguguaccgcgacgaggcucugaauaaccgguuccagauuaaaggcguugagcucaaguccggauacaaagauuggauccuguggauuagcuuugccaucucuugcuuccuucuguguguggcccuccugggcuuuaucaugugggcuugccaaaaggggaauauuagauguaacaucugcauuuga

SEQ ID NO: 188380 - RNA, 1701 nt, Artificial Sequence; identical to SEQ ID NO: 188370
  derived and/or modified sequence opt5 from hemagglutinin__InfluenzaA__ADK94441

SEQ ID NO: 188381 - RNA, 1701 nt, Artificial Sequence
  derived and/or modified sequence opt5 from hemagglutinin__InfluenzaA__ADK94476
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggcccauuccaauuguuauccuuacgacgugcccgauuaugcuucucuccggagccugguugccuccagcgggacgcuugaguuuaacaaugaaucuuucaacuggaccggagugacacagaauggcaccuccagcgcuugcauccgcagaucuaagaacuccuuuuucagccggcugaauuggcucacacaccugaacuuuaaauacccugcccuuaaugucaccaugcccaacaacgagcaguucgacaagcuguauauuuggggcgcgcaucacccugggacggauaaagaccagaucuuucucuacgcccaggcuucuggacgcauuacaguguccaccaagagaagccagcagacaguuaucccgaauauuggcucccggccccgcgugagaaacaucccuucucggaucagcauuuauuggaccaucgucaaacccggggauauucugcugaucaauuccaccggaaaccucauugccccucgcggcuacuucaagaucagaagcgggaagucuuccaucaugcggagcgacgcucccauuggaaaauguaauucugagugcaucacaccgaacggcagcauuccuaaugacaagcccuuucagaacgugaaucgcaucacguacggcgccuguccuagauaugugaaacaaaacacccugaaacuugcgacagggaugcggaauguccccgaaaaacagacccgcggaauuuucggcgccaucgcuggguuuaucgagaacggaugggaaggcaugguugaugggugguacggauucagacaccaaaauuccgagggccggggccaagccgcugaccugaagucuacacaggccgccauugaucagaucaacgggaaacucaauagacugauuggaaagaccaacgagaaguuccaucagaucgaaaaagaguuuagcgaaguggagggccgcauucaagaccuugaaaaguauguggaggauacgaaaaucgaccugugguccuacaacgcugagcuccuggucgcgcuggaaaaucagcacacaauugaucucaccgacagcgagaugaacaagcuguucgaaaagaccaagaagcagcuucgggagaaugccgaagauauggggaacggaugcuuuaaaaucuaucauaagugugacaaugcuugcaucggcucuauuagaaacgggacauacgaucacgacguguaucgcgacgaggcccugaauaaccgguuccagaucaaaggcguugagcucaaguccggauacaaagauuggauucuguggaucagcuuugccauuucuugcuuccuucuguguguggcucuccugggcuuuaucaugugggccugccaaaaggggaauaucagauguaacauuugcaucuga

SEQ ID NO: 188382 - RNA, 1701 nt, Artificial Sequence; identical to SEQ ID NO: 186637
  derived and/or modified sequence opt5 from hemagglutinin__InfluenzaA__ADK94487

SEQ ID NO: 188383 - RNA, 1701 nt, Artificial Sequence
  derived and/or modified sequence opt5 from hemagglutinin__InfluenzaA__ADK94498
augaagaccaucauugcccugagcuacauccucugccugguguucgcucagaaacuucccggcaacgacaauuccacagccacgcugugucucgggcaccaugcggucccuaacggaaccguugugaagacaauuaccaaugaucaaaucgaggugacaaacgcuaccgaacugguccagucuagcuccacaggcgagauuugcgacucuccgcaccagauccuugaugggaaaaauuguacccugaucgacgcccuccugggagauccccagugcgacggcuuucaaaacaagaaaugggaucuguucguggaaagaagcaaggccuauuccaauuguuacccuuaugacguucccgauuacgcuucucuccggagccugguggccuccagcgggacgcuugaguuuaacaaugaaucuuucaacuggaccggagucacacagaauggcaccuccagcgcuugcauucgcagaucuaagaacuccuuuuucagccggcugaauuggcucacacaucugaacuuuaaauauccugcccuuaaugugaccaugcccaacaacgagcaguucgacaagcuguacaucuggggcguucaccauccugggacggauaaagaccagauuuuucucuaugcgcaagccucuggacgcaucacaguguccaccaagagaagccagcagacagucauuccgaauaucggcucccggccccgcgugagaaacauuccuucucggaucagcaucuacuggaccauugugaaacccggggauauccugcugauuaauuccaccggaaaccucaucgcuccucgcggcuacuucaagauuagaagcgggaagucuuccaucaugcggagcgacgcccccaucggaaaauguaauucugagugcauuacaccgaacggcagcaucccuaaugacaagcccuuucagaacgucaaucgcauuacguauggcgcuuguccuagauacguuaaacaaaacacccugaaacuugccacagggaugcggaaugugcccgaaaaacagacccgcggaaucuucggcgcgauugccggguuuaucgagaacggaugggaaggcaugguggaugggugguauggauucagacaccaaaauuccgagggccggggccaggcugccgaccugaagucuacacaggcugccaucgaucagauuaacgggaaacucaauagacugaucggaaagaccaacgagaaguuccaccagauugaaaaagaguuuagcgaagucgagggccgcauccaagaccuugaaaaguacguggaggauacgaaaauugaccugugguccuauaacgccgagcuccugguugcucuggaaaaucagcauacaaucgaucucaccgacagcgagaugaacaagcuguucgaaaagaccaagaagcagcuucgggagaaugcggaagauauggggaacggaugcuuuaaaauuuaccacaagugugacaaugccugcaucggcucuaucagaaacgggacauauaaucaugauguguaccgcgacgaggcucugaacaaucgguuccagauuaaaggcgucgagcucaaguccggauacaaagacuggauccuguggauuagcuuugccaucucuugcuuccuucuguguguggcccuccugggcuuuauuaugugggcuugccaaaaggggaacaucagauguaauaucugcauuuga

SEQ ID NO: 188384 - RNA, 1701 nt, Artificial Sequence
  derived and/or modified sequence opt5 from hemagglutinin__InfluenzaA__ADK94509
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauccgcagaucuaagaacuccuuuuucagccggcugaauuggcucacacaucugaacuuuaaauauccugcccuuaaugucaccaugcccaacaacgagcaguucgacaagcuguacauuuggggcgugcaccauccugggacggauaaagaccagaucuuucucuaugcgcaagccucuggacgcauuacaguuuccaccaagagaagccagcagacagcuaucccgaauauuggcucccggccccgcgugagaaacaucccuucucggaucagcauuuacuggaccaucgucaaacccggggauauucugcugaucaauuccaccggaaaccucauugccccucgcggcuacuucaagaucagaagcgggaagucuuccaucaugcggagcgacgcucccauuggaaaauguaauucugagugcaucacaccgaacggcagcauuccuaaugacaagcccuuucagaacgugaaucgcaucacguauggcgccuguccuagauacauuaaacaaaacacccugaaacuugcgacagggaugcggaaugugcccgaaaaacagacccgcggaaucuucggcgccaucgcuggguuuauugagaacggaugggaaggcauggucgaugggugguauggauucagacaccaaaauuccgagggccggggccaggccgcugaccugaagucuacacaggccgccaucgaucagauuaacgggaaacucaauagacugaucggaaagaccaacgagaaguuccaccagauugaaaaagaguuuagcgaaguugagggccgcauccaagaccuugaaaaguacguggaggauacgaaaauugaccugugguccuauaacgcugagcuccugguggcgcuggaaaaucagcauacaaucgaucucaccgacagcgagaugaacaagcuguucgaaaagaccaagaagcagcuucgggagaaugccgaagauauggggaacggaugcuuuaaaaucuaccacaagugugacaaugcuugcauuggcucuaucagaaacgggacauaugaucaugacgucuaccgcgacgaggcccugaauaaccgguuccagauuaaaggcguggagcucaaguccggauacaaagauuggauccuguggauuagcuuugccaucucuugcuuccuucuguguguugcucuccugggcuuuaucaugugggccugccaaaaggggaauauuagauguaacaucugcauuuga

SEQ ID NO: 188385 - RNA, 1701 nt, Artificial Sequence
  derived and/or modified sequence opt5 from hemagglutinin__InfluenzaA__ADK94520
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugaucgccuccagcgggacgcuugaauuuaacaaugagucuuucaacuggaccggaguuacacagaauggcaccuccagcgcuugcauucgcagaucuaacaauuccuuuuucagccggcugaacuggcucacacaucugcgcuuuaaguauccugcccuuaaugugaccaugcccaacaacgagcaguucgacaagcuguacaucuggggcguccaccauccugggacggauaaugaccagauuuuucucuaugcgcaagccucuggaagaaucacaguguccaccaaacggagccagcagacaguuauuccgaacaucggcucccgccccagagugcggaauaucccuucucgcauuagcaucuacuggaccauugucaagcccggggauauccugcugauuaacuccaccggaaaucucaucgcuccuagaggcuacuucaaaauccggagcgggaagucuuccauuaugcgcagcgacgcccccaucggaaaauguaacucugaaugcauuacaccgaauggcagcaucccuaacgacaagcccuuucagaaugugaacagaauuacguauggcgcuuguccucgguacgugaagcaaaauacccugaaacuugccacagggaugcgcaacguccccgagaagcagaccagaggaaucuucggcgcgaucgccggguuuauugaaaauggaugggagggcaugguugaugggugguauggauuccggcaccagaacuccgagggcagaggccaagcugccgaccugaaaucuacacaggcugccaucgaucagauuaaugggaagcucaaccgccugaucggaaaaaccaacgaaaaguuccaccagauugagaaagaauuuagcgagguggaaggccggauccaagaccuugagaaguacguggaggauacgaagauugaccugugguccuauaaugccgaacuccuggucgcucuggagaaccagcauacaaucgaucucaccgacagcgaaaugaauaaacuguucgagaagaccaaaaagcagcuuagagaaaacgcggaggauauggggaauggaugcuuuaaaaucuaccacaagugugacaacgccugcauuggcucuauccgcaaugggacauaugaucaugacguguaccgggacgaggcucugaacaauagauuccagauuaagggcguugaacucaaauccggauacaaggauuggauccuguggauuagcuuugccaucucuugcuuccuucuguguguggcccuccugggcuuuaucaugugggcuugccaaaaagggaacauuaaguguaauaucugcauuuga

SEQ ID NO: 188386 - RNA, 1701 nt, Artificial Sequence; identical to SEQ ID NO: 186637
  derived and/or modified sequence opt5 from hemagglutinin__InfluenzaA__ADK94531

SEQ ID NO: 188387 - RNA, 1701 nt, Artificial Sequence; identical to SEQ ID NO: 185458
  derived and/or modified sequence opt5 from hemagglutinin__InfluenzaA__ADK94542

SEQ ID NO: 188388 - RNA, 1701 nt, Artificial Sequence
  derived and/or modified sequence opt5 from hemagglutinin__InfluenzaA__ADK94553
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauccgcagaucuaagaacuccuuuuucagccggcugaauuggcucacacaucugaacuuuaaauauccugcccuuaaugucaccaugcccaacaacgagcaguucgacaagcuguacauuuggggcgugcaccauccugggacggauaaagaccagaucuuucucuaugcgcaagccucuggacgcauuacaguuuccaccaagagaagccagcagacagugaucccgaauauuggcucccggccccgcgucagaaacaucccuucucggaucagcauuuacuggaccaucgugaaacccggggauauucugcugaucaauuccaccggaaaccucauugcuccucgcggcuacuucaagaucagaagcgggaagucuuccaucaugcggagcgacgcccccauuggaaaauguaauucugagugcaucacaccgaacggcagcauuccuaaugacaagcccuuucagaacgugaaucgcaucacguauggcgcuuguccuagauacgucaaacaauccacccugaaacuugccacagggaugcggaacguucccgaaaaacagacccgcggaauuuucggcgcgaucgccggguuuaucgagaauggaugggaaggcaugguggaugggugguauggauucagacaccagaacucugagggccggggccaagcugccgaccucaagagcacacaggcugccauugaucagaucaaugggaaacugaacagacugauuggaaagaccaaugagaaguuccaccagaucgaaaaagaguuuuccgaaguggagggccgcauucaagaccuugaaaaguacgucgaggauacgaaaaucgaccuguggagcuauaacgccgagcuccugguggcucuggaaaaccagcauacaauugaucucaccgacucugagaugaauaagcuguucgaaaagaccaagaagcagcuucgggagaacgcggaagauauggggaauggaugcuuuaaaaucuaccacaaguguaacaaugccugcaucggcuccauuagaaacgggacauaugaccaugauguuuaccgcgacgaggcucugaauaaccgguuccagaucaaaggcguggagcucaagagcggauacaaagacuggauucuguggaucucuuuugccauuuccugcuuccuucugugugucgcccuccugggcuuuaucaugugggcuugccaaaaggggaauaucagauguaacauuugcaucuga

SEQ ID NO: 188389 - RNA, 1701 nt, Artificial Sequence; identical to SEQ ID NO: 186637
  derived and/or modified sequence opt5 from hemagglutinin__InfluenzaA__ADK94564

SEQ ID NO: 188390 - RNA, 1701 nt, Artificial Sequence
  derived and/or modified sequence opt5 from hemagglutinin__InfluenzaA__ADK98501
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcggcaacgggacgugcuauccgggagacuuuauugauuacgaagaacugcgggagcagcuuuccagcgucucuuccuucgaacgcuuugagaucuuccccaagaccagcucuuggccuaaucacgacuccaacaagggcgugacagccgcuuguccccaugccggcgcgaaaucuuuuuauaagaaucugaucuggcucguuaaaaaggggaacagcuacccuaaacuguccaagagcuauauuaaugauaagggaaaagaagugcuuguccuguggggcauccaccaccccuccaccucugccgaccaacagagccucuaccagaacgcugaugccuacguguucguggggacauccagauauagcaagaaauuuaagccugagauugcuauccggccgaaaguccgcgaccaggagggaagaaugaauuacuauuggacccugguugaacccggcgauaagauuacguucgagacaaccgggaaccugguggugccucgguacgccuuugcgauggaacgcaacgccggaucuggcaucauuaucuccgacacacccguccaugauugcaauaccaccugucaaacaccuaaaggcgcuaucaacacgagccuccccuuccagaauauucacccgaucaccauugggaagugcccuaaguaugugaaaucuacaaagcugagacuugccaccggacugcggaacguucccagcauccagucccgcggccucuuuggggcuauugccggauucaucgagggcggguggacaggaaugguggacggcugguacggcuaucaucaccagaaugaacaagggucuggauacgccgcugaccugaaaagcacccagaacgcgaucgaugagauuacgaauaaggucaacuccgugaucgagaaaaugaauacacaguuuaccgccguuggcaaggaguucaaccaccuugagaagagaauugaaaaucugaacaaaaagguggacgauggguuccucgacaucuggaccuacaaugcugagcugcugguccuccuggaaaacgagcggacacuugauuaucaugacagcaaugugaaaaaccuguacgagaagguccgcucucagcucaaaaacaaugccaaggaaauuggaaacggcuguuuugaguucuaucacaagugcgauaauaccuguauggaauccgugaaaaacgggacauacgacuauccuaaguacagcgaggaagccaaacugaauagagaggagaucgauggcguuaaacuugaaucuacgcggaucuaucaaauucuggcuaucuacuccaccguggccagcucccucguccuggugguuucucugggagcgauuagcuuuuggaugugcuccaacggcucucuccagugccgcaucuguauuuga

SEQ ID NO: 188391 - RNA, 1701 nt, Artificial Sequence
  derived and/or modified sequence opt5 from hemagglutinin__InfluenzaA__ADK98503
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacguggacgcuuacguguucgucggcacaagcagauauuccaagaaauuuaagccggagauugccauccggcccaaaguucgcgaucaggaggggagaaugaauuacuauuggacccugguggaaccuggagacaagauuacguucgaggcuacaggcaaccugguggucccccgguacgccuuugcgauggaacgcaacgccgggagcggaaucauuaucucugauaccccugugcaugacugcaauacaaccugucaaacccccaaaggcgcuaucaacacaucccucccguuccagaauauucacccuaucacgauuggcaagugccccaaguauguuaaaagcaccaagcugagacuugccacagggcugcggaacgugccuucuauccagagccgcggacucuuuggcgcuauugccggguucaucgagggaggcuggaccgggauggucgacggaugguacggcuaucaucaccagaaugaacaaggcuccggguacgccgcugaucugaaaucuacacagaacgcgaucgacgagauuaccaauaaggugaacagcguuaucgagaaaaugaauacgcaguuuacagccgugggaaaggaguucaaccaccuugagaagagaauugaaaaucugaacaaaaaggucgaugacggcuuccucgauaucuggaccuacaaugcugagcugcuggugcuccuggaaaacgagcggacccuugacuaucaugauuccaaugucaaaaaccuguacgagaaggugcgcagccagcucaaaaacaaugccaaggaaauugggaacggauguuuugaguucuaucacaagugcgacaauacauguauggaaucuguuaaaaacggcaccuacgauuaucccaaguacuccgaggaagccaaacugaauagagaggagaucgacggggugaaacuugaaagcacacggaucuaucaaauucuggcuaucuacucuacggucgccuccagccucgugcugguugugucccugggcgcgauuucuuuuuggaugugcagcaacggaucccuccagugccgcaucuguauuuga

SEQ ID NO: 188392 - RNA, 1701 nt, Artificial Sequence; identical to SEQ ID NO: 188375
  derived and/or modified sequence opt5 from hemagglutinin__InfluenzaA__ADK98623

SEQ ID NO: 188393 - RNA, 1701 nt, Artificial Sequence; identical to SEQ ID NO: 185458
  derived and/or modified sequence opt5 from hemagglutinin__InfluenzaA__ADK98634

SEQ ID NO: 188394 - RNA, 1701 nt, Artificial Sequence; identical to SEQ ID NO: 185458
  derived and/or modified sequence opt5 from hemagglutinin__InfluenzaA__ADK98645

SEQ ID NO: 188395 - RNA, 1701 nt, Artificial Sequence; identical to SEQ ID NO: 188321
  derived and/or modified sequence opt5 from hemagglutinin__InfluenzaA__ADK98656

SEQ ID NO: 188396 - RNA, 1701 nt, Artificial Sequence; identical to SEQ ID NO: 188388
  derived and/or modified sequence opt5 from hemagglutinin__InfluenzaA__ADK98667

SEQ ID NO: 188397 - RNA, 1701 nt, Artificial Sequence
  derived and/or modified sequence opt5 from hemagglutinin__InfluenzaA__ADK98678
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccucuggacgcauuacaguuuccaccaagagaagccagcagacagugaucccgaacauuggcucccggccccgcgucagaaauaucccuucucggaucagcauuuacuggaccaucgugaaacccggggauauucugcugaucaacuccaccggaaaucucauugcuccucgcggcuacuucaagaucagaagcgggaaaucuuccaucaugcggagcgacgcccccauuggaaaguguaacucugaaugcaucacacagaauggcagcauuccgaacgacaagccuuuucaaaaugugaaccgcaucacguauggcgcuugucccagauacgucaaacagaauacccugaaacuugccacagggaugcggaacguuccugagaagcagacccgcggaauuuucggcgcgaucgccggguuuaucgaaaauggaugggagggcaugguggaugggugguauggauucagacaccaaaacuccgagggccggggccaggcugccgaccugaagucuacacaggcugccauugaucagaucaaugggaaacucaacagacugauuggaaagaccaacgaaaaauuccaccaaaucgagaaggaauuuagcgagguggaaggccgcauucaggaccuugagaaguacgucgaggauacgaaaaucgaccugugguccuauaaugccgaacuccugguggcucuggagaaccagcauacaauugaucucaccgacagcgaaaugaauaagcuguucgagaaaaccaagaaacagcuucgggaaaacgcggaggauauggggaauggaugcuuuaagaucuaccacaagugugacaacgccugcaucggcucuauuagaaaugggacauaugaucaugacguuuaccgcgacgaggcucugaacaaucgguuccaaaucaaaggcguggaacucaaguccggauacaaagauuggauucuguggaucagcuuugccauuucuugcuuccuucugugugucgcccuccugggcuuuaucaugugggcuugccagaaggggaacaucagauguaauauuugcaucuga

SEQ ID NO: 188398 - RNA, 1701 nt, Artificial Sequence; identical to SEQ ID NO: 185458
  derived and/or modified sequence opt5 from hemagglutinin__InfluenzaA__ADK98689

SEQ ID NO: 188399 - RNA, 1701 nt, Artificial Sequence; identical to SEQ ID NO: 185458
  derived and/or modified sequence opt5 from hemagglutinin__InfluenzaA__ADK98700

SEQ ID NO: 188400 - RNA, 1701 nt, Artificial Sequence; identical to SEQ ID NO: 185458
  derived and/or modified sequence opt5 from hemagglutinin__InfluenzaA__ADK98711

SEQ ID NO: 188401 - RNA, 1701 nt, Artificial Sequence
  derived and/or modified sequence opt5 from hemagglutinin__InfluenzaA__ADK98722
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccucuggacgcauuacaguuuccaccaagggcagccagcagacagugaucccgaacauuggguccagaccccggguccgcaauaucccuucuagaaucagcauuuacuggaccaucgugaaacccggagauauucugcugaucaacuccaccggcaaucucauugcuccucggggguacuucaagauccgcagcggaaaaucuuccaucaugagaagcgacgcccccauuggcaaguguaacucugaaugcaucacaccgaauggcagcauuccuaacgacaagcccuuucagaaugugaaccggaucacguauggggcuuguccucgcuacgucaaacaaaauacccugaaacuugccacaggaaugagaaacguucccgagaagcagacccggggcauuuucggggcgaucgccggauuuaucgaaaauggcugggaggggaugguggauggaugguauggcuuccgccaccagaacuccgagggcagagggcaagcugccgaccugaagucuacacaggcugccauugaucagaucaauggaaaacucaaccggcugauuggcaagaccaacgaaaaauuccaccagaucgagaaggaauuuagcgagguggaagggcgcauucaagaccuugagaaguacgucgaggauacgaaaaucgaccugugguccuauaaugccgaacuccugguggcucuggagaaccagcauacaauugaucucaccgacagcgaaaugaauaagcuguucgagaaaaccaagaaacagcuuagagaaaacgcggaggauaugggaaauggcugcuuuaagaucuaccacaagugugacaacgccugcaucgggucuauucggaauggcacauaugaucaugacguuuacagagacgaggcucugaacaaucgcuuccagaucaaaggaguggaacucaaguccggcuacaaagauuggauucuguggaucagcuuugccauuucuugcuuccuucugugugucgcccuccugggguuuaucaugugggcuugccaaaagggaaacauccgguguaauauuugcaucuga

SEQ ID NO: 188402 - RNA, 1701 nt, Artificial Sequence; identical to SEQ ID NO: 188375
  derived and/or modified sequence opt5 from hemagglutinin__InfluenzaA__ADK98733

SEQ ID NO: 188403 - RNA, 1701 nt, Artificial Sequence; identical to SEQ ID NO: 185458
  derived and/or modified sequence opt5 from hemagglutinin__InfluenzaA__ADK98744

SEQ ID NO: 188404 - RNA, 1701 nt, Artificial Sequence; identical to SEQ ID NO: 185458
  derived and/or modified sequence opt5 from hemagglutinin__InfluenzaA__ADK98777

SEQ ID NO: 188405 - RNA, 1701 nt, Artificial Sequence; identical to SEQ ID NO: 185458
  derived and/or modified sequence opt5 from hemagglutinin__InfluenzaA__ADK98788

SEQ ID NO: 188406 - RNA, 1701 nt, Artificial Sequence; identical to SEQ ID NO: 186637
  derived and/or modified sequence opt5 from hemagglutinin__InfluenzaA__ADK98799

SEQ ID NO: 188407 - RNA, 1701 nt, Artificial Sequence
  derived and/or modified sequence opt5 from hemagglutinin__InfluenzaA__ADK98810
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagacauuucucuaugcgcaagccucuggacgcaucaccguuuccacaaagagaagccagcagaccgugauuccgaacaucggcucccggccccgcgucagaaauauuccuucucggaucagcaucuacuggaccauugugaaacccggggauauccugcugauuaacuccacaggaaaucucaucgcuccucgcggcuacuucaagauuagaagcgggaaaucuuccaucaugcggagcgacgcccccaucggaaaguguaacucugaaugcauuacgccgaauggcagcaucccuaacgacaagcccuuucagaaugugaaccgcauuaccuauggcgcuuguccuagauacgucaaacaaaauacacugaaacuugccaccgggaugcggaacguucccgagaagcagacacgcggaaucuucggcgcgauugccggguuuaucgaaaauggaugggagggcaugguggaugggugguauggauucagacaccagaacuccgagggccggggccaagcugccgaccugaagucuacccaggcugccaucgaucagauuaaugggaaacucaacagacugaucggaaagacgaacgaaaaauuccaccagauugagaaggaauuuagcgagguggaaggccgcauccaagaccuugagaaguacgucgaggauacaaaaauugaccugugguccuauaaugccgaacuccugguggcucuggagaaccagcauaccaucgaucucaccgacagcgaaaugaauaagcuguucgagaaaacaaagaaacagcuucgggaaaacgcggaggauauggggaauggaugcuuuaagauuuaccacaagugugacaacgccugcaucggcucuaucagaaaugggaccuaugaucauaacguuuaccgcgacgaggcucugaauaaccgguuccagauuaaagaaguggagcucaaguccggcuacaaagacuggauccuguggauuagcuuugccaucucuugcuuccuucugugugucgcccuccugggauuuauuaugugggcuugccaaaagggcaauaucagauguaacaucugcauuuga

SEQ ID NO: 188408 - RNA, 1701 nt, Artificial Sequence
  derived and/or modified sequence opt5 from hemagglutinin__InfluenzaA__ADK98821
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauccgcagaucuaagaacuccuuuuucagccggcugaauuggcucacacaucugaacuuuaaauauccugcccuuaaugucaccaugcccaacaacgagcaguucgacaagcuguacauuuggggcgugcaccauccugggacggauaaagaccagaucuuucucuaugcgcaagccucuggacgcauuacaguuuccaccaagagaagccagcagacagcuaucccgaauauuggcucccggccccgcgugagaaacaucccuucucggaucagcauuuacuggaccaucgucaaacccggggauauucugcugaucaauuccaccggaaaccucauugccccucgcggcuacuucaagaucagaagcgggaagucuuccaucaugcggagcgacgcucccauuggaaaauguaauucugagugcaucacaccgaacggcagcauuccuaaugacaagcccuuucagaacgugaaucgcaucacguauggcgccuguccuagauacgugaaacaaaacacccugaaacuugcgacagggaugcggaauguccccgaaaaacagacccgcggaauuuucggcgccaucgcuggguuuaucgagaacggaugggaaggcaugguugaugggugguauggauucagacaccaaaauuccgagggccggggccaggccgcugaccugaagucuacacaggccgccauugaucagaucaacgggaaacucaauagacugauuggaaagaccaacgagaaguuccaccagaucgaaaaagaguuuagcgaaguggagggccgcauucaagaccuugaaaaguacguggaggauacgaaaaucgaccugugguccuauaacgcugagcuccuggucgcgcuggaaaaucagcauacaauugaucucaccgacagcgagaugaacaagcuguucgaaaagacccggaagcagcuuagagagaaugccgaagauauggggaacggaugcuuuaagaucuaccacaaaugugacaaugcuugcaucggcucuauucgcaacgggacauaugaucaugacguguaccgggacgaggcccugaauaacagauuccagaucaagggcguugagcucaaauccggauacaaggauuggauucuguggaucagcuuugccauuucuugcuuccuucuguguguggcucuccugggcuuuaucaugugggccugccaaaaagggaauauccgcuguaacauuugcaucuga

SEQ ID NO: 188409 - RNA, 1701 nt, Artificial Sequence; identical to SEQ ID NO: 185458
  derived and/or modified sequence opt5 from hemagglutinin__InfluenzaA__ADK98832

SEQ ID NO: 188410 - RNA, 1701 nt, Artificial Sequence; identical to SEQ ID NO: 188388
  derived and/or modified sequence opt5 from hemagglutinin__InfluenzaA__ADK98843

SEQ ID NO: 188411 - RNA, 1701 nt, Artificial Sequence
  derived and/or modified sequence opt5 from hemagglutinin__InfluenzaA__ADK98854
augaagaccaucauugcccugagcuacauccucugccugguguucacacagaaacuucccggcaacgacaauuccacggcuacccugugucucgggcaccaugccgucccuaacggaacaauuguuaagaccaucacaaaugaucaaauugaggugaccaacgcgacagaacuggugcagucuagcuccaccggcgagaucugcgacucuccgcaccagauccuugauggggaaaauuguacgcugauugacgcucuccugggagauccccagugcgacggcuuucaaaacaaaaagugggaucuguucgucgagagaagcaaagccuauuccaauuguuacccuuaugacgugcccgauuacgccucucuccggagccugguugcuuccagcgggacccuugaauuuaacaaugagucuuucaacuggacaggagugacccagaauggcacauccagcgccugcauccgcagaucuaacaauuccuuuuucagccggcugaacuggcucacccaucugaaguuuaaguauccugcucuuaaugucacgaugcccaacaacgagcaguucgacaaacuguacauuuggggcgugcaccauccugggacagauaaugaccagaucuuucucuaugcccaagcgucuggacgcauuaccguuuccacaaagagaagccagcagaccgugaucccgaacauuggcucccggccccgcgucagaaauaucccuucucggaucagcauuuacuggaccaucgugaaacccggggauauucugcugaucaacuccacaggaaaucucauugccccucgcggcuacuucaagaucagaagcgggaaaucuuccaucaugcggagcgacgcucccauuggaaaguguaacucugaaugcaucacgccgaauggcagcauuccuaacgacaagcccuuucagaaugugaaccgcaucaccuauggcgccuguccuagauacgucaaacaaaauacacugaaacuugcuaccgggaugcggaacguucccgagaagcagacacgcggaauuuucggcgccaucgcgggguuuaucgaaaauggaugggagggcaugguggaugggugguauggauucagacaccagaacuccgagggccggggccaagccgcugaccugaagucuacccaggccgcuauugaucagaucaaugggaaacucaacagacugauuggaaagacgaacgaaaaauuccaccagaucgagaaggaauuuagcgagguggaaggccgcauucaagaccuugagaaguacgucgaggauacaaaaaucgaccugugguccuauaaugccgaacuccugguggcccuggagaaccagcauaccauugaucucaccgacagcgaaaugaauaagcuguucgagaaaacaaagaaacagcuucgggaaaacgcugaggauauggggaauggaugcuuuaagaucuaccacaagugugacaacgcgugcaucggcucuauuagaaaugggaccuaugaucaugacguuuaccgcgacgaggcccugaacaaucgguuccagaucaaaggcguggaacucaagcccggauacaaagauuggauucuguggaucuccuuugcuauuagcugcuuccuucugugugucgcccuccugggcuuuaucaugugggccugccaaaaggggaacaucagauguaauauuugcaucuga

SEQ ID NO: 188412 - RNA, 1701 nt, Artificial Sequence
  derived and/or modified sequence opt5 from hemagglutinin__InfluenzaA__ADK98865
augaagaccaucauugcccugagcuacauccucugccugguguucgcucagaaacuucccggcuccgacaacucuacagccacgcugugucucgggcaccaugcggucccuaauggaaccauuguuaagacaaucaccaacgaucaaauugaggugacaaaugcuaccgaacuggugcagagcuccucuacaggcgagaucugcgacagcccgcaccagauccuugauggggaaaacuguacccugauugacgcccuccugggagauccccagugcgacgauuuucaaaauaaaaagugggaccuguucgucgagagauccaaagccuauucuaacuguuacccuuaugaugugcccgacuacgcuagccuccggucccugguugccagcucuggcacgcuugaauuuaauaacgaguccuucaauuggaccggggugacacagaacggaaccagcucugcuugcauccgcagauccagcaauuccuuuuucucucggcugaacuggcucacacaucugcgcuuuaaguauccugcccuuaaugucaccaugcccaacaaugagcaguucgauaagcuguacauuuggggcgugcaccauccuggcacggacaacgaucagaucuuucucuaugcgcaagccagcgggagaauuacaguuuccaccaaacggucucagcagacagugaucccgaacauuggaagccgccccagaguccggaauaucccuucccgcaucagcauuuacuggaccaucgugaagcccggcgacauucugcugaucaacucuaccgggaaucucauugcuccuagaggauacuucaaaauccgguccggcaagagcucuaucaugcgcagcgacgcccccauugggaaauguaacuccgaaugcaucacaccgaauggaucuauuccuaacgauaagcccuuucagaaugugaacagaaucacguauggcgcuuguccucgguacgucaagcaaaauacccugaaacuugccacaggcaugcgcaacguucccgagaagcagaccagagggauuuucggagcgaucgccggcuuuaucgaaaaugggugggagggaaugguggacggcugguauggguuccggcaccagaacagcgagggaagaggccaagcugccgaucugaaauccacacaggcugccauugaccagaucaauggcaagcucaaccgccugauugggaaaaccaaugaaaaguuccaccagaucgagaaagaauuuagcgagguggaaggacggauucaagaucuugagaaguacgucgaggacacgaagaucgaucuguggucuuauaacgccgaacuccugguggcucuggagaaccagcauacaauugaccucaccgauuccgaaaugaauaaacuguucgagaagaccaaaaagcagcuuagagaaaacgcggaggacaugggcaaugggugcuuuaaaaucuaccacaagugugauaacgccugcaucggaagcauucgcaauggcacauaugaccaugacguuuaccgggaugaggcucugaacaauagauuccagaucaaggggguggaacucaaaucuggcuacaaggacuggauucuguggaucuccuuugccauuagcugcuuccuucugugugucgcccuccugggauuuaucaugugggcuugccaaaaaggcaacauccgcuguaauauuugcaucuga

SEQ ID NO: 188413 - RNA, 1701 nt, Artificial Sequence
  derived and/or modified sequence opt5 from hemagglutinin__InfluenzaA__ADK98876
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgagaucugcgacuccccgcaccagauccuugaugggaaaaacuguacccugauugacgcccuccugggagauccccagugcgacggcuuucagaauaagaaaugggaucuguucgucgaaagaucuaaggccuauagcaacuguuacccuuaugacgugcccgauuacgcuucccuccggucucugguugccagcuccgggacgcuugaguuuaauaacgaaucuuucaauuggaccggagugacacagaacggcaccucuuccgcuugcauccgcagaagcaagaauagcuuuuucucccggcugaacuggcucacacaucugaauuuuaaauauccugcccuuaacgucaccaugcccaacaauggccaguucgacaagcuguacauuuggggagugcaccauccugggacggauaaagaccagaucuuucucuaugcgcaagccagcggccgcauuacaguuucuaccaagagaucccagcagacagugaucccgaacauugggagccggccccgcgucagaaauaucccuucccggaucucuauuuacuggaccaucgugaaacccggagauauucugcugaucaacagcaccggcaaucucauugcuccucgcggguacuucaagaucagauccggaaagagcucuaucaugcgguccgacgcccccauuggcaaauguaacagcgagugcaucacaccgaauggcucuauuccuaacgacaagcccuuucagaaugugaaccgcaucacguauggggcuuguccuagauacgucaaacaaaauacccugaaacuugccacaggaaugcggaacguucccgagaagcagacccgcggcauuuucggggcgaucgccggauuuaucgaaaauggcugggaggggaugguggauggaugguauggcuucagacaccagaacagcgaaggccgggggcaagcugccgaccugaaguccacacaggcugccauugaucagaucaauggaaaacucaacagacugauuggcaagaccaacgagaaguuccaccagaucgagaaagaauuuucugagguggaagggcgcauucaagaccuugagaaguacgucgaagauacgaaaaucgaccuguggagcuauaaugccgagcuccugguggcucuggagaaccagcauacaauugaucucaccgacuccgaaaugaauaagcuguucgagaaaaccaagaagcagcuucgggaaaacgcggaggauaugggaaauggcugcuuuaaaaucuaccacaagugugacaacgccugcaucgggagcauuagaaauggcacauaugaucaugacguuuaccgcgacgaagcucugaacaaucgguuccagaucaaaggaguggagcucaagucuggcuacaaagauuggauucuguggaucuccuuugccauuagcugcuuccuucugugugucgcccuccugggguuuaucaugugggcuugccaaaagggaaacaucagauguaauauuugcaucuga

SEQ ID NO: 188414 - RNA, 1701 nt, Artificial Sequence; identical to SEQ ID NO: 188388
  derived and/or modified sequence opt5 from hemagglutinin__InfluenzaA__ADK98887

SEQ ID NO: 188415 - RNA, 1701 nt, Artificial Sequence; identical to SEQ ID NO: 185458
  derived and/or modified sequence opt5 from hemagglutinin__InfluenzaA__ADK98898

SEQ ID NO: 188416 - RNA, 1701 nt, Artificial Sequence
  derived and/or modified sequence opt5 from hemagglutinin__InfluenzaA__ADK98909
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgagaucugcgacuccccgcaccagauucuugauggggaaaauuguacccugaucgacgcccuccugggagauccccagugcgacggcuuucaaaacaaaaagugggaucuguucgucgagagaucuaaagccuauagcaauuguuacccuuaugacgugcccgauuacgcuucccuccggucucugguugccagcuccgggacgcuugaauuuaacaaugagagcuucaacuggaccggagugacacagaauggcaccucuuccgcuugcauucgcagaagcaacaauuccuuuuucucucggcugaacuggcucacacaucugaaguuuaaguauccugcccuuaaugucaccaugcccaacaacgagcaguucgacaaacuguacaucuggggcgugcaccauccugggacggauaaugaccagauuuuucucuaugcgcaagccagcggacgcaucacaguuucuaccaagagaucccagcagacagugauuccgaacaucggcagccggccccgcgucagaaauaucccuucccggauuucuaucuacuggaccauugugaaacccggggauauccugcugauuaacagcaccggaaaucucaucgcuccucgcggcuacuucaagaucagauccgggaaaagcucuauuaugcgguccgacgcccccaucggaaaguguaacagcgaaugcauuacaccgaauggcucuaucccuaacgacaagcccuuucagaaugugaaccgcauuacguauggcgcuuguccuagauacgucaaacaaaauacccugaaacuugccacagggaugcggaacguucccgagaagcagacccgcggaaucuucggcgcgaucgccggguuuauugaaaauggaugggagggcaugguggaugggugguauggauucagacaccagaacagcgagggccggggccaagcugccgaccugaaguccacacaggcugccaucgaucagauuaaugggaaacucaacagacugaucggaaagaccaacgaaaaauuccaccagauugagaaggaauuuucugagguggaaggccgcauccaagaccuugagaaguacgucgaggauacgaaaauugaccuguggagcuauaaugccgaacuccugguggcucuggagaaccagcauacaaucgaucucaccgacuccgaaaugaauaagcuguucgagaaaaccaagaaacagcuucgggaaaacgcggaggauauggggaauggaugcuuuaagaucuaccacaagugugacaacgccugcauuggcagcaucagaaaugggacauaugaucaugacguuuaccgcgacgaggcucugaacaaucgguuccagauuaaaggcguggaacucaagucuggauacaaagauuggauccuguggauuuccuuugccaucagcugcuuccuucugugugucgcccuccugggcuuuaucaugugggcuugccaaaaggggaacauuagauguaauaucugcauuuga

SEQ ID NO: 188417 - RNA, 1701 nt, Artificial Sequence
  derived and/or modified sequence opt5 from hemagglutinin__InfluenzaA__ADK98920
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagagggaaggccuauagcaauuguuacccuuaugacgugcccgauuacgcuucccuccggucucugguugccagcuccggaacgcuugaguuuaacaaugaaucuuucaacuggaccggcgugacacagaauggcaccucuuccgcuugcauccgcagaagcaagaacagcuuuuucucccggcugaauuggcucacacaucugaacuuuaaauauccugcccuuaaugucaccaugcccaacaacgagcaguucgacaagcuguacauuuggggagugcaccauccugggacggauaaagaccagaucuuucucuaugcgcaagccagcggccgcauuacaguuucuaccaagagaucccagcagacagugaucccgaauauugggagccggccccgcgucagaaacaucccuucccggaucucuauuuacuggaccaucgugaaacccggagauauucugcugaucaauagcaccggcaaccucauugcuccucgcggguacuucaagaucagauccggaaagagcucuaucaugcgguccgacgcccccauuggcaaauguaauagcgagugcaucacaccgaacggcucuauuccuaaugacaagcccuuucagaacgugaaucgcaucacguauggggcuuguccuagauacgucaaacaaagcacccugaaacuugccacaggaaugcggaacguucccgaaaaacagacccgcggcauuuucggggcgaucgccggauuuaucgagaauggcugggaagggaugguggauggaugguauggcuucagacaccagaacuccgagggccgggggcaagcugccgaccugaagucuacacaggcugccauugaucagaucaauggaaaacucaacagacugauuggcaagaccaaugagaaguuccaccagaucgaaaaagaguuuagcgaaguggaggggcgcauucaagaccuugaaaaguacgucgaggauacgaaaaucgaccugugguccuauaacgccgagcuccugguggcucuggaaaaccagcauacaauugaucucaccgacagcgagaugaauaagcuguucgaaaagaccaagaagcagcuucgggagaacgcggaagauaugggaaauggcugcuuuaaaaucuaccacaagugugacaacgccugcaucgggucuauuagaaauggcacauaugaucaugacguuuaccgcgacgaggcucugaacaaucgguuccagaucaaaggaguggagcucaaguccggcuacaaagauuggauucuguggaucagcuuugccauuucuugcuuccuucugugugucgcccuccugggguuuaucaugugggcuugccaaaagggaaacaucagauguaauauuugcaucuga

SEQ ID NO: 188418 - RNA, 1701 nt, Artificial Sequence; identical to SEQ ID NO: 185458
  derived and/or modified sequence opt5 from hemagglutinin__InfluenzaA__ADK98931

SEQ ID NO: 188419 - RNA, 1701 nt, Artificial Sequence
  derived and/or modified sequence opt5 from hemagglutinin__InfluenzaA__ADK98942
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccucuggacgcauuacaguuuccaccaagagaagccagcagacagugaucuccaacauuggcucucggccgcgcgucagaaauauccccagccggaucuccauuuacuggaccaucgugaaaccuggggauauucugcugaucaacagcaccggaaaucucauugcuccccgcggcuacuucaagaucagaucugggaaauccagcaucaugcggucugacgccccuauuggaaaguguaacagcgaaugcaucacacccaauggcuccauuccgaacgacaagccuuuucagaaugugaaccgcaucacguauggcgcuugucccagauacgucaaacaaaauacccugaagcuggccacagggaugcggaacguuccugagaaacagacccgcggaauuuucggcgcgaucgccggguuuaucgaaaauggaugggagggcaugguggaugggugguauggauucagacaccagaacucugagggccggggccaagcugccgaccuuaagagcacacaggcugccauugaucagaucaaugggaaacucaacagacugauuggaaagaccaacgaaaaauuccaccagaucgagaaggaauuuuccgagguggaaggccgcauucaagaccuugagaaguacgucgaggauacgaaaaucgaccuguggagcuauaaugccgaacuccugguggcucuggagaaccagcauacaauugaucucaccgacucugaaaugaauaagcuguucgagaaaaccaagaaacagcuucgggaaaacgcggaggauauggggaauggaugcuuuaagaucuaccacaagugugacaacgccugcaucggcuccauuagaaaugggacauaugaucauaacguuuaccgcgacgaggcucugaauaaccgguuccagaucaaaggcguggaacucaagagcggauacaaagacuggauucuguggaucucuuuugccauuuccugcuuccuucugugugucgcccuccugggcuuuaucaugugggcuugccaaaaggggaauaucagauguaacauuugcaucuga

SEQ ID NO: 188420 - RNA, 1701 nt, Artificial Sequence
  derived and/or modified sequence opt5 from hemagglutinin__InfluenzaA__ADK98953
augaagaccaucauugcccugagcuacaugcucugccugguguucgcucagaaacuucccggcaacgacaauuccacagccacgcugugucucgggcaccaugcggucccuaacggaaccaucguuaagacaauuaccaaugaucaaaucgaggugacaaacgcuaccgaacuggugcagucuagcuccacaggcgagauuugcgacucuccgcaccagauccuugauggggaaaauuguacccugaucgacgcccuccugggagauccccagugcgacggcuuucaaaacaaaaagugggaucuguucgucgagagaagcaaagccuauuccaauuguuacccuuaugacgugcccgauuacgcuucucuccggagccugauugccuccagcgggacgcuugaauuuaacaaugagucuuucaacuggaccggaguuacacagaauggcaccuccagcgcuugcauccgcagaucuaacaauuccuuuuucagccggcugaacuggcucacacaucugaaguuuaaguauccugcccuuaaugugaccaugcccaacaacgagcaguucgacaaacuguacauuuggggcguccaccauccugggacggauaaugaccagaucuuucucuaugcgcaagccucuggacgcauuacaguguccaccaagagaagccagcagacaguuaucccgaacauuggcucccggccccgcgugagaaauaucccuucucggaucagcauuuacuggaccaucgucaaacccggggauauucugcugaucaacuccaccggaaaucucauugcuccucgcggcuacuucaagaucagaagcgggaaaucuuccaucaugcggagcgacgcccccauuggaaaguguaacucugaaugcaucacaccgaauggcagcauuccuaacgacaagcccuuucagaaugugaaccgcaucacguauggcgcuuguccuagauacgugaaacaaaauacccugaaacuugccacagggaugcggaacguccccgagaagcagacccgcggaauuuucggcgcgaucgccggguuuaucgaaaauggaugggagggcaugguugaugggugguauggauucagacaccagaacuccgagggccggggccaagcugccgaccugaagucuacacaggcugccauugaucagaucaaugggaaacucaacagacugauuggaaagaccaacgaaaaauuccaccagaucgagaaggaauuuagcgagguggaaggccgcauucaagaccuugagaaguacguggaggauacgaaaaucgaccugugguccuauaaugccgaacuccuggucgcucuggagaaccagcauacaauugaucucaccgacagcgaaaugaauaagcuguucgagaaaaccaagaaacagcuucgggaaaacgcggaggauauggggaauggaugcuuuaagaucuaccacaagugugacaacgccugcaucggcucuauuagaaaugggacauaugaucaugacguguaccgcgacgaggcucugaacaaucgguuccagaucaaaggcguugaacucaaguccggauacaaagauuggauucuguggaucagcuuugccauuucuugcuuccuucuguguguggcccuccugggcuuuaucaugugggcuugccaaaaggggaacaucagauguaauauuugcaucuga

SEQ ID NO: 188421 - RNA, 1701 nt, Artificial Sequence; identical to SEQ ID NO: 185458
  derived and/or modified sequence opt5 from hemagglutinin__InfluenzaA__ADK98964

SEQ ID NO: 188422 - RNA, 1701 nt, Artificial Sequence; identical to SEQ ID NO: 188375
  derived and/or modified sequence opt5 from hemagglutinin__InfluenzaA__ADK98975

SEQ ID NO: 188423 - RNA, 1701 nt, Artificial Sequence; identical to SEQ ID NO: 188420
  derived and/or modified sequence opt5 from hemagglutinin__InfluenzaA__ADK98986

SEQ ID NO: 188424 - RNA, 1701 nt, Artificial Sequence; identical to SEQ ID NO: 186637
  derived and/or modified sequence opt5 from hemagglutinin__InfluenzaA__ADK98997

SEQ ID NO: 188425 - RNA, 1701 nt, Artificial Sequence; identical to SEQ ID NO: 188420
  derived and/or modified sequence opt5 from hemagglutinin__InfluenzaA__ADK99008

SEQ ID NO: 188426 - RNA, 1701 nt, Artificial Sequence
  derived and/or modified sequence opt5 from hemagglutinin__InfluenzaA__ADK99030
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauccgcagaucuaagaacuccuuuuucagccggcugaauuggcucacacaucugaacuuuaaauauccugcccuuaaugucaccaugcccaacaacgagcgcuucgacaagcuguacauuuggggcgugcaccauccugggacggauaaagaccagaucuuucucuaugcgcaggccucuggaagaauuacaguuuccaccaagcggagccaacagacagugaucccgaauauuggcucccgccccagaguccggaacaucccuucucgcaucagcauuuacuggaccaucgugaaacccggggauauucugcugaucaauuccaccggaaaccucauugcuccuagaggcuacuucaagauccggagcgggaagucuuccaucaugcgcagcgacgcccccauuggaaaauguaauucugagugcaucacaccgaacggcagcauuccuaaugacaagcccuuucagaacgugaauagaaucacguauggcgcuuguccucgguacgucaaacagaacacccugaaacuugccacagggaugcgcaauguucccgaaaaacaaaccagaggaauuuucggcgcgaucgccggguuuaucgagaacggaugggaaggcaugguggaugggugguauggauuccggcaccaaaauuccgagggcagaggccaggcugccgaccugaagucuacacaggcugccauugaucagaucaacgggaaacucaaucgccugauuggaaagaccaacgagaaguuccaccagaucgaaaaagaguuuagcgaaguggagggccggauucaggaccuugaaaaguacgucgaggauacgaaaaucgaccugugguccuauaacgccgagcuccugguggcucuggaaaaucaacauacaauugaucucaccgacagcgagaugaacaagcuguucgaaaagaccaagaagcagcuuagagagaaugcggaagauauggggaacggaugcuuuaaaaucuaccacaagugugacaaugccugcaucggcucuauucgcaacgggacauaugaucaugacguuuaccgggacgaggcucugaauaacagauuccagaucaaaggcguggagcucaaguccggauacaaagauuggauucuguggaucagcuuugccauuucuugcuuccuucugugugucgcccuccugggcuuuaucaugugggcuugccagaaggggaauauccgcuguaacauuugcaucuga

SEQ ID NO: 188427 - RNA, 1701 nt, Artificial Sequence
  derived and/or modified sequence opt5 from hemagglutinin__InfluenzaA__ADK99041
augaagaccaucauugcccugagcuacauccucugccugguguucgcucagaaacuucccggcaacgacaauuccacagccacgcugugucucgggcaccaugcggucccuaacggaaccauuguuaagacaaucgcuaaugaucaaauugaggugaccaacgccacagaacuggugcagucuagcuccaccggcgagaucugcgacucuccgcaccagauccuugauggggaaaauuguacacugauugacgcccuccugggagauccccagugcgacggcuuucaaaacaaaaagugggaucuguucgucgagagaagcaaggcuuauuccaauuguuacccuuaugacgugcccgauuacgccucucuccggagccugguugcuuccagcgggacccuugaauuuaacaaugagucuuucaacuggacgggagugacccagaauggcacauccagcgccugcauccgcagaucuaacaauuccuuuuucagccggcugaacuggcucacccaucugaaguuuaaguauccugcgcuuaaugucacaaugcccaacaacgagcaguucgacaaacuguacauuuggggcgugcaccauccugggaccgauaaugaccagaucuuucucuaugcccaggcuucuggacgcauuacgguuuccacaaagagaagccaacagaccgugaucccgaacauuggcucccggccccgcgucagaaauaucccuucucggaucagcauuuacuggacaaucgugaaacccggggauauucugcugaucaacuccaccggaaaucucauugccccucgcggcuacuucaagaucagaagcgggaaaucuuccaucaugcggagcgacgcucccauuggaaaguguaacucugaaugcaucaccccgaauggcagcauuccuaacgacaagcccuuucagaaugugaaccgcaucacauauggcgccuguccuagauacgucaaacaaaauacgcugaaacuugcgaccgggaugcggaacguucccgagaaacagacacgcggaauuuucggcgccaucgcuggguuuaucgaaaauggaugggagggcaugguggaugggugguauggauucagacaccagaacuccgagggccggggccaagccgcugaccugaagucuacccaggccgccauugaucagaucaaugggaaacucaacagacugauuggaaagacaaacgaaaaauuccaccagaucgagaaggaauuuagcgagguggaaggccgcauucaagaccuugagaaguacgucgaggauaccaaaaucgaccugugguccuauaaugcugaacuccugguggcgcuggagaaccagcauacgauugaucucacagacagcgaaaugaauaagcuguucgagaaaaccaagaaacagcuucgggaaaacgccgaggauauggggaauggaugcuuuaagaucuaccacaagugugacaacgcuugcaucggcucuauuagaaaugggaccuaugaucaugacguuuaccgcgacgaggcccugaacaaucgguuccagaucaaaggcguggaacucaaguccggauacaaagauuggauucuguggaucagcuuugccauuucuugcuuccuucugugugucgcucuccugggcuuuaucaugugggccugccaaaaggggaacaucagauguaauauuugcaucuga

SEQ ID NO: 188428 - RNA, 1701 nt, Artificial Sequence; identical to SEQ ID NO: 188375
  derived and/or modified sequence opt5 from hemagglutinin__InfluenzaA__ADK99063

SEQ ID NO: 188429 - RNA, 1701 nt, Artificial Sequence; identical to SEQ ID NO: 185458
  derived and/or modified sequence opt5 from hemagglutinin__InfluenzaA__ADK99085

SEQ ID NO: 188430 - RNA, 1701 nt, Artificial Sequence; identical to SEQ ID NO: 185458
  derived and/or modified sequence opt5 from hemagglutinin__InfluenzaA__ADK99096

SEQ ID NO: 188431 - RNA, 1701 nt, Artificial Sequence; identical to SEQ ID NO: 185458
  derived and/or modified sequence opt5 from hemagglutinin__InfluenzaA__ADK99107

SEQ ID NO: 188432 - RNA, 1701 nt, Artificial Sequence
  derived and/or modified sequence opt5 from hemagglutinin__InfluenzaA__ADK99118
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacaucccgcaccagauucuugaugggaaaaauuguacccugaucgacgcccuccugggagauccccagugcgacggcuuucaaaacaagaaaugggaucuguucgucgaaagaucuaaggccuauagcaauuguuacccuuaugacgugcccgauuacgcuucccuccggucucugguugccagcuccgggacgcuugaguuuaacaaugaaucuuucaacuggaccggagugacacagaauggcaccucuuccgcuugcauucgcagaagcaagaacagcuuuuucucccggcugaauuggcucacacaucugaacuuuaaauauccugcccuuaaugucaccaugcccaacaacgagcaguucgacaagcuguacaucuggggcgugcaccauccugggacggauaaagaccagauuuuucucuaugcgcaagccagcggacgcaucacaguuucuaccaagagaucccagcagacagugauuccgaauaucggcagccggccccgcgucagaaacaucccuucccggauuucuaucuacuggaccauugugaaacccggggauauccugcugauuaauagcaccggaaaccucaucgcuccucgcggcuacuucaagaucagauccggaaagagcucuauuaugcgguccgacgcccccaucgggaaauguaauagcgagugcauuacaccgaacggcucuaucccuaaugacaagcccuuucagaacgugaaucgcauuacguauggcgcuuguccuagauacgucaaacaaagcacccugaaacuugccacagggaugcggaacguucccgaaaaacagacccgcggaaucuucggcgcgaucgccggguuuauugagaauggaugggaaggcaugguggaugggugguauggauucagacaccagaacuccgagggccggggccaagcugccgaccugaagucuacacaggcugccaucgaucagauuaaugggaaacucaacagacugaucggaaagaccaaugagaaguuccaccagauugaaaaagaguuuagcgaaguggagggccgcauccaagaccuugaaaaguacgucgaggauacgaaaauugaccugugguccuauaacgccgagcuccugguggcucuggaaaaccagcauacaaucgaucucaccgacagcgagaugaauaagcuguucgaaaagaccaagaagcagcuucgggagaacgcggaagauauggggaauggaugcuuuaaaaucuaccacaaguguaacaaugccugcauuggcucuaucagaaacgggacauaugaccaugauguuuaccgcgacgaggcucugaauaaccgguuccagauuaaaggcguggagcucaaguccggauacaaagacuggauccuguggauuagcuuugccaucucuugcuuccuucugugugucgcccuccugggcuuuaucaugugggcuugccaaaaggggaauauuagauguaacaucugcauuuga

SEQ ID NO: 188433 - RNA, 1701 nt, Artificial Sequence
  derived and/or modified sequence opt5 from hemagglutinin__InfluenzaA__ADK99129
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauccgcagaucuaagaacuccuuuuucagccggcugaauuggcucacacaucugaacuuuaaauauccugcccuuaauaugaccaugcccaacaacgagcaguucgacaagcuguacauuuggggcguccaccauccugggacggauaaagaccagaucuuucucuaugcgcaagccucuggacgcauuacaguguccaccaagagaagccagcagacaguuaucccgaauauuggcucccggccccgcgugagaaacaucccuucucggaucagcauuuacuggaccaucgucaaacccggggauauucugcugaucaauuccaccggaaaccucauugcuccucgcggcuacuucaagaucagaagcgggaagucuuccaucaugcggagcgacgcccccauuggaaaauguaauucugagugcaucacaccgaacggcagcauuccuaaugacaagcccuuucagaacgugaaucgcaucacguauggcgcuuguccuagauacgugaaacaauccacccugaaacuugccacagggaugcggaacguccccgaaaaacagacccgcggaauuuucggcgcgaucgccggguuuaucgagaauggaugggaaggcaugguugaugggugguauggauucagacaccagaacucugagggccggggccaagcugccgaccucaagagcacacaggcugccauugaucagaucaaugggaaacugaacagacugauuggaaagaccaaugagaaguuccaccagaucgaaaaagaguuuuccgaaguggagggccgcauucaagaccuugaaaaguacguggaggauacgaaaaucgaccuguggagcuauaacgccgagcuccuggucgcucuggaaaaccagcauacaauugaucucaccgacucugagaugaauaagcuguucgaaaagaccaagaagcagcuucgggagaacgcggaagauauggggaauggaugcuuuaaaaucuaccacaaguguaacaaugccugcaucggcuccauuagaaacgggacauaugaccaugauguguaccgcgacgaggcucugaauaaccgguuccagaucaaaggcguugagcucaagagcggauacaaagacuggauucuguggaucucuuuugccauuuccugcuuccuucuguguguggcccuccugggcuuuaucaugugggcuugccaaaaggggaauaucagauguaacauuugcaucuga

SEQ ID NO: 188434 - RNA, 1701 nt, Artificial Sequence; identical to SEQ ID NO: 188375
  derived and/or modified sequence opt5 from hemagglutinin__InfluenzaA__ADK99140

SEQ ID NO: 188435 - RNA, 1701 nt, Artificial Sequence
  derived and/or modified sequence opt5 from hemagglutinin__InfluenzaA__ADK99151
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggccugcaaaacaagaaaugggaucucuuugucgaaagaagcaaggccuauuccaauuguuacccuuaugacgugcccgauuacgcuucucugcggagccuuguugccuccagcgggacgcuggaguucaacaaugaaucuuuuaacuggaccggagugacacagaauggcaccuccagcgcuugcauccgcagaucuaagaacuccuucuuuagccggcucaauuggcugacacaucuuaacuucaaauauccugcccugaaugucaccaugcccaacaacgagcaguuugacaagcucuacauuuggggcgugcaccauccugggacggauaaagaccagaucuuccuguaugcgcaagccucuggacgcauuacaguuuccaccaagagaagccagcagacagcuaucccgaauauuggcucccggccccgcgugagaaacaucccuucucggaucagcauuuacuggaccaucgucaaacccggggauauucugcucaucaauuccaccggaaaccugauugccccucgcggcuacuuuaagaucagaagcgggaagucuuccaucaugcggagcgacgcucccauuggaaaauguaauucuaagugcaucacaccgaacggcagcauuccuaaugacaaacccuuccagaacgugaaucgcaucacguauggcgccuguccuagauacgugaagcaaaacacccuuaaacuggcgacagggaugcggaauguccccgagaagcagacccgcggaauuuuuggcgccaucgcuggguucaucgaaaacggaugggagggcaugguugaugggugguauggauuuagacaccaaaauuccgaaggccggggccaggccgcugaccucaaaucuacacaggccgccauugaucagaucaacgggaagcugaauagacuuauuggaaagaccaacgagaaauuccaccagaucgagaaggaguucagcgaaguggaaggccgcauucaagaccuggagaaauacguggaagauacgaagaucgaccucugguccuauaacgcugagcugcuggucgcgcucgagaaucagcauacaauugaucugaccgacagcgaaaugaacaaacuuuuugagaagaccaagaaacagcugcgggaaaaugccgaggauauggggaacggaugcuucaagaucuaccacaaaugugacaaugcuugcaucggcucuauuagaaacgggacauaugaucaugacguguaccgcgacgaagcccucaauaaccgguuucagaucaagggcguugagcugaaauccggauacaaggauuggauucuuuggaucagcuucgccauuucuugcuuucugcucuguguggcucugcugggcuucaucaugugggccugccaaaaggggaauaucagauguaacauuugcaucuga

SEQ ID NO: 188436 - RNA, 1701 nt, Artificial Sequence; identical to SEQ ID NO: 188375
  derived and/or modified sequence opt5 from hemagglutinin__InfluenzaA__ADK99162

SEQ ID NO: 188437 - RNA, 1701 nt, Artificial Sequence
  derived and/or modified sequence opt5 from hemagglutinin__InfluenzaA__ADK99173
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacugauccagucuagcuccacaggcgagaucugcgacucuccgcaccagauucuugauggggaaaauuguacccugaucgacgcccuccugggagauccccagugcgacggccugcaaaacaaaaagugggaucucuuuguggagagaagcaaagccuauuccaauuguuacccuuaugacguccccgauuacgcuucucugcggagccuuguggccuccagcgggacgcuggaguucaacaaugaaucuuuuaacuggaccggaguuacacagaauggcaccuccagcgcuugcauucgcagaucuaacaauuccuucuuuagccggcucaacuggcugacacaucuuaaguucaaguauccugcccugaaugugaccaugcccaacaacgagcaguuugacaaacucuacaucuggggcguccaccauccugggacggauaaugaccagauuuuccuguaugcgcaagccucuggacgcaucacaguguccaccaagagaagccagcagacaguuauuccgaacaucggcucccggccccgcgugagaaauaucccuucucggauuagcaucuacuggaccauugucaaacccggggauauccugcucauuaacuccaccggaaaucugaucgcuccucgcggcuacuuuaagaucagaagcgggaaaucuuccauuaugcggagcgacgcccccaucggaaaguguaacucugaaugcauuacaccgaauggcagcaucccuaacgacaagcccuuccagaaugugaaccgcauuacguauggcgcuuguccuagauacgugaaacaaaauacccuuaagcuggccacagggaugcggaacguccccgagaaacagacccgcggaaucuuuggcgcgaucgccggguucauugaaaauggaugggagggcaugguugaugggugguauggauuuagacaccagaacuccgagggccggggccaagcugccgaccucaagucuacacaggcugccaucgaucagauuaaugggaaacugaacagacuuaucggaaagaccaacgaaaaauuccaccagauugagaaggaguucagcgaaguggaaggccgcauccaagaccuggagaaguacguggaggauacgaaaauugaccucugguccuauaaugccgaacugcuggucgcucucgagaaccagcauacaaucgaucugaccgacagcgaaaugaauaaacuuuuugagaagaccaagaaacagcugcgggaaaacgcggaggauauggggaauggaugcuucaagaucuaccacaagugugacaacgccugcauuggcucuaucagaaaugggacauaugaucaugacguguaccgcgacgaggcucucaacaaucgguuucagauuaaaggcguugaacugaaguccggauacaaagauuggauccuuuggauuagcuucgccaucucuugcuuucugcucuguguggcccugcugggcuucaucaugugggcuugccaaaaggggaacauuagauguaauaucugcauuuga

SEQ ID NO: 188438 - RNA, 1701 nt, Artificial Sequence
  derived and/or modified sequence opt5 from hemagglutinin__InfluenzaA__ADK99184
augaagaccaucauugcccugagcuacauccucugccugguguccgcucagaaacuucccggcaacgacaauucuacagccacgcugugucucgggcaccaugcggucccuaacggaaccauuguuaagacaaucaccaaugaucaaauugaggugacaaacgcuaccgaacuggugcagagcuccucuacaggcgagaucugcaauagcccgcaccagauccuugacggggaaaacuguacccugauugaugcccuccugggagacccccagugcgauggcuuccaaaauaaaaagugggaccuguuugucgagagauccaaagccuauucuaacuguuacccuuaugaugugcccgacuacgcuagccuccggucccugguugccagcucugggacgcuugaguucaauaacgaauccuuuaauuggaccggagugacacagaacggcaccagcucugcuugcauccgcagauccaauaacagcuucuuuucucggcugaauuggcucacacaucugaaguucaaguauccugcccuuaacgucaccaugcccaacaaugagcaguuugauaaacuguacauuuggggcgugcaccauccugggacggacaacgaucagaucuuccucuaugcgcaagccuccggacgcauuacaguuagcaccaagagaucccagcagacagugaucccgaauauuggcucucggccccgcgucagaaacaucccuagccggaucuccauuuacuggaccaucgugaaacccggggacauucugcugaucaauagcaccggaaaccucauugcuccucgcggcuacuuuaagaucagaucugggaaauccagcaucaugcggucugaugcccccauuggaaaguguaauagcgaaugcaucacaccgaacggcuccauuccuaaugacaagcccuuccagaacgugaaucgcaucacguauggcgcuuguccuagauacgucaaacaaaacacccugaagcuggccacagggaugcggaauguucccgagaaacagacccgcggaauuuuuggcgcgaucgccggguucaucgaaaacggaugggagggcaugguggacgggugguauggauuuagacaccaaaauucugagggccggggccaggcugccgaucuuaagagcacacaggcugccauugaccagaucaacgggaaacucaacagacugauuggaaagaccaaugaaaaauuccaccagaucgagaaggaguucuccgaaguggaaggccgcauucaagaucuugagaaguacgucgaggacacgaaaaucgaucuguggagcuauaacgccgaacuccugguggcucuggagaaucagcauacaauugaccucaccgauucugaaaugaacaagcuguuugagaaaaccaagaaacagcuucgggaaaaugcggaggacauggggaacggaugcuucaagaucuaccacaagugugauaaugccugcaucggcuccauuagaaacgggacauaugaccaugauguuuaccgcgacgaggcucugaauaaccgguuucagaucaaaggcguggaacucaagagcggauacaaagacuggauucuguggaucucuuucgccauuuccugcuuucuucugugugucgcccuccugggcuucaucaugugggcuugccaaaaggggaauaucagauguaacauuugcaucuga

SEQ ID NO: 188439 - RNA, 1701 nt, Artificial Sequence; identical to SEQ ID NO: 185458
  derived and/or modified sequence opt5 from hemagglutinin__InfluenzaA__ADK99195

SEQ ID NO: 188440 - RNA, 1701 nt, Artificial Sequence
  derived and/or modified sequence opt5 from hemagglutinin__InfluenzaA__ADK99206
augaagaccaucauugcccugagcuacauccucugccugguguucgcucagaaacuucccggcaacgacaauuccacagccacgcugugucucgggcaccaugcggucccuaacggaaccguugugaagacaauuaccaaugaucaaaucgaggugacaaacgcuaccgaacugguccagucuagcuccacaggcgagauuugcgacucuccgcaccagauccuugaugggaaaaauuguacccugaucgacgcccuccugggagauccccagugcgacggcuuucaaaacaagaaaugggaucuguucguggaaagaagcaaggccuauuccaauuguuacccuuaugacguucccgauuacgcuucucuccggagccugguggccuccagcgggacgcuugaguuuaacaaugaaucuuucaacuggaccggagucacacagaauggcaccuccagcgcuugcauucgcagaucuaagaacuccuuuuucagccggcugaauuggcucacacaucugaacuuuaaauauccugcccuuaaugugaccaugcccaacaacgagcaguucgacaagcuguacaucuggggcguucaccauccugggacggauaaagaccagauuuuucucuaugcgcaagccucuggacgcaucacaguguccaccaagagaagccagcagacagucauuccgaauaucggcucccggccccgcgugagaaacauuccuucucgggugagcaucuacuggaccaucgucaaacccggggauauucugcugaucaauuccaccggaaaccucauugcuccucgcggcuacuucaagaucagaagcgggaagucuuccauuaugcggagcgacgcccccaucggaaaauguaauucugagugcaucacaccgaacggcagcauuccuaaugacaagcccuuucagaacguuaaucgcaucacguauggcgcuuguccuagauacgugaaacaaaacacccugaaacuugccacagggaugcggaaugugcccgaaaaacagacccgcggaauuuucggcgcgaucgccggguuuauugagaacggaugggaaggcauggucgaugggugguauggauucagacaccaaaauuccgagggccggggccaggcugccgaccugaagucuacacaggcugccaucgaucagaucaacgggaaacucaauagacugauuggaaagaccaacgagaaguuccaccagaucgaaaaagaguuuagcgaaguggagggccgcauucaagaccuugaaaaguacguugaggauacgaaaaucgaccugugguccuauaacgccgagcuccuggugagccuggaaaaucagcauacaauugaucucaccgacucugagaugaacaagcuguucgaaaagaccaagaagcagcuucgggagaaugcugaagauauggggaacggaugcuuuaaaaucuaccacaagugugacaaugcgugcauuggcuccaucagaaacgggacauaugaucaugacgucuaccgcgacgaggcccugaauaaccgguuccagaucaaaggcguggagcucaagagcggauacaaagauuggauucuguggaucucuuuugcuauuuccugcuuccuucuguguguugcccuccugggcuuuaucaugugggccugccaaaaggggaauauuagauguaacaucugcaucuga

SEQ ID NO: 188441 - RNA, 1701 nt, Artificial Sequence; identical to SEQ ID NO: 188375
  derived and/or modified sequence opt5 from hemagglutinin__InfluenzaA__ADK99217

SEQ ID NO: 188442 - RNA, 1701 nt, Artificial Sequence; identical to SEQ ID NO: 188375
  derived and/or modified sequence opt5 from hemagglutinin__InfluenzaA__ADK99228

SEQ ID NO: 188443 - RNA, 1701 nt, Artificial Sequence
  derived and/or modified sequence opt5 from hemagglutinin__InfluenzaA__ADK99239
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauccgcagaucuaagaacuccuuuuucagccggcugaauuggcucacacaucugaacuuuaaauauccugcccuuaaugucaccaugcccaacaacgagcaguucgacaagcuguacauuuggggcgugcaccauccugggacggauaaagaccagaucuuucucuaugcgcaagccucuggacgcauuacaguuuccaccaagagaagccagcagacagugaucccgaauauuggcucccggccccgcgucagaaacaucccuucucggaucagcauuuacuggaccaucgugaaacccggggauauucugcugaucaauuccaccggaaaccucauugcuccucgcggcuacuucaagaucagaagcgggaagucuuccaucaugcggagcgacgcccccauuggaaaauguaauucugagugcaucacaccgaacggcagcauuccuaaugacaagcccuuucagaacgugaaucgcaucacguauggcgcuuguccuagauacgucaaacaaaacacccugaaacuugccacagggaugcggaauguucccgaaaaacagacccgcggaauuuucggcgcgaucgccggguuuaucgagaacggaugggaaggcaugguggaugggugguauggauucagacaccaaaauuccgagggccggggccaggcugccgaccugaagucuacacaggcugccauugaucagaucaacgggaaacucaauagacugauuggaaagaccaacgagaaguuccaccagaucgaaaaagaguuuagcgaaguggagggccgcauucaagaccuugaaaaguacgucgaggauacgaaaaucgaccugugguccuauaacgccgagcuccugguggcucuggaaaaucagcauacaauugaucucaccgacagcgagaugaacaagcuguucgaaaagaccaagaagcagcuucgggagaaugcggaagauauggggaacggaugcuuuaaaaucuaccacaagugugacaaugccugcaucggcucuauuagaaacgggacauaugaucaugacguuuaccgcgacgaggcucugaauaaccgguuccagaucaaaggcguggagcucaaguccggauacaaagauuggauucuguggaucagcuuugccauuucuugcuuccuucugugugucgcccuccugggcuuuaucaugugggcuugccaaaaggggaauaucagauguaacauuugcaucuga

SEQ ID NO: 188444 - RNA, 1701 nt, Artificial Sequence
  derived and/or modified sequence opt5 from hemagglutinin__InfluenzaA__ADK99250
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccucuggacgcauuacaguuuccaccaagagaagccagcagacagugaucccgaacauuggcucccggccccgcgucagaaauaucccuucucggaucagcauuuacuggaccaucgugaaacccggggauauucugcugaucaacuccaccggaaaucucauugcuccucgcggcuacuucaagaucagaagcgggaaaucuuccaucaugcggagcgacgcccccauuggaaaguguaacucugaaugcaucacaccgaauggcagcauuccuaacgacaagcccuuucagaaugugaaccgcaucacguauggcgcuuguccuagauacgucaaacaaaauacccugaaacuugccacagggaugcggaacguucccgagaagcagacccgcggaauuuucggcgcgaucgccggguuuaucgaaaauggaugggagggcaugguggaugggugguauggauucagacaccagaacuccgagggccggggccaagcugccgaccugaagucuacacaggcugccauugaucagaucaaugggaaacucaacagacugauuggaaagaccaacgaaaaauuccaccagaucgagaaggaauuuagcgagguggaaggccgcauucaagacaucgagaaguacgucgaggauacgaaaauugaccuuugguccuauaaugccgaacugcucguggcucuggagaaccagcauacaaucgaucugaccgacagcgaaaugaauaaacucuucgagaagaccaagaaacagcugcgggaaaacgcggaggauauggggaauggaugcuuuaagaucuaccacaagugugacaacgccugcauuggcucuaucagaaaugggacauaugaucaugacguuuaccgcgacgaggcucuuaacaaucgguuccagauuaaaggcguggaacugaaguccggauacaaagauuggauccucuggauuagcuuugccaucucuugcuuccugcuuugugucgcccugcucggcuuuaucaugugggcuugccaaaaggggaacauuagauguaauaucugcauuuga

SEQ ID NO: 188445 - RNA, 1701 nt, Artificial Sequence; identical to SEQ ID NO: 188375
  derived and/or modified sequence opt5 from hemagglutinin__InfluenzaA__ADK99261

SEQ ID NO: 188446 - RNA, 1701 nt, Artificial Sequence
  derived and/or modified sequence opt5 from hemagglutinin__InfluenzaA__ADK99283
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauccgcagaucuaagaacuccuuuuucagccggcugaauuggcucacacaucugaacuuuaaauauccugcccuuaaugucaccaugcccaacaacgagcaguucgacaagcuguacauuuggggcgugcaccauccugggacggauaaagaccagaucuuucucuaugcgcaagccucuggacgcauuacaguuuccaccaagagaagccagcagacagugaucccgaauauuggcucccggccccgcgucagaaacaucccuucucggaucagcauuuacuggaccaucgugaaacccggggauauucugcugaucaauuccaccggaaaccucauugcuccucgcggcuacuucaagaucagaagcgggaagucuuccaucaugcggagcgacgcccccauuggaaaauguaauucugagugcaucacaccgaacggcagcauuccuaaugacaagcccuuucagaacgugaaucgcaucacguauggcgcuuguccuagauacgucaaacaaaacacccugaaacuugccacagggaugcggaauguucccgaaaagcagacccgcggaauuuucggcgcgaucgccggguuuaucgagaacggaugggaaggcaugguggaugggugguauggauucagacaccaaaauuccgagggccggggccaggcugccgaccugaagucuacacaggcugccauugaucagaucaacgggaaacucaauagacugauuggaaagaccaacgagaaguuccaccagaucgaaaaagaguuuagcgaaguggagggccgcauucaagaccuugaacgguacgucgaggauacgaagaucgaccugugguccuauaacgccgagcuccugguggcucuggaaaaucagcauacaauugaucucaccgacagcgagaugaacaaacuguucgaaaagaccaaaaagcagcuuagagagaaugcggaagauauggggaacggaugcuuuaagaucuaccacaaaugugacaaugccugcaucggcucuauucgcaacgggacauaugaucaugacguuuaccgggacgaggcucugaauaacagauuccagaucaagggcguggagcucaaauccggauacaaggauuggauucuguggaucagcuuugccauuucuugcuuccuucugugugucgcccuccugggcuuuaucaugugggcuugccaaaaagggaauauccgcuguaacauuugcaucuga

SEQ ID NO: 188447 - RNA, 1701 nt, Artificial Sequence
  derived and/or modified sequence opt5 from hemagglutinin__InfluenzaA__ADK99294
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaagauaaaaagugggaccuguucgucgagagaagcaaagccuauuccaacuguuacccuuaugaugugcccgacuacgcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaucugaacuuuaaguauccugcccuuaaugucaccaugcccaacaacgagcaguucgauaagcuguacauuuggggcgugcaccauccugggacggacaaagaucagaucuuucucuaugcgcaagccucuggacgcauuacaguuuccaccaagagaagccagcaggcugugaucccgaauauuggcucccggccccgcgucagaaacaucccuucucggaucagcauuuacuggacaaucgugaaacccggggacauucugcugaucaauuccaccggaaaccucauugccccucgcggcuacuucaagaucagaagcgggaaaucuuccaucaugcggagcgacgcucccauuggaaaguguaauucugaaugcaucaccccgaacggcagcauuccuaaugauaagcccuuucagaacgugaaucgcaucacauauggcgccuguccuagauacgucaaacaaaacacgcugaaacuugcgaccgggaugcggaauguucccgagaagcagacacgcggaauuuucggcgccaucgcuggguuuaucgaaaacggaugggagggcaugguggacgggugguauggauucagacaccaaaauuccgagggccggggccaggccgcugaucugaagucuacccaggccgccauugaccagaucaacgggaaacucaauagacugauuggaaagacaaacgaaaaauuccaccagaucgagaaggaauuuagcgagguggaaggccgcauucaagaucuugagaaguacgucgaggacaccaaaaucgaucugugguccuauaacgcugaacuccugguggcgcuggagaaucagcauacgauugaccucacagauagcgaaaugaacaagcuguucgagaaaaccaagaaacagcuucgggaaaaugccgaggacauggggaacggaugcuuuaagaucuaccacaagugugauaaugcuugcaucggcucuauuagaaacgggaccuaugaccaugacguuuaccgcgaugaggcccugaauaaccgguuccagaucaaaggcguggaacucaaguccggauacaaagacuggauucuguggaucagcuuugccauuucuugcuuccuucugugugucgcucuccugggcuuuaucaugugggccugccaaaaggggaauaucagauguaacauuugcaucuga

SEQ ID NO: 188448 - RNA, 1701 nt, Artificial Sequence; identical to SEQ ID NO: 185458
  derived and/or modified sequence opt5 from hemagglutinin__InfluenzaA__ADK99305

SEQ ID NO: 188449 - RNA, 1701 nt, Artificial Sequence; identical to SEQ ID NO: 185458
  derived and/or modified sequence opt5 from hemagglutinin__InfluenzaA__ADL27989

SEQ ID NO: 188450 - RNA, 1701 nt, Artificial Sequence
  derived and/or modified sequence opt5 from hemagglutinin__InfluenzaA__ADL28000
augaagaccaucauugcccugagcuacauccucugccugguguucgcucagaaacuucccggcaacgacaauuccacagccacgcugugucucgggcaccaugcggucccuaacggaaccaugguuaagacaauuaccaaugaucaaaucgaggugacaaacgcuaccgaacuggugcagucuagcuccacaggcgagauuugcgacucuccgcaccagauccuugaugggaaaaauuguacccugaucgacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauucgcagaucuaagaacuccuuuuucagccggcugaauuggcucacacaucugaacuuuaaauauccugcccuuaaugucaccaugcccaacaacgagcaguucgacaagcuguacaucuggggcgugcaccauccugggacggauaaagaccagauuuuucucuaugcgcaagccucugagcgcaucacaguuuccaccaagagaagccagcagacagugauuccgaauaucggaucccggccccgcgucagaaacauuccuucucggaucagcaucuacuggaccauugugaaacccggcgauauccugcugauuaauuccaccgggaaccucaucgcuccucgcggauacuucaagauuagaagcggcaagucuuccaucaugcggagcgacgcccccaucgggaaauguaauucugaaugcauuacaccgaacggaagcaucccuaaugacaagcccuuucagaacgugaaucgcauuacguauggcgcuuguccuagauacgucaaacaauccacccugaagcuggccacaggcaugcggaacguucccgagaaacagacccgcgggaucuucggagcgauugccggcuuuaucgaaaaugggugggagggaaugguggauggcugguauggguucagacaccagaacucugagggacggggccaagcugccgaccuuaagagcacacaggcugccaucgaucagauuaauggcaaacucaacagacugaucgggaagaccaaugaaaaguuccaccagauugagaaagaauuuuccgagguggaaggacgcauccaagaccuugagaaguacgucgaggauacgaaaauugaccuguggagcuauaacgccgaacuccugguggcucuggagaaccagcauacaaucgaucucaccgacucugaaaugaauaagcuguucgagaaaaccaagaagcagcuucgggaaaacgcggaggauaugggcaaugggugcuuuaaaauuuaccacaagugugacaacgccugcaucggauccaucagaaauggcacauaugaucaugacguuuaccgcgacgaggcucugaacaaucgguuccagauuaaagggguggaacucaagagcggcuacaaagauuggauccuguggauuucuuuugccaucuccugcuuccuucugugugucgcccuccugggauuuauuaugugggcuugccaaaagggcaacaucagauguaauaucugcauuuga

SEQ ID NO: 188451 - RNA, 1701 nt, Artificial Sequence
  derived and/or modified sequence opt5 from hemagglutinin__InfluenzaA__ADL28011
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccucuggacgcauuacaguuuccaccagacggagccagcagacagugaucccgaacauuggcucccgccccagaguccggaauaucccuucucgcaucagcauuuacuggaccaucgugaagcccggggauauucugcugaucaacuccaccggaaaucucauugcuccuagaggcuacuucaaaauccggagcgggaagucuuccaucaugcgcagcgacgcccccauuggaaaauguaacucugaaugcaucacaccgaauggcagcauuccuaacgacaagcccuuucagaaugugaacagaaucacguauggcgcuuguccucgguacgucaagcaaaauacccugaaacuugccacagggaugcgcaacguucccgagaagcagaccagaggaauuuucggcgcgaucgccggguuuaucgaaaauggaugggagggcaugguggaugggugguauggauuccggcaccagaacuccgagggcagaggccaagcugccgaccugaaaucuacacaggcugccauugaucagaucaaugggaagcucaaccgccugauuggaaaaaccaacgaaaaguuccaccagaucgagaaagaauuuagcgagguggaaggccggauucaagaccuugagaaguacgucgaggauacgaagaucgaccugugguccuauaaugccgaacuccugguggcucuggagaaccagcauacaauugaucucaccgacagcgaaaugaauaaacuguucgagaagaccaaaaagcagcuuagagaaaacgcggaggauauggggaauggaugcuuuaaaaucuaccacaagugugacaacgccugcaucggcucuauucgcaaugggacauaugaucaugacguuuaccgggacgaggcucugaacaauagauuccagaucaagggcguggaacucaaauccggauacaaggauuggauucuguggaucagcuuugccauuucuugcuuccuucugugugucgcccuccugggcuuuaucaugugggcuugccaaaaagggaacauccgcuguaauauuugcaucuga

SEQ ID NO: 188452 - RNA, 1701 nt, Artificial Sequence; identical to SEQ ID NO: 188375
  derived and/or modified sequence opt5 from hemagglutinin__InfluenzaA__ADL28022

SEQ ID NO: 188453 - RNA, 1701 nt, Artificial Sequence; identical to SEQ ID NO: 185458
  derived and/or modified sequence opt5 from hemagglutinin__InfluenzaA__ADL28033

SEQ ID NO: 188454 - RNA, 1701 nt, Artificial Sequence; identical to SEQ ID NO: 186637
  derived and/or modified sequence opt5 from hemagglutinin__InfluenzaA__ADL28044

SEQ ID NO: 188455 - RNA, 1701 nt, Artificial Sequence
  derived and/or modified sequence opt5 from hemagglutinin__InfluenzaA__ADL28055
augaagaccaucguggcccugagcuacauucucugccuggucuucgcucagaaacuucccggcaacgacaauuccacagccacgcugugucucgggcaccaugcgguuccuaacggaaccaucgugaagacaauuaccaaugaucaaaucgaggugacaaacgcuaccgaacugguccagucuagcuccacaggcgagauuugcgacucuccgcaccagauccuugauggggaaaauuguacccugaucgacgcccuccugggagauccccagugcgacggcuuucaaaacaaaaagugggaucuguucguggagagaagcaaagccuauuccaauuguuacccuuaugacguucccgauuacgcuucucuccggagccugguggccuccagcgggacgcuugaauuuaacaaugagucuuucaacuggaccggagucacacagaauggcaccuccagcgcuugcauucgcagaucuaacaauuccuuuuucagccggcugaacuggcucacacaucugaaguuuaaguauccugcccuuaaugugaccaugcccaacaacgagcaguucgacaaacuguacaucuggggcguucaccauccugggacggauaaugaccagauuuuucucuaugcgcaagccucuggacgcaucacaguguccaccaagagaagccagcagacagucauuccgaacaucggcucccggccccgcgugagaaauauuccuucucggaucagcaucuacuggaccauugugaaacccggggauauccugcugauuaacuccaccggaaaucucaucgcuccucgcggcuacuucaagauuagaagcgggaaaucuuccaucaugcggagcgacgcccccaucggaaaguguaacucugaaugcauuacaccgaauggcagcaucccuaacgacaagcccuuucagaaugucaaccgcauuacguauggcgcuuguccuagauacguuaaacaaaauacccugaaacuugccacagggaugcggaacgugcccgagaagcagacccgcggaaucuucggcgcgauugccggguuuaucgaaaauggaugggagggcaugguggaugggugguauggauucagacaccagaacuccgagggccggggccaagcugccgaccugaagucuacacaggcugccaucgaucagauuaaugggaaacucaacagacugaucggaaagaccaacgaaaaauuccaccagauugagaaggaauuuagcgaggucgaaggccgcauccaagaccuugagaaguacguggaggauacgaaaauugaccugugguccuauaaugccgaacuccugguugcucuggagaaccagcauacaaucgaucucaccgacagcgaaaugaauaagcuguucgagaaaaccaagaaacagcuucgggaaaacgcggaggauauggggaauggaugcuuuaagauuuaccacaagugugacaacgccugcaucggcucuaucagaaaugggacauaugaucaugacguguaccgcgacgaggcucugaacaaucgguuccagauuaaaggcgucgaacucaaguccggauacaaagauuggauccuguggauuagcuuugccaucucuugcuuccuucuguguguggcccuccugggcuuuauuaugugggcuugccaaaaggggaacaucagauguaauaucugcauuuga

SEQ ID NO: 188456 - RNA, 1701 nt, Artificial Sequence; identical to SEQ ID NO: 185458
  derived and/or modified sequence opt5 from hemagglutinin__InfluenzaA__ADL28066

SEQ ID NO: 188457 - RNA, 1701 nt, Artificial Sequence; identical to SEQ ID NO: 188375
  derived and/or modified sequence opt5 from hemagglutinin__InfluenzaA__ADL28077

SEQ ID NO: 188458 - RNA, 1701 nt, Artificial Sequence
  derived and/or modified sequence opt5 from hemagglutinin__InfluenzaA__ADL28088
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuauucucaagcguccggacgcauuacaguuagcaccaagagaucccagcagacagugaucccgaacauuggcucucggccccgcgucagaaauaucccuagccggaucuccauuuacuggaccaucgugaaacccggggauauucugcugaucaacagcaccggaaaucucauugccccucgcggcuacuucaagaucagaucugggaaauccagcaucaugcggucugacgcucccauuggaaaguguaacagcgaaugcaucacaccgaauggcuccauuccuaacgacaagcccuuucagaaugugaaccgcaucacguauggcgccuguccuagauacgucaaacaaaauacccugaagcuggcuacagggaugcggaacguucccgagaaacagacccgcggaauuuucggcgccaucgcgggguuuaucgaaaauggaugggagggcaugguggaugggugguauggauucagacaccagaacucugagggccggggccaagccgcugaccuuaagagcacacaggccgcuauugaucagaucaaugggaaacucaacagacugauuggaaagaccaacgaaaaauuccaccagaucgagaaggaauuuuccgagguggaaggccgcauucaagaccuugagaaguacgucgaggauacgaaaaucgaccuguggagcuauaaugccgaacuccugguggcccuggagaaccagcauacaauugaucucaccgacucugaaaugaauaagcuguucgagaaaaccaagaaacagcuucgggaaaacgcugaggauauggggaauggaugcuuuaagaucuaccacaagugugacaacgcgugcaucggcuccauuagaaaugggacauaugaucaugacguuuaccgcgacgaggcccugaacaaucgguuccagaucaaaggcguggaacucaagagcggauacaaagauuggauucuguggaucucuuuugcuauuuccugcuuccuucugugugucgcccuccugggcuuuaucaugugggccugccaaaaggggaacaucagauguaauauuugcaucuga

SEQ ID NO: 188459 - RNA, 1701 nt, Artificial Sequence; identical to SEQ ID NO: 185458
  derived and/or modified sequence opt5 from hemagglutinin__InfluenzaA__ADL28099

SEQ ID NO: 188460 - RNA, 1701 nt, Artificial Sequence
  derived and/or modified sequence opt5 from hemagglutinin__InfluenzaA__ADL28110
augaagaccaucauugcccugagcuacauccucugccugguguucgcucagaaacuucccggcaacgacaauuccacagccacgcuguguauugggcaccaugcggucccuaacggaaccaucguuaagacaauuaccaaugaucaaaucgaggugacaaacgcuaccgaacucgugcaaaauucuagcacaggcgagaucugcgacuccccgcaccagauucuggaugggaaaaacuguacccuuaucgacgcccugcucggagauccccagugcgacggcuuucagaauaagaaaugggaucuguucgucgaaagaucuaaggccuauagcaacuguuacccuuaugacgugcccgauuacgcuucccugcggucucucguugccagcuccgggacgcuggaguuuaauaacgaaucuuucaauuggaccggagugacacagaacggcaccucuuccgcuugcauucgcagaagcaagaauagcuuuuucucccggcuuaacuggcugacacaucucaauuuuaaauauccugcccugaacgucaccaugcccaacaaugagcaguucgacaaacuuuacaucuggggcgugcaccauccugggacggauaaagaccagauuuuucuguaugcgcaagccagcggacgcaucacaguuucuaccaagagaucccagcagacagcuauuccgaacaucggcagccggccccgcgugagaaauaucccuucccggauuucuaucuacuggaccauugucaaacccggggauauccuccugauuaacagcaccggaaaucugaucgccccucgcggcuacuucaagaucagauccggaaagagcucuauuaugcgguccgacgcucccaucgacaaauguaacagcgagugcauuacaccgaaugggucuaucccuaacgauaagcccuuucagaaugugaaccgcauuacguauggcgccuguccuagauacgugaaacaaaauacccucaagcuggcgacaggcaugcggaacguccccgaaaaacagacccgcgggaucuucggagccaucgcuggcuuuauugagaaugggugggaaggaaugguugacggcugguauggguucagacaccagaacagcgagggacggggccaagccgcugaucuuaaguccacacaggccgccaucgaccagauuaauggcaaacugaacagacucaucgggaagaccaacgagaaguuccaccagauugaaaaagaguuuucugaaguggagggacgcauccaagaucuggaaaaguacguggaggacacgaaaauugaucuuuggagcuauaaugcugagcugcucgucgcgcuggaaaaccagcauacaaucgaccugaccgauuccgagaugaauaaacucuucgaaaagaccaagaagcagcugcgggagaacgccgaagacaugggcaaugggugcuuuaagaucuaccacaagugugauaacgcuugcauuggaagcaucagaaauggcacauaugaccaugacguguaccgcgaugaggcccuuaacaaucgguuccagauuaaagggguugagcugaagucuggcuacaaagacuggauccucuggauuuccuuugccaucagcugcuuccugcuuuguguggcucugcucggauuuaucaugugggccugccaaaagggcaacauuagauguaauaucugcauuuga

SEQ ID NO: 188461 - RNA, 1701 nt, Artificial Sequence
  derived and/or modified sequence opt5 from hemagglutinin__InfluenzaA__ADL28126
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugaaucagaacggcacauccagcgcuugcauccgcagaucuaauaacuccuuuuucagccggcugaauuggcucacccaucugaaguuuaaguauccugcccuuaacgucacaaugcccaacaaugagcaguucgacaaacuguacauuuggggcgugcaccauccugggaccgauaacgaccagaucuuucucuaugcgcaagccucuggacgcauuacgguuuccacaaagagaagccagcagaccgugaucccgaauauuggcucccggccccgcgucagaaacaucccuucucggaucagcauuuacuggacaaucgugaaacccggggauauucugcugaucaauuccaccggaaaccucauugcuccucgcggcuacuucaagaucagaagcgggaaaucuuccaucaugcggagcgacgcccccauuggaaaguguaauucugaaugcaucaccccgaacggcagcauuccuaaugacaagcccuuucagaacgugaaucgcaucacauauggcgcuuguccuagauacgucaaacaaaacacgcugaaacuugccaccgggaugcggaauguucccgagaagcagacacgcggaauuuucggcgcgaucgccggguuuaucgaaaacggaugggagggcaugguggaugggugguauggauucagacaccaaaauuccgagggccggggccaggcugccgaccugaagucuacccaggcugccauugaucagaucaacgggaaacucaacagacugauuggaaagacaaaugaaaaauuccaccagaucgagaaggaauuuagcgagguggaaggccgcauucaagaccuugagaaguacgucgaggauaccaaaaucgaccugugguccuauaacgccgaacuccugguggcucuggagaaucagcauacgauugaucucacagacagcgaaaugaacaagcuguucgagaaaaccaagaaacagcuucgggaaaaugcggaggauauggggaacggaugcuuuaagaucuaccacaagugugacaaugccugcaucggcucuauuagaaacgggaccuaugaucaugacguuuaccgcgacgaggcucugaauaaccgguuccagaucaaaggcguggaacucaaguccggauacaaagauuggauucuguggaucagcuuugccauuucuugcuuccuucugugugucgcccuccugggcuuuaucaugugggcuugccaaaaggggaauaucagauguaacauuugcaucuga

SEQ ID NO: 188462 - RNA, 1701 nt, Artificial Sequence
  derived and/or modified sequence opt5 from hemagglutinin__InfluenzaA__ADL28137
augaagaccaucauugcccugagcuacauccucugccugguguccgcucagaaacuucccggcaacgacaauucuacagccacgcugugucucgggcaccaugcggucccuaacggaaccauuguuaagacaaucaccaaugaucaaauugaggugacaaacgcuaccgaacuggugcagagcuccucuacaggcgagaucugcgacgggccgcaccagauccuugauggagaaaauuguacccugauugacgcccuccugggcgauccccagugcgacggguuccaaaacaaaaagugggaucuguuugucgagagaagcaaagccuauuccaauuguuacccuuaugacgugcccgauuacgcuucucuccggagccugguugccuccagcggaacgcuugaguucaacaaugaaucuuuuaacuggaccggcgugacacagaauggcaccuccagcgcuugcauccgcagaucuaacaauuccuucuuuagccggcugaacuggcucacacaucugaaguucaaguauccugcccuuaaugucaccaugcccaacaacgagcaguuugacaaacuguacauuuggggagugcaccauccugggacggauaaugaccagaucuuccucuaugcgcaagccucuggccgcauuacaguuuccaccaagagaagccagcagacagugaucccgaacauugggucccggccccgcgucagaaauaucccuucucggaucagcauuuacuggaccaucgugaaacccggagauauucugcugaucaacuccaccggcaaucucauugcuccucgcggguacuuuaagaucagaagcggaaaaucuuccaucaugcggagcgacgcccccauuggcaaguguaacucugaaugcaucacaccgaauggcagcauuccuaacgacaagcccuuccagaaugugaaccgcaucacguauggggcuuguccuagauacgucaaacaaaauacccugaaacuugccacaggaaugcggaacguucccgagaagcagacccgcggcauuuuuggggcgaucgccggauucaucgaaaauggcugggaggggaugguggauggaugguauggcuuuagacaccagaacuccgagggccgggggcaagcugccgaccugaagucuacacaggcugccauugaucagaucaauggaaaacucaacagacugauuggcaagaccaacgaaaaauuccaccagaucgagaaggaguucagcgaaguggaagggcgcauucaagaccuugagaaguacgucgaggauacgaaaaucgaccugugguccuauaaugccgaacuccugguggcucuggagaaccagcauacaauugaucucaccgacagcgaaaugaauaagcuguuugagaaaaccaagaaacagcuucgggaaaacgcggaggauaugggaaauggcugcuucaagaucuaccacaagugugacaacgccugcaucgggucuauuagaaauggcacauaugaucaugacguuuaccgcgacgaggcucugaacaaucgguuucagaucaaaggaguggaacucaaguccggcuacaaagauuggauucuguggaucagcuucgccauuucuugcuuucuucugugugucgcccuccugggguucaucaugugggcuugccaaaagggaaacaucagauguaauauuugcaucuga

SEQ ID NO: 188463 - RNA, 1701 nt, Artificial Sequence; identical to SEQ ID NO: 185458
  derived and/or modified sequence opt5 from hemagglutinin__InfluenzaA__ADL28148

SEQ ID NO: 188464 - RNA, 1701 nt, Artificial Sequence; identical to SEQ ID NO: 188375
  derived and/or modified sequence opt5 from hemagglutinin__InfluenzaA__ADL28170

SEQ ID NO: 188465 - RNA, 1701 nt, Artificial Sequence; identical to SEQ ID NO: 185458
  derived and/or modified sequence opt5 from hemagglutinin__InfluenzaA__ADL28181

SEQ ID NO: 188466 - RNA, 1701 nt, Artificial Sequence; identical to SEQ ID NO: 188370
  derived and/or modified sequence opt5 from hemagglutinin__InfluenzaA__ADL28192

SEQ ID NO: 188467 - RNA, 1701 nt, Artificial Sequence; identical to SEQ ID NO: 188376
  derived and/or modified sequence opt5 from hemagglutinin__InfluenzaA__ADL28203

SEQ ID NO: 188468 - RNA, 1701 nt, Artificial Sequence; identical to SEQ ID NO: 186435
  derived and/or modified sequence opt5 from hemagglutinin__InfluenzaA__ADL28214

SEQ ID NO: 188469 - RNA, 1701 nt, Artificial Sequence
  derived and/or modified sequence opt5 from hemagglutinin__InfluenzaA__ADL28225
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuauucucaagcguccggacgcauuacaguuagcaccaagagaucccagcagacagugaucccgaacauuggcucucggccccgcgucagaaauaucccuagccggaucuccauuuacuggaccaucgugaaacccggggauauucugcugaucaacagcaccggaaaucucauugccccucgcggcuacuucaagaucagaucugggaaauccagcaucaugcggucugacgcucccauuggaaaguguaacagcgaaugcaucacaccgaauggcuccauuccuaacgacaagcccuuucagaaugugaaccgcaucacguauggcgccuguccuagauacgucaaacaaaauacccugaagcuggcuacagggaugcggaacguucccgagaaacagacccgcggaauuuucggcgccaucgcgggguuuaucgaaaauggaugggagggcaugguggaugggugguauggauucagacaccagaacucugagggccggggccaagccgcugaccuuaagagcacacaggccgcuauugaucagaucaaugggaaacucaacagacugauuggaaagaccaacgaaaaauuccaccagaucgagaaggaauuuuccgagguggaaggccgcauucaagaccuugagaaguacgucgaggauacgaaaacagaccuguggagcuauaaugccgaacuccugguggcccuggagaaccagcauaccaucgaucucaccgacucugaaaugaauaagcuguucgagaaaacaaagaaacagcuucgggaaaacgcugaggauauggggaauggaugcuuuaagauuuaccacaagugugacaacgcgugcaucggcuccaucagaaaugggaccuaugaucaugacguuuaccgcgacgaggcccugaacaaucgguuccagauuaaaggcguggaacucaagagcggauacaaagauuggauccuguggauuucuuuugcuaucuccugcuuccuucugugugucgcccuccugggcuuuauuaugugggccugccaaaaggggaacaucagauguaauaucugcauuuga

SEQ ID NO: 188470 - RNA, 1701 nt, Artificial Sequence; identical to SEQ ID NO: 188375
  derived and/or modified sequence opt5 from hemagglutinin__InfluenzaA__ADL28236

SEQ ID NO: 188471 - RNA, 1701 nt, Artificial Sequence; identical to SEQ ID NO: 185458
  derived and/or modified sequence opt5 from hemagglutinin__InfluenzaA__ADL28247

SEQ ID NO: 188472 - RNA, 1701 nt, Artificial Sequence; identical to SEQ ID NO: 188388
  derived and/or modified sequence opt5 from hemagglutinin__InfluenzaA__ADL28258

SEQ ID NO: 188473 - RNA, 1701 nt, Artificial Sequence; identical to SEQ ID NO: 185458
  derived and/or modified sequence opt5 from hemagglutinin__InfluenzaA__ADL28370

SEQ ID NO: 188474 - RNA, 1701 nt, Artificial Sequence; identical to SEQ ID NO: 185693
  derived and/or modified sequence opt5 from hemagglutinin__InfluenzaA__ADL29672

SEQ ID NO: 188475 - RNA, 1701 nt, Artificial Sequence; identical to SEQ ID NO: 185935
  derived and/or modified sequence opt5 from hemagglutinin__InfluenzaA__ADL29682

SEQ ID NO: 188476 - RNA, 1701 nt, Artificial Sequence; identical to SEQ ID NO: 185693
  derived and/or modified sequence opt5 from hemagglutinin__InfluenzaA__ADL29692

SEQ ID NO: 188477 - RNA, 1701 nt, Artificial Sequence
  derived and/or modified sequence opt5 from hemagglutinin__InfluenzaA__ADL29702
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacacauacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacgagauuacgaauaaggucaacuccgugaucgagaaaaugaauacacaguuuaccgccguuggaaaggaguucaaccaccuugagaagagaauugaaaaucugaacaaaaagaucgaugacggcuuccucgauauuuggaccuacaaugcugagcugcuggugcuccuggaaaacgagcggacacuugacuaucaugauagcaaugucaaaaaccuguacgagaaggugcgcaaccagcucaaaaauaacgccaaggaaaucgggaauggauguuuugaguucuaucacaagugcgacaacaccuguauggaaucugucaaaaauggcacauacgauuauccuaaguacuccgaggaagccaaacugaacagagaggagaucgacggggugaaacuugaaagcacgcggauuuaucaaauccuggcuauuuacucuaccguugccuccagccucgugcuggucgugucccugggcgcgaucucuuuuuggaugugcagcaauggaucccuccagugccgcauuuguaucuga

SEQ ID NO: 188478 - RNA, 1701 nt, Artificial Sequence; identical to SEQ ID NO: 185693
  derived and/or modified sequence opt5 from hemagglutinin__InfluenzaA__ADL29730

SEQ ID NO: 188479 - RNA, 1701 nt, Artificial Sequence; identical to SEQ ID NO: 185693
  derived and/or modified sequence opt5 from hemagglutinin__InfluenzaA__ADL29740

SEQ ID NO: 188480 - RNA, 1701 nt, Artificial Sequence; identical to SEQ ID NO: 185693
  derived and/or modified sequence opt5 from hemagglutinin__InfluenzaA__ADL29750

SEQ ID NO: 188481 - RNA, 1701 nt, Artificial Sequence
  derived and/or modified sequence opt5 from hemagglutinin__InfluenzaA__ADL29760
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaauacaagcacaaugggaaacuuuguaagcugagaggaguugcuccccuccaucugggcaaaugcaacaucgccggguggauucugggaaauccugagugugaaucucucagcacagccuccucuuggagcuauaucguggagaccuccucuagcgauaacggcacgugcuacccgggggacuuuauugauuaugaagaacugcgggagcagcuuuccagcgucucuuccuucgaacgcuuugagaucuuccccaagaccagcucuuggccuaaucacgacuccaacaagggagugacagccgcuuguccccaugccggcgcgaaaucuuuuuacaagaaucugaucuggcucguuaaaaagggcaacagcuauccuaaacuguccaagagcuacauuaaugauaaggggaaagaagugcuuguccuguggggaauccaccaccccuccaccucugccgaccaacagagccucuaccagaacgcugaugccuauguguucgugggcacauccagauacagcaagaaauuuaagccugagauugcuauccggccgaaaguccgcgaccaggaggggagaaugaauuauuacuggacccugguugaacccggagauaagauuacguucgaggccacaggcaaccugguggugccucgguaugcguuugccauggaacgcaacgcugggucuggaaucauuaucuccgacacccccguccaugauugcaauacaaccugucaaaccccuaaaggcgccaucaacacaagccuccccuuccagaauauucacccgaucacgauuggcaagugcccuaaguacgugaaaucuaccaagcugagacuugcuacagggcugcggaacguucccagcauccagucccgcggacucuuuggcgccauugccggguucaucgagggaggcuggaccgggaugguggacggaugguauggcuaccaucaccagaaugaacaaggcucuggguacgcugcggaccugaaaagcacacagaacgccaucgaugagauuaccaauaaggucaacuccgugaucgagaaaaugaauacgcaguuuacagcuguuggaaaggaguucaaccaccuugagaagagaauugaaaaucugaacaaaaagguggacgauggcuuccucgacaucuggaccuauaaugccgagcugcugguccuccuggaaaacgagcggacccuugauuaccaugacagcaaugugaaaaaccuguaugagaagguccgcucucagcucaaaaacaaugccaaggaaauugggaacggauguuuugaguucuaccacaagugcgauaauacauguauggaauccgugaaaaacggcaccuaugacuacccuaaguauagcgaggaagcuaaacugaauagagaggagaucgaugggguuaaacuugaaucuacacggaucuaccaaauucuggccaucuacuccacgguggcgagcucccucguccuggugguuucucugggcgcuauuagcuuuuggaugugcuccaacggaucucuccagugccgcaucuguauuuga

SEQ ID NO: 188482 - RNA, 1701 nt, Artificial Sequence; identical to SEQ ID NO: 185693
  derived and/or modified sequence opt5 from hemagglutinin__InfluenzaA__ADL29770

SEQ ID NO: 188483 - RNA, 1701 nt, Artificial Sequence; identical to SEQ ID NO: 187193
  derived and/or modified sequence opt5 from hemagglutinin__InfluenzaA__ADL29780

SEQ ID NO: 188484 - RNA, 1701 nt, Artificial Sequence
  derived and/or modified sequence opt5 from hemagglutinin__InfluenzaA__ADL29879
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacuccuacguguucgugggcacaagcaaguauucuaaaaaguuuaaaccugagauugccaucagaccgaagguccgggaucaggaggggcgcaugaauuacuauuggacccugguugaacccggagacaaaauuacguucgaggcuacaggcaaccugguggugccuagauacgccuuugcgauggaacggaacgccggguccggaaucauuaucagcgauacccccguccaugacugcaauacaaccugucaaaccccuaagggcgcuaucaacacaucucuccccuuccagaauauucacccgaucacgauuggcaagugcccuaaauauguuaagagcaccaaacugcgccuugccacagggcugagaaacgugcccuccauccagucucggggacucuuuggcgcuauugccggguucaucgagggaggcuggaccgggaugguggacggaugguacggcuaucaucaccagaaugaacaaggcagcggguacgccgcugaucugaaguccacacagaacgcgaucgacgagauuaccaauaaagucaacagcgugaucgagaagaugaauacgcaguuuacagccguuggaaaggaguucaaccaccuugagaaacgcauugaaaaucugaacaagaaaguggaugacggcuuccucgauaucuggaccuacaaugcugagcugcugguccuccuggaaaacgagagaacccuugacuaucaugauucuaaugugaagaaccuguacgagaaaguccggucccagcucaagaacaaugccaaggaaauugggaacggauguuuugaguucuaucacaaaugcgacaauacauguauggaaagcgugaagaacggcaccuacgauuauccuaaauacucugaggaagccaagcugaaucgcgaggagaucgacgggguuaaacuugaauccacaagaaucuaucaaauucuggcuaucuacagcacgguggccuccucucucguccuggugguuagccugggcgcgauuuccuuuuggaugugcucuaacggaagccuccagugccggaucuguauuuga

SEQ ID NO: 188485 - RNA, 1701 nt, Artificial Sequence
  derived and/or modified sequence opt5 from hemagglutinin__InfluenzaA__ADL32017
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuugucagcugagaggaguugcgccccuccaucugggcaagugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgggagcaacuuuccagcgucucuuccuucgaacgcuuugagaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaagugcuuguccuguggggaauccaccaccccuccaccucugccgaucagcagagccucuaccagaacgcugacacauacguguucgugggcaccuccagauauagcaaaaaguuuaaaccugagauugccauccggccgaagguccgcgaucaagaggggagaaugaauuacuauuggacgcugguugaacccggagacaaaauuacauucgaggcuaccggcaaccugguggugccucgguacgccuuugcgauggaacgcaacgccgggucuggaaucauuaucuccgauacacccguccaugacugcaauaccaccugucagacaccuaagggcgcuaucaacacgagccuccccuuccagaauauucacccgaucaccauuggcaaaugcccuaaguaugugaagucuacaaaacugagacuugccaccgggcugcggaacguucccagcauccagucccgcggacucuuuggcgcuauugccggguucaucgagggaggcuggacagggaugguggacggaugguacggcuaucaucaccaaaaugaacagggcucuggguacgccgcugaucuuaagagcacccagaacgcgaucgacgagauuacgaauaaagucaacuccgugaucgagaagaugaauacacaguuuaccgccguuggaaaagaguucaaccaccuggagaagagaauugaaaaucugaacaagaaaaucgaugacggcuuccucgauauuuggaccuacaaugcugagcugcuggugcuccuggaaaacgagcggacacuugacuaucaugauagcaaugucaagaaccuguacgagaaagugcgcucucaacucaagaacaaugccaaagaaaucgggaacggauguuuugaguucuaucacaagugcgacaauaccuguauggaauccgucaagaacggcacauacgauuauccuaaauacagcgaggaagccaagcugaauagagaggagaucgacggggugaaacuugaaucuacgcggauuuaucagauccuggcuauuuacuccaccguugccagcucccucgugcuggucgugucucugggcgcgaucagcuuuuggaugugcuccaacggaucucuccagugccgcauuuguaucuga

SEQ ID NO: 188486 - RNA, 1701 nt, Artificial Sequence
  derived and/or modified sequence opt5 from hemagglutinin__InfluenzaA__ADL32037
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucuguggaucaacagagccucuaccagaacgccgacgcuuacguguucgucggcacauccagauauagcaagaaauuuaagccugagauugccauccggccgaaaguucgcgaucaggaggggagaaugaauuacuauuggacccugguggaacccggagacaagauuacguucgaggcuacaggcaaccugguggucccucgguacgccuuugcgauggaacgcaacgccgggucuggaaucauuaucuccgauacccccgugcaugacugcaauacaaccugucaaaccccuaaaggcgcuaucaacacaagccuccccuuccagaauauucacccgaucacgauuggcaagugcccuaaguauguuaaaucuaccaagcugagacuugccacagggcugcggaacgugcccagcauccagucccgcggacucuuuggcgcuauugccggguucaucgagggaggcuggaccgggauggucgacggaugguacggcuaucaucaccagaaugaacaaggcucuggguacgccgcugaucugaaaagcacacagaacgcgaucgacgagauuaccaauaaggugaacuccguuaucgagaaaaugaauacgcaguuuacagccgugggaaaggaguucaaccaccuugagaagagaauugaaaaucugaacaaaaaggucgaugacggcuuccucgauaucuggaccuacaaugcugagcugcuggugcuccuggaaaacgagcggacccuugacuaucaugauagcaaugucaaaaaccuguacgagaaggugcgcucucagcucaaaaacaaugccaaggaaauugggaacggauguuuugaguucuaucacaagugcgacaauacauguauggaauccguuaaaaacggcaccuacgauuauccuaaguacagcgaggaagccaaacugaauagagaggagaucgacggggugaaacuugaaucuacacggaucuaucaaauucuggcuaucuacuccacggucgccagcucccucgugcugguugugucucugggcgcgauuagcuuuuggaugugcuccaacggaucucuccagugccgcaucuguauuuga

SEQ ID NO: 188487 - RNA, 1701 nt, Artificial Sequence; identical to SEQ ID NO: 185693
  derived and/or modified sequence opt5 from hemagglutinin__InfluenzaA__ADL32047

SEQ ID NO: 188488 - RNA, 1701 nt, Artificial Sequence
  derived and/or modified sequence opt5 from hemagglutinin__InfluenzaA__ADL32057
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaggagcugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagggccucuaccagaacgcugacgccuacguguucguggggacaagcagauauuccaagaaauuuaagccugagauugcuauccggccgaaaguccgcgaucaggagggaagaaugaauuacuauuggacccugguugaacccggcgacaagauuacguucgaggccacagggaaccugguggugccucgguacgcguuugccauggaacgcaacgcuggaagcggcaucauuaucucugauacccccguccaugacugcaauacaaccugucaaaccccuaaaggcgccaucaacacaucccuccccuuccagaauauucacccgaucacgauugggaagugcccuaaguaugugaaaggaaccaagcugagacuugcuacaggccugcggaacguucccagcauccagucucgcgggcucuuuggagccauugccggcuucaucgaagggggauggaccggcaugguggacggcugguacggguaucaucaccagaaugaacaaggaagcggcuacgcugcggaucugaaauccacacagaacgccaucgacgagauuaccaauaaggucaacucugugaucgagaaaaugaauacgcaguuuacagcuguugggaaggaguucaaccaccuugaaaagagaauugaaaaucugaacaaaaagguggaugacggauuccucgauaucuggaccuacaaugccgagcugcugguccuccuggaaaacgagcggacccuugacuaucaugauagcaaugugaaaaaccuguacgagaagguccgcucccagcucaaaaacaaugccaaggaaauuggcaacggguguuuugaguucuaucacaagugcgacaauacauguauggaaagcgugaaaaacggcaccuacgauuauccuaaguacucugaggaagcuaaacugaauagagaggagaucgacggaguuaaacuugaauccacacggaucuaucaaauucuggccaucuacagcacgguggcgucuucccucguccuggugguuagccugggcgcuauuuccuuuuggaugugcucuaacgggagccuccagugccgcaucuguauuuga

SEQ ID NO: 188489 - RNA, 1701 nt, Artificial Sequence; identical to SEQ ID NO: 185693
  derived and/or modified sequence opt5 from hemagglutinin__InfluenzaA__ADL32090

SEQ ID NO: 188490 - RNA, 1701 nt, Artificial Sequence; identical to SEQ ID NO: 185693
  derived and/or modified sequence opt5 from hemagglutinin__InfluenzaA__ADL32114

SEQ ID NO: 188491 - RNA, 1701 nt, Artificial Sequence; identical to SEQ ID NO: 185693
  derived and/or modified sequence opt5 from hemagglutinin__InfluenzaA__ADL32344

SEQ ID NO: 188492 - RNA, 1701 nt, Artificial Sequence; identical to SEQ ID NO: 186140
  derived and/or modified sequence opt5 from hemagglutinin__InfluenzaA__ADL32354

SEQ ID NO: 188493 - RNA, 1701 nt, Artificial Sequence
  derived and/or modified sequence opt5 from hemagglutinin__InfluenzaA__ADL32364
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccaucuccuggucuuacauuguggagaccagcuccucugacaacggcacgugcuauccgggggauuuuaucgacuacgaagaacugcgggagcagcuuagcuccgucagcucuuucgaacgcuuugagaucuuccccaagaccuccagcuggccuaaucacgauucuaacaagggagugacagccgcuuguccccaugccggcgcgaaauccuuuuauaagaaucugauuuggcucguuaaaaagggcaacagcuacccuaaacugucuaaguccuauaucaaugacaaggggaaagaagugcuuguccuguggggcauucaccaccccagcaccuccgccgaucaacagucucucuaccagaacgcugacacauacguguucgugggaaccagcagauauuccaagaaauuuaagccugagaucgccauucggccgaaaguccgcgaucaggaggggagaaugaauuacuauuggacgcugguugaacccggagacaagaucacauucgaggcuaccggcaaccugguggugccucgguacgccuuugcgauggaacgcaacgccgggagcggaauuaucaucucugauacacccguccaugacugcaauaccaccugucaaacaccuaaaggcgcuauuaacacgucccuccccuuccagaauauccacccgauuaccaucggcaagugcccuaaguaugugaaaagcacaaagcugagacuugccaccgggcugcggaacguucccucuauucagagccgcggacucuuuggcgcuaucgccggguucaucgagggaggcuggacagggaugguggacggaugguacggcuaucaucaccagaaugaacaaggcuccggguacgccgcugaucugaaaucuacccagaacgcgauugacgagaucacgaauaaggucaacagcgugauugagaaaaugaauacacaguuuaccgccguuggaaaggaguucaaccaccuugagaagagaaucgaaaaucugaacaaaaagauugaugacggcuuccucgauaucuggaccuacaaugcugagcugcuggugcuccuggaaaacgagcggacacuugacuaucaugauuccaaugucaaaaaccuguacgagaaggugcgcagccagcucaaaaacaaugccaaggaaaucgggaacggauguuuugaguucuaucacaagugcgacaauaccuguauggaaucugucaaaaacggcacauacgauuauccuaaguacuccgaggaagccaaacugaauagagaggagauugacggggugaaacuugaaagcacgcggaucuaucaaauucuggcuaucuacucuaccguugccuccagccucgugcuggucgugucccugggcgcgauuucuuuuuggaugugcagcaacggaucccuccagugccgcaucuguauuuga

SEQ ID NO: 188494 - RNA, 1701 nt, Artificial Sequence; identical to SEQ ID NO: 185693
  derived and/or modified sequence opt5 from hemagglutinin__InfluenzaA__ADL32374

SEQ ID NO: 188495 - RNA, 1701 nt, Artificial Sequence
  derived and/or modified sequence opt5 from hemagglutinin__InfluenzaA__ADL32384
augaaggccauccuggugguccuccuguacaccuucgcuacagccacggcggacacccuuugcauuggcuaucacgcuaacaauagcacagauaccguugacacagugcuggagaagaacgugaccgucacacauuccgugaaucuccuggaagauaagcacaacgggaaacuuuguaagcugagaggaguugcuccccuccaucugggcaaaugcaauaucgccggguggauucugggaaacccugagugugaaucucucagcaccgccuccucuuggagcuacaucguggagacguccucuagcgacaaugggaccugcuauccgggcgauuuuauugacuacgaagaacugcgggagcagcuuuccagcgucucuuccuucgaacgcuuugagaucuuccccaagacaagcucuuggccuaaccacgauuccaauaagggagugaccgccgcuuguccccaugccggcgcgaaaucuuuuuauaagaaccugaucuggcucguuaaaaagggcaauagcuacccuaaacuguccaagagcuauauuaacgacaaggggaaagaagugcuuguccuguggggaauccaccaccccuccacaucugccgaucaacagagccucuaccagaaugcugacgccuacguguucgugggcaccuccagauauagcaagaaauuuaagccugagauugcuauccggccgaaaguccgcgaucaggaggggagaaugaacuacuauuggacgcugguugaacccggagacaagauuacauucgaggccaccggcaaucugguggugccucgguacgcguuugccauggaacgcaacgcugggucuggaaucauuaucuccgauacacccguccaugacugcaacaccaccugucaaacaccuaaaggcgccaucaauacgagccuccccuuccagaacauucacccgaucaccauuggcaagugcccuaaguaugugaaaucuacaaagcugagacuugcuaccgggcugcggaauguucccagcauccagucccgcggacucuuuggcgccauugccggguucaucgagggaggcuggacagggaugguggacggaugguacggcuaucaucaccagaacgaacaaggcucuggguacgcugcggaucugaaaagcacccagaaugccaucgacgagauuacgaacaaggucaauuccgugaucgagaaaaugaacacacaguuuaccgcuguuggaaaggaguucaaucaccuugagaagagaauugaaaaccugaauaaaaagguggaugacggcuuccucgauaucuggaccuacaacgccgagcugcugguccuccuggaaaaugagcggacacuugacuaucaugauagcaacgugaaaaaucuguacgagaagguccgcucucagcucaaaaacaacgccaaggaaauugggaauggauguuuugaguucuaucacaagugcgacaacaccuguauggaauccgugaaaaauggcacauacgauuauccuaaguacagcgaggaagcuaaacugaacagagaggagaucgacgggguuaaacuugaaucuacgcggaucuaucaaauucuggccaucuacuccaccguggcgagcucccucguccuggugguuucucugggcgcuauuagcuuuuggaugugcuccaauggaucucuccagugccgcaucuguauuuga

SEQ ID NO: 188496 - RNA, 1701 nt, Artificial Sequence
  derived and/or modified sequence opt5 from hemagglutinin__InfluenzaA__ADL32394
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucuuuuagcacaaccuccucuuggagcuacaucguggagacguccucuagcgacaacgggaccugcuauccgggcgauuucauugacuacgaagaacuccgggagcagcuguccagcgucucuuccuuugaacgcuucgagaucuuucccaagacaagcucuuggccuaaucacgauuccaacaagggagugaccgccgccuguccccaugcuggcgccaagagcuucuauaaaaaucuuaucuggcugguuaaaaagggcaacucuuacccuaaacucuccaagagcuauauuaaugacaaggggaaagaagugcugguccuuuggggaauccaccaccccuccacaucugcggaucaacagagccuguaccagaacgccgacaccuacguguuugugggcacguccagauauagcaagaaauucaagccugagauugcuauccggccgaaaguccgcgaucaggaggggagaaugaauuacuauuggacacucguugaacccggagacaagauuaccuuugaggccacaggcaaccugguggugccucgguacgcuuucgccauggaacgcaacgcggggucuggaaucauuaucuccgauacccccguccaugacugcaauaccacaugucaaacgccuaaaggcgccaucaacaccagccugcccuuucagaauauucacccgaucacaauuggcaagugcccuaaguaugugaaaucuaccaagcucagacuggcuacagggcuucggaacguucccagcauccagucccgcggacuguucggcgccauugcuggguuuaucgagggaggcuggaccgggaugguggacggaugguacggcuaucaucaccagaaugaacaaggcucuggguacgccgccgaucucaaaagcacgcagaacgcuaucgacgagauuacaaauaaggucaacuccgugaucgagaaaaugaauacccaguucaccgcgguuggaaaggaguucaaccaccuggagaagagaauugaaaaucuuaacaaaaagaucgaugacggcuuucuggauauuuggacauacaaugccgagcuccuggugcugcucgaaaacgagcggacccuggacuaucaugauagcaaugucaaaaaccuuuacgagaaggugcgcucucagcugaaaaacaaugcuaaggaaaucgggaacggauguuucgaguuuuaucacaagugcgacaauacauguauggaauccgucaaaaacggcacguacgauuauccuaaguacagcgaggaagccaaacucaauagagaggagaucgacggggugaagcuggaaucuacccggauuuaucaaauccuugccauuuacuccacaguugcuagcucccuggugcucgucgugucucugggcgccaucagcuucuggaugugcuccaacggaucucugcagugccgcauuuguaucuga

SEQ ID NO: 188497 - RNA, 1701 nt, Artificial Sequence; identical to SEQ ID NO: 185693
  derived and/or modified sequence opt5 from hemagglutinin__InfluenzaA__ADL32404

SEQ ID NO: 188498 - RNA, 1701 nt, Artificial Sequence
  derived and/or modified sequence opt5 from hemagglutinin__InfluenzaA__ADL32414
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgcccaggaggggagaaugaauuacuauuggacccugguugaacccggagauaagauuacguucgaggcgacaggcaaccugguggugccucgguacgccuuugcuauggaacgcaacgccgggucuggaaucauuaucuccgacacccccguccaugauugcaauacaaccugucaaaccccuaaaggcgcuaucaacacaagccuccccuuccagaauauucacccgaucacgauuggcaagugcccuaaguaugugaaaucuaccaagcugagacuugccacagggcugcggaacguucccagcauccagucccgcggacucuuuggcgccauugcuggguucaucgagggaggcuggaccgggaugguggacggaugguacggcuaucaucaccagaaugaacaaggcucuggguacgcggccgaccugaaaagcacacagcacgcuaucgaugagauuaccaacaaggucaauuccgugaucgagaaaaugaacacgcaguuuacagccguuggaaaggaguucaaucaucuugagaagagaauugaaaaccugaauaaaaagguggacgauggcuuccucgacaucuggaccuacaacgccgagcugcugguccuccuggaaaaugagcggacccuugauuaucacgacagcaacgugaaaaaucuguacgagaagguccgcucucagcucaaaaacaacgcuaaggaaauugggaauggauguuuugaguucuaucauaagugcgauaacacauguauggaauccgugaaaaauggcaccuacgacuauccuaaguacagcgaggaagccaaacugaacagagaggagaucgaugggguuaaacuugaaucuacacggaucuaucaaauucuggcgaucuacuccacgguggcuagcucccucguccuggugguuucucugggcgccauuagcuuuuggaugugcuccaauggaucucuccagugccgcaucuguauuuga

SEQ ID NO: 188499 - RNA, 1701 nt, Artificial Sequence
  derived and/or modified sequence opt5 from hemagglutinin__InfluenzaA__ADL32424
augaaggccauccuggugguccuccuguacaccuucgcuauugccaacgcggacacacuuugcaucggcuaucacgcuaauaacagcacggauaccguugacacagugcuggagaagaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacauccucuagcgacaacggaaccugcuauccgggggauuuuaucgacuacgaagaacugcgggagcagcuuuccagcgucucuuccuucgaacgcuuugagaucuuccccaagacgagcucuuggccuaaucacgauuccaacaagggagugaccgccgcuuguccccaugccggcgcgaaaucuuuuuauaagaaucugauuuggcucguuaaaaagggcaacagcuacccuaaacuguccaagagcuauaucaaugacaaggggaaagaagugcuuguccuguggggcauucaccaccccuccacaucugccgaucaacagagccucuaccagaacgcugacgccuacguguucgugggcaccuccagauauagcaagaaauuuaagccugagaucgcuauucggccgaaaguccgcgaucaggaggggagaaugaauuaccauuggacacugguugaacccggagacaagaucaccuucgaggccacgggcaaccugguggugccucgguaugcguuugccauggaacgcaacgcugggucuggaauuaucaucuccgauacacccguccacgacugcaauaccacaugucaaaccccuaaaggcgccauuaacaccagccuccccuuccagaauauccauccgauuacaaucggcaagugcccuaaguacgugaaaucuacgaagcugagacuugcuaccgggcugcggaacguucccagcauucagucccgcggacucuuuggcgccaucgccggguucaucgagggaggcuggacagggaugguggacggaugguauggcuaccaccaccagaaugaacaaggcucuggguaugcugcggaucugaaaagcacccagcaugccauugacgagaucacaaacaaggucaauuccgugauugagaaaaugaacacccaguuuacggcuguuggaaaggaguucaaucaccuugagaagagaaucgaaaaccugaauaaaaagguggaugacggcuuccucgauauuuggacauacaacgccgagcugcugguccuccuggaaaaugagcggacccuugacuaccaugauagcaacgugaaaaaucuguaugagaagguccgcucucagcucaaaaacaacgccaaggaaaucgggaauggauguuuugaguucuaccacaagugcgacaacaccuguauggaauccgugaaaaauggcacauaugauuacccuaaguauagcgaggaagcuaaacugaacagagaggagaucaaugggguuaaacuugaaucuacccggauuuaccaaauccuggccauuuauuccacaguggcgagcucccucguccuggugguuucucugggcgcuaucagcuuuuggaugugcuccaacggaucucuccagugccgcauuuguaucuga

SEQ ID NO: 188500 - RNA, 1701 nt, Artificial Sequence
  derived and/or modified sequence opt5 from hemagglutinin__InfluenzaA__ADL32434
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuauccacgauuccaauaagggagugacagccgcuuguccccaugccggcgcgaaaucuuuuuauaagaaccugauuuggcucguuaaaaagggcaauagcuacccuaaacuguccaagagcuauaucaacgacaaggggaaagaagugcuuguccuguggggcauucaccaccccuccaccucugccgaucaacagagccucuaccagaaugcugacgccuacguguucgugggaacauccagauauagcaagaaauuuaagccugagaucgcuauucggccgaaaguccgcgaucaggaggggagaaugaacuacuauuggauccugguugaacccggagacaagauuaccuucgaggccacgggcaaucugguggugccucgguacgcguuugccauggaacgcaacgcugggucuggaaucaucauuuccgauacacccguccaugacugcaacaccacaugucaaaccccuaaaggcgccaucaauaccagccuccccuuccagaacauucacccgaucacaauuggcaagugcccuaaguaugugaaaucuacgaagcugagacuugcuaccgggcugcggaauguucccagcauccagucccgcggacucuuuggcgccaucgccggguucauugagggaggcuggacagggaugguggacggaugguacggcuaucaucaccagaacgaacaaggcucuggguacgcugcggaucugaaaagcacccagcacgccaucgacgagauuacaaauaaggucaacuccgugaucgagaaaaugaauacccaguuuacggcuguuggaaaggaguucaaccaucuugagaagagaauugaaaaucugaacaaaaagguggaugacggcuuccucgauaucuggacauacaaugccgagcugcugguccuccuggaaaacgagcggacccuugacuaucacgauagcaaugugaaaaaccuguacgagaagguccgcucucagcucaaaaauaacgccaaggaaaucgggaacggauguuuugaguucuaucauaagugcgacaauaccuguauggaauccgugaaaaacggcacauacgauuauccuaaguacagcgaggaagcuaaacugaauagagaggagauugacgggguuaaacuugaaucuacccggaucuaucaaauucuggccaucuacuccacaguggcgagcucccucguccuggugguuucucugggcgcuauuagcuuuuggaugugcuccaacggaucucuccagugccgcaucuguauuuga

SEQ ID NO: 188501 - RNA, 1701 nt, Artificial Sequence; identical to SEQ ID NO: 187113
  derived and/or modified sequence opt5 from hemagglutinin__InfluenzaA__ADL32444

SEQ ID NO: 188502 - RNA, 1701 nt, Artificial Sequence
  derived and/or modified sequence opt5 from hemagglutinin__InfluenzaA__ADL32454
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagagccucuaccagaacgcugacgccuacguguucgugggcuccagcagauauucuaaaaaguuuaaaccugagauugcuauccggccgaagguccgcgaucaggaagggagaaugaauuacuauuggacacugguugagcccggagacaaaauuaccuucgaagccacgggcaaccugguggugccucgguacgcguuugccauggagcgcaacgcuggguccggaaucauuaucagcgauacacccguccaugacugcaauaccacaugucaaaccccuaagggcgccaucaacaccucucuccccuuccacaauauucauccgaucacaauuggcaaaugcccuaaguauguuaagagcacgaaacugagacuugcuaccgggcugcggaacgugcccuccauccagucucgcggacucuuuggcgccauugccggguucaucgaaggaggcuggacagggaugguggacggaugguacggcuaucaccaccagaaugagcagggcagcggguacgcugcggaucugaaguccacccaaaacgccaucgacgagauuacaaauaaagucaacagcgugaucgaaaagaugaauacccaguuuacggcuguuggaaaagaguucaaccaucuugaaaagagaauugagaaucugaacaagaaaguggaugacggcuuccucgauaucuggacauacaaugccgaacugcugguccuccuggagaacgagcggacccuugacuaucacgauucuaaugugaagaaccuguacgaaaaaguccgcucccagcucaagaacaaugccaaagagcuggggaacggauguuuugaguucuaucauaagugcgacaauaccuguauggaaagcgugaagaacggcacauacgauuauccuaaauacucugaagaggcuaaacuuaauagagaggaaauugacgggguuaagcuggaguccacccggaucuaucagauccucgccauuuacagcacaguggcguccucucugguccuggugguuagccucggcgcuaucuccuuuuggaugugcucuaacggaagccugcaaugccgcauuuguaucuga

SEQ ID NO: 188503 - RNA, 1701 nt, Artificial Sequence; identical to SEQ ID NO: 187860
  derived and/or modified sequence opt5 from hemagglutinin__InfluenzaA__ADL32464

SEQ ID NO: 188504 - RNA, 1701 nt, Artificial Sequence; identical to SEQ ID NO: 187860
  derived and/or modified sequence opt5 from hemagglutinin__InfluenzaA__ADL32484

SEQ ID NO: 188505 - RNA, 1701 nt, Artificial Sequence
  derived and/or modified sequence opt5 from hemagglutinin__InfluenzaA__ADL32504
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcaugugcuauccgggggauuuuauugacuacgaagaacugcgggagcagcuuuccagcgucucuuccuucgaacgcuuugagaucuuccccaagacgagcucuuggccuaaucacgauuccaacaagggagugaccgccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccacaucugccgaucaacagagccucuaccagaacgcugacgccuacguguucgugggcaccuccagauauagcaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcugggucuggaaucauuaucuccgauacacccguccaugacugcaauaccacaugucaaaccccuaaaggcgccaucaacaccagccuccccuuccagaauauucacccgaucacaauuggcaagugcccuaaguaugugaaaucuacgaagcugagacuugcuaccgggcugcggaacguucccagcauccagucccgcggacucuuuggcgccauugccggguucaucgagggaggcuggacagggaugguggacggaugguacggcuaucaucaccagaaugaacaaggcucuggguacgcugcggaucugaaaagcacccagcacgccaucgacgagauuacaaacaaggucaauuccgugaucgagaaaaugaacacccaguuuacggcuguuggaaaggaguucaaucaucuugagaagagaauugaaaaccugaauaaaaagguggaugacggcuuccucgauaucuggacauacaacgccgagcugcugguccuccuggaaaaugagcggacccuugacuaucacgauagcaacgugaaaaaucuguacgagaagguccgcucucagcucaaaaacaacgccaaggaaauugggaauggauguuuugaguucuaucauaagugcgacaacaccuguauggaauccgugaaaaauggcacauacgauuauccuaaguacagcgaggaagcuaaacugaacagagaggagaucgacgggguuaaacuugaaucuacccggaucuaucaaauucuggccaucuacuccacaguggcgagcucccucguccuggugguuucucugggcgcuauuagcuuuuggaugugcuccaauggaucucuccagugccgcaucuguauuuga

SEQ ID NO: 188506 - RNA, 1701 nt, Artificial Sequence; identical to SEQ ID NO: 187113
  derived and/or modified sequence opt5 from hemagglutinin__InfluenzaA__ADL32514

SEQ ID NO: 188507 - RNA, 1701 nt, Artificial Sequence; identical to SEQ ID NO: 187860
  derived and/or modified sequence opt5 from hemagglutinin__InfluenzaA__ADL32524

SEQ ID NO: 188508 - RNA, 1701 nt, Artificial Sequence
  derived and/or modified sequence opt5 from hemagglutinin__InfluenzaA__ADL32544
augaaggccauccuggugguccuccuguacaccuucgcuacaagcaacgccgacacgcuuugcauuggcuaucacgcgaauaacuccaccgauacaguugacaccgugcuggagaagaaugugacagucacccauucugugaaccuccuggaagauaagcacaaugggaaacuuuguaagcugagaggaguugcuccccuccaucugggcaaaugcaacaucgccggguggauucugggaaauccugagugugaaagccucuccacagccucuagcugguccuacaucguggagaccucuagcuccgacaacggcacgugcuauccgggggauuuuauugacuacgaagaacugcgggagcagcuuagcucugucuccagcuucgaacgcuuugagaucuuccccaagaccucuuccuggccuaaucacgauagcaacaagggagugacagcugccuguccccaugcuggcgccaaaucuuuuuauaagaaucugaucuggcucguuaaaaagggcaacuccuacccuaaacugagaaagagcuauauuaaugacaaggggaaagaagugcuuguccuguggggaauccaccaccccuccaccucugcggaucaacagagccucuaccagaacgccgacgcuuacguguucgugggcacaucccgguauagcaagaaauuuaagccugagauugccauccgcccgaaagucagagaucaggaggggcggaugaauuacuauuggacccugguugaacccggagacaagauuacguucgaggcuacaggcaaccugguggugccucgcuacgccuuugcgauggaaagaaacgccgggucuggaaucauuaucuccgauacccccguccaugacugcaauacaaccugucaaaccccuaaaggcgcuaucaacacaagccuccccuuccagaauauucacccgaucacgauuggcaagugcccuaaguaugugaaaucuaccaagcugcggcuugccacagggcugcgcaacguucccagcauccaguccagaggacucuuuggcgcuauugccggguucaucgagggaggcuggaccgggaugguggacggaugguacggcuaucaucaccagaaugaacaaggcucuggguacgccgcugaucugaaaagcacacagcacgcgaucgacgagauuaccaacaaggucaauuccgugaucgagaaaaugaacacgcaguuuacagccguuggaaaggaguucaaucaucuugagaagcggauugaaaaccugaauaaaaagguggaugacggcuuccucgauaucuggaccuacaacgcugagcugcugguccuccuggaaaaugagcgcacccuugacuaucacgauagcaacgugaaaaaucuguacgagaaggucagaucucagcucaaaaacaacgccaaggaaauugggaauggauguuuugaguucuaucauaagugcgacaacacauguauggaauccgugaaaaauggcaccuacgauuauccuaaguacagcgaggaagccaaacugaaccgggaggagaucgacgggguuaaacuugaaucuacacgcaucuaucaaauucuggcuaucuacuccacgguggccagcucccucguccuggugguuucucugggcgcgauuagcuuuuggaugugcuccaauggaucucuccagugcagaaucuguauuuga

SEQ ID NO: 188509 - RNA, 1701 nt, Artificial Sequence; identical to SEQ ID NO: 188294
  derived and/or modified sequence opt5 from hemagglutinin__InfluenzaA__ADL32554

SEQ ID NO: 188510 - RNA, 1701 nt, Artificial Sequence; identical to SEQ ID NO: 187306
  derived and/or modified sequence opt5 from hemagglutinin__InfluenzaA__ADL32670

SEQ ID NO: 188511 - RNA, 1701 nt, Artificial Sequence
  derived and/or modified sequence opt5 from hemagglutinin__InfluenzaA__ADL32690
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauguggcugguuaaaaagggcaacagcuacccuaaacucuccaagagcuauauuaaugacaaggggaaagaagugcugguccuuuggggaauccaccaccccuccaccucugccgaucaacagagccuguaccagaacgcugacgccuacguguucgugggcuccagcagauauucuaagaaauuuaagccugagauugcuauccggccgaaaguccgcgaucaggaggggagaaugaauuacuauuggacacucguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucugcccuuccagaauauucacccgaucacaauuggcaagugcccuaaguaugugaaaagcacgaagcucagacuggcuaccgggcuucggaacguucccuccauccagucucgcggacuguuuggcgccauugccggguucaucgagggaggcuggacagggaugguggacggaugguacggcuaucaucaccagaaugaacaaggcagcggguacgcugcggaucucaaauccacccagaacgccaucgacgagauuacaaauaaggucaacagcgugaucgagaaaaugaauacccaguuuacggcuguuggaaaggaguucaaccaccuggagaagagaauugaaaaucuuaacaaaaagguggaugacggcuuccuggauaucuggacauacaaugccgagcuccugguccugcucgaaaacgagcggacccuggacuaucaugauucuaaugugaaaaaccuuuacgagaagguccgcucccagcugaaaaacaaugccaaggaaauugggaacggauguuuugaguucuaucacaagugcgacaauaccuguauggaaagcgugaaaaacggcacauacgauuauccuaaguacucugaggaagcuaaacucaauagagaggagaucgacgggguuaagcuggaauccacccggaucuaucaaauucuugccaucuacagcacaguggcguccucucugguccucgugguuagccugggcgcuauuuccuuuuggaugugcucuaacggaagccugcagugccgcaucuguauuuga

SEQ ID NO: 188512 - RNA, 1701 nt, Artificial Sequence; identical to SEQ ID NO: 185873
  derived and/or modified sequence opt5 from hemagglutinin__InfluenzaA__ADL32710

SEQ ID NO: 188513 - RNA, 1701 nt, Artificial Sequence; identical to SEQ ID NO: 185693
  derived and/or modified sequence opt5 from hemagglutinin__InfluenzaA__ADL32720

SEQ ID NO: 188514 - RNA, 1701 nt, Artificial Sequence; identical to SEQ ID NO: 187465
  derived and/or modified sequence opt5 from hemagglutinin__InfluenzaA__ADL32730

SEQ ID NO: 188515 - RNA, 1701 nt, Artificial Sequence; identical to SEQ ID NO: 187465
  derived and/or modified sequence opt5 from hemagglutinin__InfluenzaA__ADL32740

SEQ ID NO: 188516 - RNA, 1701 nt, Artificial Sequence; identical to SEQ ID NO: 186637
  derived and/or modified sequence opt5 from hemagglutinin__InfluenzaA__ADL39137

SEQ ID NO: 188517 - RNA, 1698 nt, Artificial Sequence
  derived and/or modified sequence opt5 from hemagglutinin__InfluenzaA__ADL39148
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucguggaccagaaaacccuguacagaacagagaaugccuacgucagcguuguguccucucauuauagccggaaguucacccccgaaauugcuaagcgcccuaaagugagagaucaggagggccggaucaacuacuauuggacgcuucuggagcccggggacacaauuaucuuugaagccaauggaaaccucauugcgccucgcuacgccuucgcucuguccagagauuuuggcagcgggaucauuaauucuaacgcccccauggacaagugugaugcuaaaugccagaccccgcaaggagccaucaauuccagccuuccuuuccagaacguccaccccgugacaaucggcgaguguccuaaguauguucggucugcgaaacugcgcauggugaccggccucagaaauauucccagcauccagucccgggggcuguuuggagccauugcuggcuucaucgaagggggauggaccggcauggucgacgggugguacggauaucaucaccagaacgagcaaggcucuggcuacgccgcugaucaaaagagcacacagaaugccauuaacgggaucacgaauaaagugaacuccguuaucgaaaagaugaauacccaguuuacagccgugggaaaggaguucaacaaacuggagcgcagaauggaaaaccucaauaagaaagucgacgauggcuucauugacaucuggaccuacaacgcugagcugcuugugcugcucgaaaaugagcggacacuggacuuucacgauagcaacgucaagaaucuuuaugaaaaagugaagucucagcugaagaacaaugcgaaagagauugggaacggaugcuucgaguuuuaccauaaguguaaugacgaaugcauggaguccguuaaaaacggcaccuaugauuaccccaaguauagcgaagagucuaaacucaaucgcgagaagaucgacggggugaagcuggaauccaugggcgucuaccagauucuggccaucuauagcacgguggcuuccucucucguucugcuugugagccugggagccaucuccuucuggaugugcucuaacggcagccuccaguguagaauuugcaucuga

SEQ ID NO: 188518 - RNA, 1701 nt, Artificial Sequence
  derived and/or modified sequence opt5 from hemagglutinin__InfluenzaA__ADL39159
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagaucauugauggggaaaauuguacccuuaucgacgcccugcucggagauccccagugcgacggcuuucaaaacaaaaagugggaucuguucgucgagagaagcaaagccuauuccaauuguuacccuuaugacgugcccgauuacgcuucucugcggagccucguugccuccagcgggacgcuggaauuuaacaaugagucuuucaacuggaccggagugacacagaauggcaccuccagcgcuugcauucgcagaucuaacaauuccuuuuucagccggcuuaacuggcugacacaucucaaguuuaaguauccugcccugaaugucaccaugcccaacaacgagcaguucgacaaacuuuacaucuggggcgugcaccauccugggacggauaaugaccagauuuuucuguaugcgcaagccucuggacgcaucacaguuuccaccaagagaagccagcagacagugauuccgaacaucggcucccggccccgcgucagaaauaucccuucucggauuagcaucuacuggaccauugugaaacccggggauauccuccugauuaacuccaccggaaaucugaucgcuccucgcggcuacuucaagaucagaagcgggaaaucuuccauuaugcggagcgacgcccccaucggaaaguguaacucugaaugcauuacaccgaauggcagcaucccuaacgacaagcccuuucagaaugugaaccgcauuacguauggcgcuuguccuagauacgucaaacaaaauacccucaagcuggccacagggaugcggaacguucccgagaaacagacccgcggaaucuucggcgcgaucgccggguuuauugaaaauggaugggagggcaugguggaugggugguauggauucagacaccagaacuccgagggccggggccaagcugccgaccuuaagucuacacaggcugccaucgaucagauuaaugggaaacugaacagacucaucggaaagaccaacgaaaaauuccaccagauugagaaggaauuuagcgagguggaaggccgcauccaagaccuggagaaguacgucgaggauacgaaaauugaccuuugguccuauaaugccgaacugcucguggcucuggagaaccagcauacaaucgaucugaccgacagcgaaaugaauaaacucuucgagaagaccaagaaacagcugcgggaaaacgcggaggauauggggaauggaugcuuuaagaucuaccacaagugugacaacgccugcauuagaucuauccgcaauggcacauaugaucaugacguuuaccgggacgaggcucuuaacaauagauuccagauuaaagggguggaacugaaguccggcuacaaagauuggauccucuggauuagcuuugccaucucuugcuuccugcuuuguuuugcccugcucggauucaucaugugggcuugccaaaagggcaacauucgcuguaauaucugcauuuga

SEQ ID NO: 188519 - RNA, 1701 nt, Artificial Sequence
  derived and/or modified sequence opt5 from hemagglutinin__InfluenzaA__ADL39170
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauccgcagaucuaagaacuccuuuuucagccggcugaauuggcucacacaucugaacuuuaaauauccugcccuuaaugucaccgugcccaacaacgagcaguucgacaagcuguacauuuggggcguucaccauccugggacggauaaagaccagaucuuucucuaugcgcaagccucuggacgcauuacaguguccaccaagagaagccagcagacagucaucccgaauauuggcucccggccccgcgugagaaacaucccuucucggaucagcauuuacuggaccaucgugaaacccggggauguccugcugauuaauuccaccggaaaccucaucgcuccucgcggcuacuucaagauuagaagcgggaagucuuccaucaugcggagcgacgcccccaucggaaaauguaauucugagugcauuacaccgaacggcagcaucccuaaugacaagcccuuucagaacguuaaucgcauuacguauggcgcuuguccuagauacgugaaacaaaacacccugaaacuugccacagggaugcggaaugugcccgaaaaacagacccgcggaaucuucggcgcgauugccggguuuaucgagaacggaugggaaggcauggucgaugggugguauggauucagacaccaaaauuccgagggccggggccaggcugccgaccugaagucuacacaggcugccaucgaucagauuaacgggaaacucaauagacugaucggaaagaccaacgagaaguuccaccagauugaaaaagaguuuagcgaaguggagggccgcauccaagaccuugaaaaguacguugaggauacgaaaauugaccugugguccuauaacgccgagcuccugguggcucuggaaaaucagcauacaaucgaucucaccgacagcgagaugaacaagcuguucgaaaagaccaagaagcagcuucgggagaaugcggaagauauggggaacggaugcuuuaaaauuuaccacaagugugacaaugccugcaucggcucuaucagaaacgggacauaugaucaugacgucuaccgcgacgaggcucugaauaaccgguuccagauuaaaggcguggagcucaaguccggauacaaagauuggauccuguggauuagcuuugccaucucuugcuuccuucuguguguugcccuccugggcuuuauuaugugggcuugccaaaaggggaauaucagauguaacaucugcauuuga

SEQ ID NO: 188520 - RNA, 1701 nt, Artificial Sequence; identical to SEQ ID NO: 186637
  derived and/or modified sequence opt5 from hemagglutinin__InfluenzaA__ADL39203

SEQ ID NO: 188521 - RNA, 1701 nt, Artificial Sequence; identical to SEQ ID NO: 185458
  derived and/or modified sequence opt5 from hemagglutinin__InfluenzaA__ADL39214

SEQ ID NO: 188522 - RNA, 1698 nt, Artificial Sequence
  derived and/or modified sequence opt5 from hemagglutinin__InfluenzaA__ADL39225
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccuggguacuuugccgauuaugaggaacugagagagcaacucuccucugucagcuccuucgaacgguuugagaucuuccccaaggagagcucuuggccuaaccauacggugaccggagccuccgcuagcugcucucacaauggcgaaaacuccuuuuaccgcaaucugcuuuggcugacaggcaaaaacgggcucuaucccaaucugagcaagucuuacgccaacaacaaagagaaggaaguucuggugcucuggggaguccaucacccuccgaauaucgcugaccagaaaacccuguaccacacagagaacgccuauguguccguggucagcucccauuacucuagaaaguucacccccgaaauugcgaagcggccuaaaguucgcgaucaggagggcagaaucaauuauuacuggacgcuucuggagcccggggacacaauuaucuuugaagccaacggaaaucucauugcuccucgguaugccuucgcucugagccgcggcuuuggguccggaaucauuaacagcaaugcccccauggauaagugugacgcgaaaugccagaccccgcaaggcgccaucaacucuucccuuccuuuccagaaugugcaccccgugacaaucggcgaguguccuaaguacgucagaagcgcuaaacugcggauggugaccgggcuccgcaacauucccucuauccagagcagaggacuguuuggcgccauugcuggguucaucgaaggaggcuggaccgggaugguugauggaugguauggcuaccaucaccagaaugagcaaggcuccggguacgccgccgaccagaagucuacacagaacgcuauuaauggaaucacgaacaaagugaauagcgucaucgaaaagaugaacacccaguuuacagcggugggcaaggaguucaacaaacuggagcggcgcauggaaaaucucaacaagaaaguugaugacggguucauugauaucuggaccuauaaugccgagcugcuugugcugcucgaaaacgagagaacacuggacuuucacgacuccaaugucaagaaccuuuacgaaaaagucaagagccaacugaagaauaacgcuaaagagauuggaaauggcugcuucgaguuuuaucauaaguguaacgaugaaugcauggagucugugaaaaaugggaccuacgacuaucccaaguacuccgaagagagcaaacucaaccgggagaagaucgauggcgugaagcuggaaucuaugggaguuuaucagauucuggccaucuacuccacgguggccagcucccucguccugcuugugucucugggcgcuaucagcuucuggaugugcuccaaugggucucuccagugucgcauuugcaucuga

SEQ ID NO: 188523 - RNA, 1698 nt, Artificial Sequence
  derived and/or modified sequence opt5 from hemagglutinin__InfluenzaA__ADL39236
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccuggguacuuugccgauuaugaggaacugagagagcaacucuccucugucagcuccuucgaacgguuugagaucuuccccaaggagagcucuuggccuaaccauacggugaccggaguuuccgccagcugcucucacaauggcgaauccagcuuuuaccgcaaccugcuuuggcugacaggcaaaaaugggcucuaucccaaccugucuaaguccuacaccaauaacaaagagaaggaagugcugguccucuggggagugcaucacccuccgaacaucguggaccagaaaacacuguacagaaccgagaaugcuuaugucagcguuguguccucucacuacagccggaaguucacgcccgaaauugccaagcgcccuaaagugagagaucaggagggccggaucaacuauuacuggacacuucuggagcccggggacaccauuaucuuugaagcuaauggaaaccucauugccccucgcuaugcguucgcccuguccagaggcuuugggagcggaaucauuaauucuaacgcucccaugggcaagugugaugccaaaugccagacaccgcaaggcgcuaucaauuccagccuuccuuuccagaacguccaucccgugaccaucggggaguguccuaaguacguucggucugccaaacugcgcauggugaccggacucagaaauauucccagcauccagucccggggccuguuuggggcgauugccggauucaucgaaggcggguggacaggaauggucgacggcugguauggcuaccaccaucagaacgagcaagggucuggauacgcugccgaucaaaagagcacgcagaaugcuauuaacggcaucaccaauaaagugaacuccguuaucgaaaagaugaauacacaguuuaccgccguggggaaggaguucaacaaacuggagcgcagaauggaaaaccucaauaagaaagucgacgauggauucauugacaucuggacauauaacgccgagcugcuugugcugcucgaaaaugagcggacccuggauuuucacgacagcaacgucaagaaucuuuacgaaaaagugaagucucagcugaagaacaaugcuaaagagauuggcaacgggugcuucgaguuuuaucacaaguguaaugacgaaugcauggaguccguuaaaaacggcacguacgauuaucccaaguacagcgaagagucuaaacucaaucgcgagaagaucgacggagugaagcuggaauccaugggcgucuaucagauucuggcgaucuacagcacaguggccuccucucucguucugcuugugagccugggggcuaucuccuucuggaugugcucuaacggaagccuccaguguagaauuugcaucuga

SEQ ID NO: 188524 - RNA, 1701 nt, Artificial Sequence
  derived and/or modified sequence opt5 from hemagglutinin__InfluenzaA__ADL39280
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugcgcuuuaaguauccugcccuuaaugucaccaugcccaacaacgagcaguucgacaagcuguacauuuggggcgugcaccauccugggacggauaaugaccagaucuuucucuaugcgcaagccucuggaagaauuacaguuuccaccaaacggagccagcagacagugaucccgaacauuggcucccgccccagaguccggaauaucccuucucgcaucagcauuuacuggaccaucgugaagcccggggauauucugcugaucaacuccaccggaaaucucauugcuccuagaggcuacuucaaaauccggagcgggaagucuuccaucaugcgcagcgacgcccccauuggaaaauguaacucugaaugcaucacaccgaauggcagcauuccuaacgacaagcccuuucagaaugugaacagaaucacguauggcgcuuguccucgguacgucaagcaaaauacccugaaacuugccacagggaugcgcaacguucccgagaagcagaccagaggaauuuucggcgcgaucgccggguuuaucgaaaauggaugggagggcaugguggaugggugguauggauuccggcaccagaacuccgagggcagaggccaagcugccgaccugaaaucuacacaggcugccauugaucagaucaaugggaagcucaaccgccugauuggaaaaaccaacgaaaaguuccaccagaucgagaaagaauuuagcgagguggaaggccggauucaagaccuugagaaguacgucgaggauacgaagaucgaccugugguccuauaaugccgaacuccugguggcucuggagaaccagcauacaauugaucucaccgacagcgaaaugaauaaacuguucgagaagaccaaaaagcagcuuagagaaaacgcggaggauauggggaauggaugcuuuaaaaucuaccacaagugugacaacgccugcaucggcucuauucgcaaugggacauaugaucaugacguuuaccgggacgaggcucugaacaauagauuccagaucaagggcguggaacucaaauccggauacaaggauuggauucuguggaucagcuuugccauuucuugcuuccuucugugugucgcccuccugggcuuuaucaugugggcuugccaaaaagggaacauccgcuguaauauuugcaucuga

SEQ ID NO: 188525 - RNA, 1698 nt, Artificial Sequence
  derived and/or modified sequence opt5 from hemagglutinin__InfluenzaA__ADL39291
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacagagaaaaauggccucuaccccaaccugucuaaguccuaugcuaauaacaaagaaaaggaggugcugguccucuggggagugcaccacccuccgaacaugggggaccagaaaacccuguaccauacagaaaaugccuacgugagcgucguuuccucucacuauagcagaaaguucacccccgagaucgcuaagcggccuaaagugcgcgaucaggagggcagaauuaacuacuauuggacgcuucuggaacccggggacacaaucauuuuugaggccaauggaaaccucaucgcgccucgguacgccuucgcucugucccgcggcuuugggagcggaauuaucaauucuaacgcccccauggauaagugugacgcuaaaugccagaccccgcaaggcgccauuaauuccagccuuccuuuccagaacgugcaucccgucacaaucggcgaauguccuaaguaugugagaucugcgaaacugcggaugguuaccgggcuccgcaauauccccagcauucaguccagaggacuguuuggcgccaucgcuggguucauugagggaggcuggaccgggaugguggauggaugguacggcuaucaccaccagaacgaacaaggcucuggguacgccgcugaccaaaagagcacacagaaugccaucaacggaauuacgaauaaagucaacuccgugaucgagaagaugaauacccaguuuacagccguuggcaaggaguucaacaaacuggaacggcgcauggagaaccucaauaagaaaguggaugacggguucaucgauauuuggaccuacaacgcugaacugcuuguccugcucgagaaugaaagaacacuggacuuucaugacagcaacgugaagaaucuuuaugagaaagucaagucucagcugaagaacaaugcgaaagagaucggaaacggcugcuucgaauuuuaccacaaguguaaugaugagugcauggaauccgugaaaaacgggaccuaugacuaccccaaguauagcgaggagucuaaacucaaucgggaaaagauugauggcguuaagcuggaguccaugggaguguaccagauccuggccauuuauagcacggucgcuuccucucucgugcugcuuguuagccugggcgccaucuccuucuggaugugcucuaacgggagccuccagugucgcaucugcauuuga

SEQ ID NO: 188526 - RNA, 1701 nt, Artificial Sequence; identical to SEQ ID NO: 185458
  derived and/or modified sequence opt5 from hemagglutinin__InfluenzaA__ADL39302

SEQ ID NO: 188527 - RNA, 1701 nt, Artificial Sequence; identical to SEQ ID NO: 188524
  derived and/or modified sequence opt5 from hemagglutinin__InfluenzaA__ADL39313

SEQ ID NO: 188528 - RNA, 1701 nt, Artificial Sequence
  derived and/or modified sequence opt5 from hemagglutinin__InfluenzaA__ADL39335
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugcgcuuuaaguauccugcccuuaaugucaccaugcccaacaacgagcaguucgacaagcuguacauuuggggcgugcaccauccugggacggauaaugaccagaucuuucucuaugcgcaagccucuggaagaauuacaguuuccaccaaacggagccagcagacagugaucccgaacauuggcucccgccccagaguccggaauaucccuucucgcaucagcauuuacuggaccaucgugaagcccggggauauucugcugaucaacuccaccggaaaucucauugcuccuagaggcuacuucaaaauccggagcgggaagucuuccaucaugcgcagcgacgcccccauuggaaaauguaacucugaaugcaucacaccgaauggcagcauuccuaacgacaagcccuuucagaaugugaacagaaucacguauggcgcuuguccucgguacgucaagcaaaauacccugaaacuugccacagggaugcgcaacguucccgagaagcagaccagaggaauuuucggcgcgaucgccggguuuaucgaaaauggaugggagggcaugguggaugggugguauggauuccggcaccagaacuccgagggcagaggccaagcugccgaccugaaaucuacacaggcugccauugaucagaucaaugggaagcucaaccgccugauuggaaaaaccaacgaaaaguuccaccagaucgagaaagaauuuagcgagguggaaggccggauucaagaccuugagaaguacgucgaggauacgaagaucgaccugugguccuauaaugccgaacuccugguggcucuggagaaccagcauacaauucaccucaccgauagcgaaaugaauaaacuguucgagaagaccaaaaagcagcuuagagaaaacgcggaggacauggggaauggaugcuuuaaaaucuaccauaagugugauaacgccugcaucggcucuauucgcaaugggacauaugaccacgauguuuaccgggacgaggcucugaacaauagauuccagaucaagggcguggaacucaaauccggauacaaggacuggauucuguggaucagcuuugccauuucuugcuuccuucugugugucgcccuccugggcuuuaucaugugggcuugccaaaaagggaacauccgcuguaauauuugcaucuga

SEQ ID NO: 188529 - RNA, 1701 nt, Artificial Sequence; identical to SEQ ID NO: 185458
  derived and/or modified sequence opt5 from hemagglutinin__InfluenzaA__ADL39368

SEQ ID NO: 188530 - RNA, 1698 nt, Artificial Sequence
  derived and/or modified sequence opt5 from hemagglutinin__InfluenzaA__ADL39390
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccucucuguccaagagcuaugcuaacaauaaagagaaggaagugcugguccucuggggagugcaccacccuccgaacaucguggaccagaaaacccuguacagaacagagaacgccuacgucuccguugugucuagccauuauucccggaaguucacccccgaaauugcuaagcgcccuaaagugagagaucaggagggccggaucaauuacuauuggacgcuucuggagcccggggacacaauuaucuuugaagccaacggaaaucucauugcgccucgcuacgccuucgcucugagcagaggcuuugggucuggaaucauuaacuccaaugcccccaugggcaagugugaugcuaaaugccagaccccgcaaggcgccaucaacagcucucuuccuuuccagaauguccaccccgugacaaucggggaguguccuaaguauguucggagcgcgaaacugcgcauggugaccggacucagaaacauucccuccauccagucucggggccuguuuggggccauugcuggauucaucgaaggcggguggaccggaauggucgacggcugguacggcuaucaucaccagaaugagcaagggagcggauacgccgcugaucagaaguccacacagaacgccauuaauggcaucacgaacaaagugaauagcguuaucgaaaagaugaacacccaguuuacagccguggggaaggaguucaauaaacuggagcgcagaauggaaaaccucaacaagaaagucgacgauggauucauugacaucuggaccuacaaugcugagcugcuugugcugcucgaaaacgagcggacacuggauuuucacgacucuaaugucaagaaccuuuaugaaaaagugaagucccaacugaagaauaacgcgaaagagauuggcaaugggugcuucgaguuuuaccauaaguguaacgacgaaugcauggagagcguuaaaaauggcaccuaugauuaccccaaguauucugaagaguccaaacucaaccgcgagaagaucgacggagugaagcuggaaagcaugggcgucuaccagauucuggccaucuauuccacgguggcuucuagccucguucugcuugugucccugggggccaucucuuucuggaugugcagcaauggaucccuccaguguagaauuugcaucuga

SEQ ID NO: 188531 - RNA, 1701 nt, Artificial Sequence
  derived and/or modified sequence opt5 from hemagglutinin__InfluenzaA__ADL39401
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcucuugcaugcgcagauccaacaauagcuuuuucucucggcugaacuggcucacacaucugaaguuuaaguauccugcucuuaaugucaccaugcccaacaacgagcaguucgacaaacuguacaucuggggcgugcaccauccugggacggauaaugaccagauuuuucucuaugcccaagcguccggacgcaucacaguuagcaccaagagaucccagcagacagugauuccgaacaucggcucucggccccgcgucagaaauauuccuagccggaucuccaucuacuggaccauugugaaacccggggauauccugcugauuaacagcaccggaaaucucaucgccccucgcggcuacuucaagauuagaucugggaaauccagcaucaugcggucugacgcucccaucggaaaguguaacagcgaaugcauuacaccgaauggcuccaucccuaacgacaagcccuuucagaaugugaaccgcauuacguauggcgccuguccuagauacgucaaacaaaauacccugaagcuggcuacagggaugcggaacguucccgagaaacagacccgcggaaucuucggcgccauugcgggguuuaucgaaaauggaugggagggcaugguggaugggugguauggauucagacaccagaacucugagggccggggccaagccgcugaccuuaagagcacacaggccgcuaucgaucagauuaaugggaaacucaacagacugaucggaaagaccaacgaaaaauuccaccagauugagaaggaauuuuccgagguggaaggccgcauccaagaccuugagaaguacgucgaggauacgaaaauugaccuguggagcuauaaugccgaacuccugguggcccuggagaaccagcauacaaucgaucucaccgacucugaaaugaauaagcuguucgagaaaaccaagaaacagcuucgggaaaacgcugaggauauggggaauggaugcuuuaagauuuaccacaagugugacaacgcgugcaucggcuccaucagaaaugggacauaugaucaugacguuuaccgcgacgaggcccugaacaaucgguuccagauuaaaggcguggaacucaagagcggauacaaagauuggauccuguggauuucuuuugcuaucuccugcuuccuucugugugucgcccuccugggcuuuauuaugugggccugccaaaaggggaacaucagauguaauaucugcauuuga

SEQ ID NO: 188532 - RNA, 1701 nt, Artificial Sequence
  derived and/or modified sequence opt5 from hemagglutinin__InfluenzaA__ADL39412
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccucuggacgcauuacaguuuccaccaagagaagccagcagacagugaucccgaacauuggcucccggccccgcgucagaaauaucccuucucggaucagcauuuacuggaccaucgugaaacccggggauauucugcugaucaacuccaccggaaaucucauugcuccucgcggcuacuucaagaucagaagcgaaaaaucuuccaucaugcggagcgacgcccccauugggaaguguaacucugagugcaucacaccgaauggaagcauuccuaacgacaagcccuuucagaaugugaaccgcaucacguauggcgcuuguccuagauacgucaaacaaaauacccugaaacuugccacaggcaugcggaacguucccgaaaaacagacccgcgggauuuucggagcgaucgccggcuuuaucgagaaugggugggagggaaugguggauggcugguauggguucagacaccagaacuccgaaggacggggccaagcugccgaccugaagucuacacaggcugccauugaucagaucaauggcaaacucaacagacugauugggaagaccaacgagaaauuccaccagaucgaaaaggaguuuagcgaaguggagggacgcauucaagaccuugagaaguacgucgaagauacgaaaaucgaccugugguccuauaaugccgagcuccugguggcucuggaaaaccagcauacaauugaucucaccgacagcgagaugaauaagcuguucgaaaagaccaagaaacagcuucgggagaacgcggaggauaugggcaaugggugcuuuaagaucuaccacaagugugacaacgccugcaucggaucuauuagaaauggcacauaugaucaugacguuuaccgcgacgaagcucugaacaaucgguuccagaucaaagggguggagcucaaguccggcuacaaagauuggauucuguggaucagcuuugccauuucuugcuuccuucugugugucgcccuccugggauuuaucaugugggcuugccaaaagggcaacaucagauguaauauuugcaucuga

SEQ ID NO: 188533 - RNA, 1698 nt, Artificial Sequence
  derived and/or modified sequence opt5 from hemagglutinin__InfluenzaA__ADL39423
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuucccacacggugaccggaguuagcgccucuugcucccauaacggcgaaaauagcuuuuaucgcaaccugcuuuggcugacaggcaaaaaugggcucuaccccaaccugucuaaguccuaugcuaauaacaaagagaaggaagugcugguccucuggggagugcaccacccuccgaacaucgccgaccagaaaacccuguaccauacagagaaugcuuacgugagcgucguuuccucucacuauagcagaaaguucacccccgaaauugccaagcggccuaaagugcgcgaucaggagggcagaaucaacuacuauuggacgcuucuggagcccggggacacaauuaucuuugaagcgaauggaaaccucauugccccucgguacgcuuucgcccugucccgcggcuuugggagcggaaucauuaauucuaacgcucccauggauaagugugacgccaaaugccagaccccgcaaggcgcgaucaauuccagccuuccuuuccagaacgugcaucccgucacaaucggcgaguguccuaaguaugugagaucugccaaacugcggaugguuaccgggcuccgcaauauucccagcauccaguccagaggacuguuuggcgcuauugccggguucaucgaaggaggcuggaccgggaugguggauggaugguacggcuaucaccaccagaacgagcaaggcucuggguacgcugccgaccaaaagagcacacagaaugccauuaacggaaucacgaauaaagucaacuccgugaucgaaaagaugaauacccaguuuacagcuguuggcaaggaguucaacaaacuggagcggcgcauggaaaaccucaauaagaaaguggaugacggguucauugauaucuggaccuacaacgcggagcugcuuguccugcucgaaaaugagagaacacuggacuuucaugacagcaacgugaagaaucuuuaugaaaaagucaagaaccagcugaagaauaacgccaaagagauuggaaauggcugcuucgaguuuuaccacaaguguaacgaugaaugcauggagucugugaaaaaugggaccuaugacuaccccaaguauuccgaagagagcaaacucaaccgggagaagaucgauggcguuaagcuggaaucuaugggaguguaccagauucuggcuaucuauuccacggucgccagcucccucgugcugcuuguuucucugggcgccaucagcuucuggaugugcuccaaugggucucuccagugucgcauuugcaucuga

SEQ ID NO: 188534 - RNA, 1701 nt, Artificial Sequence
  derived and/or modified sequence opt5 from hemagglutinin__InfluenzaA__ADL39434
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugcgcuuuaaguauccugcccuuaaugucaccaugcccaacaacgagcaguucgacaagcuguacauuuggggcgugcaccauccugggacggauaaugaccagaucuuucucuaugcgcaagccucuggaagaauuacaguuuccaccaaacggagccagcagacagugaucccgaacauuggcucccgccccagaguccgggauaucccuucucgcaucagcauuuacuggaccaucgugaagcccggggacauucugcugaucaauuccaccggaaaccucauugcuccuagaggcuacuucaaaauccggagcgggaagucuuccaucaugcgcagcgacgcccccauuggaaaauguaauucugaaugcaucacaccgaacggcagcauuccuaaugauaagcccuuucagaacgugaauagaaucacguauggcgcuuguccucgguacgucaagcaaaacacccugaaacuugccacagggaugcgcaauguucccgagaagcagaccagaggaauuuucggcgcgaucgccggguuuaucgaaaacggaugggagggcaugguggacgggugguauggauuccggcaccaaaauuccgagggcagaggccaggcugccgaucugaaaucuacacaggcugccauugaccagaucaacgggaagcucaaucgccugauuggaaaaaccaacgaaaaguuccaccagaucgagaaagaauuuagcgagguggaaggccggauucaagaucuugagaaguacgucgaggacacgaagaucgaucugugguccuauaacgccgaacuccugguggcucuggagaaucagcauacaauugaccucaccgauagcgaaaugaacaaacuguucgagaagaccaaaaagcagcuuagagaaaaugcggaggacauggggaacggaugcuuuaaaaucuaccacaagugugauaaugccugcaucggcucuauucgcaacgggacauaugaccaugacguuuaccgggaugaggcucugaauaacagauuccagaucaagggcguggaacucaaauccggauacaaggacuggauucuguggaucagcuuugccauuucuugcuuccuucugugugucgcccuccugggcuuuaucaugugggcuugccaaaaagggaauauccgcuguaacauuugcaucuga

SEQ ID NO: 188535 - RNA, 1698 nt, Artificial Sequence
  derived and/or modified sequence opt5 from hemagglutinin__InfluenzaA__ADL39445
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccacccugucuaaguccuaugcuaacaauaaagagaaggaagugcugguccucuggggagugcaccacccuccgaacaucguggaccagaaaacacuguacagaaccgagaacgccuacgucagcguuguguccucucauuauagccggaaguucacgcccgaaauugcuaagcgcccuaaagugagagaucaggagggccggaucaauuacuauuggacacuucuggagcccggggacaccauuaucuuugaagccaacggaaaucucauugcgccucgcuacgccuucgcucuguccagaggcuuugggagcggaaucauuaacucuaaugcccccauggauaagugugacgcuaaaugccagacaccgcaaggcgccaucaacuccagccuuccuuuccagaauguccaccccgugaccaucggcgaguguccuaaguauguucggucugcgaaacugcgcauggugaccgggcucagaaacauucccagcauccagucccggggacuguuuggcgccauugcuggguucaucgaaggaggcuggacagggauggucgauggaugguacggcuaucaucaccagaaugagcaaggcucuggguacgccgcugaccagaaguccacgcagaacgccauuaauggaaucaccaacaaagugaauagcguuaucgaaaagaugaacacacaguuuaccgccgugggcaaggaguucaauaaacuggagcgcagaauggaaaaccucaacaagaaagucgaugacggguucauugauaucuggacauacaaugcugagcugcuugugcugcucgaaaacgagcggacccuggacuuucacgacagcaaugucaagaaccuuuaugaaaaagugaagucucaacugaagaauaacgcgaaagagauuggaaauggcugcuucgaguuuuaccauaaguguaacgaugaaugcauggaguccguuaaaaaugggacguaugacuaccccaaguauagcgaagagucuaaacucaaccgcgagaagaucgauggcgugaagcuggaauccaugggagucuaccagauucuggccaucuauagcacaguggcuuccucucucguucugcuugugagccugggcgccaucuccuucuggaugugcucuaaugggagccuccaguguagaauuugcaucuga

SEQ ID NO: 188536 - RNA, 1698 nt, Artificial Sequence
  derived and/or modified sequence opt5 from hemagglutinin__InfluenzaA__ADL39456
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuucccacacggugaccggaguuagcgccucuugcucccauaacggcgaaaauagcuuuuaucgcaaccugcuuuggcugacaggcaaaaaugggcucuaccccaaccugucuaaguccuaugcuaauaacaaagagaaggaagugcugguccucuggggagugcaccacccuccgaacaucgccgaccagaaaacccuguaccauacagagaaugcuuacgugagcgucguuuccucucacuauagcagaaaguucacccccgaaauugccaagcggccuaaagugcgcgaucaggagggcagaaucaacuacuauuggacgcuucuggagcccggggacacaauuaucuuugaagcgaauggaaaccucauugccccucgguacgcuuucgcccugucccgcggcuuugggagcggaaucauuaauucuaacgcucccauggauaagugugacgccaaaugccagaccccgcaaggcgcgaucaauuccagccuuccuuuccagaacgugcaucccgucacaaucggcgaguguccuaaguaugugagaucugccaaacugcggaugguuaccgggcuccgcaauauucccagcauccaguccagaggacuguuuggcgcuauugccggguucaucgaaggaggcuggaccgggaugguggauggaugguacggcuaucaccaccagaacgagcaaggcucuggguacgcugccgaccaaaagagcacacagaaugccauuaacggaaucacgaauaaagucaacuccgugaucgaaaagaugaauacccaguuuacagcuguuggcaaggaguucaacaaacuggagcggcgcauggaaaaccucaauaagaaaguggaugacggguucauugauaucuggaccuacaacgcggagcugcuuguccugcucgaaaaugagagaacacuggacuuucaugacagcaacgugaagaaucuuuaugaaaaagucaagucucagcugaagaacaaugccaaagagauuggaaacggcugcuucgaguuuuaccacaaguguaaugaugaaugcauggaguccgugaaaaacgggaccuaugacuaccccaaguauagcgaagagucuaaacucaaucgggagaagaucgauggcguuaagcuggaauccaugggaguguaccagauucuggcuaucuauagcacggucgccuccucucucgugcugcuuguuagccugggcgccaucuccuucuggaugugcucuaacgggagccuccagugucgcauuugcaucuga

SEQ ID NO: 188537 - RNA, 1698 nt, Artificial Sequence
  derived and/or modified sequence opt5 from hemagglutinin__InfluenzaA__ADL39467
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucguggaccagaaaacccuguacagaacagagaaugccuacgucagcguuguguccucucauuauagccggaaguucacccccgaaauugcuaagcgcccuaaagugagagaucaggagggccggaucaacuacuauuggacgcuucuggagcccggggacacaauuaucuuugaagccaauggaaaccucauugcgccucgcuacgccuucgcucuguccagaggcuuugggagcggaaucauuaauucuaacgcccccaugggcaagugugaugcuaaaugccagaccccgcaaggcgccaucaauuccagccuuccuuuccagaacguccaccccgugacaaucggggaguguccuaaguauguucggucugcgaaacugcgcauggugaccggacucagaaauauucccagcauccagucccggggccuguuuggggccauugcuggauucaucgaaggcggguggaccggaauggucgacggcugguacggcuaucaucaccagaacgagcaagggucuggauacgccgcugaucaaaagagcacacagaaugccauuaacggcaucacgaauaaagugaacuccguuaucgaaaagaugaauacccaguuuacagccguggggaaggaguucaacaaacuggagcgcagaauggaaaaccucaauaagaaagucgacgauggauucauugacaucuggaccuacaacgcugagcugcuugugcugcucgaaaaugagcggacacuggauuuucacgacagcaacgucaagaaucuuuaugaaaaagugaagucucagcugaagaacaaugcgaaagagauuggcaacgggugcuucgaguuuuaccauaaguguaaugacgaaugcauggaguccguuaaaaacggcaccuaugauuaccccaaguauagcgaagagucuaaacucaaucgcgagaagaucgacggagugaagcuggaauccaugggcgucuaccagauucuggccaucuauagcacgguggcuuccucucucguucugcuugugagccugggggccaucuccuucuggaugugcucuaacggaagccuccaguguagaauuugcaucuga

SEQ ID NO: 188538 - RNA, 1701 nt, Artificial Sequence; identical to SEQ ID NO: 185693
  derived and/or modified sequence opt5 from hemagglutinin__InfluenzaA__ADL41164

SEQ ID NO: 188539 - RNA, 1701 nt, Artificial Sequence; identical to SEQ ID NO: 185786
  derived and/or modified sequence opt5 from hemagglutinin__InfluenzaA__ADL41173

SEQ ID NO: 188540 - RNA, 1698 nt, Artificial Sequence
  derived and/or modified sequence opt5 from hemagglutinin__InfluenzaA__ADL60242
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaacgcuccuuuuauagaaaccugcuuuggcugacaggcaaaaaugggcucuaccccaaccugagcaagucuuaugcuaauaacaaagagaaggaagugcugguccucuggggagugcaccacccuccggacaucggcaaccagaaaacccuguaccauacagagaaugccuacguguccgucguuagcucccacuauucucggaaguucacccccgaaauugcuaagcgcccuaaagugagagaucaggaggggcggaucaacuacuauuggacgcuucuggagcccggagacacaauuaucuuugaagccaauggcaaccucauugcgccucgcuacgccuucgcucugagcagaggguuuggauccggcaucauuaauagcaacgcccccauggauaagugugacgcuaaaugccagaccccgcaaggcgccaucaauucuucccuuccuuuccagaacgugcaucccgucacaaucggggaguguccuaaguaugugcggagcgcgaaacugcgcaugguuaccggacucagaaauauucccucuauccagagccggggccuguuuggggccauugcuggauucaucgaaggcggguggaccggaaugguggauggcugguacggcuaucaccaccagaacgagcaaggguccggauacgccgcugaccagaagucuacacagaaugccauuaacggcaucacgaauaaagucaacagcgugaucgaaaagaugaauacccaguuuacagccguugggaaggaguucaacaaacuggagcgcagaauggaaaaccucaauaagaaaguggaugacggauucauugauaucuggaccuacaacgcugagcugcuuguccugcucgaaaaugagcggacacuggacuuucaugacuccaacgugaagaaucuuuaugaaaaagucaagagccaacugaagaacaaugcgaaagagauuggcaacgggugcuucgaguuuuaccacaaguguaaugaugaaugcauggagucugugaaaaacggcaccuaugacuaccccaaguauuccgaagagagcaaacucaaucgcgagaagaucgauggaguuaagcuggaaucuaugggcguguaccagauucuggccaucuauuccacggucgcuagcucccucgugcugcuuguuucucugggggccaucagcuucuggaugugcuccaacggaucucuccaguguagaauuugcaucuga

SEQ ID NO: 188541 - RNA, 1698 nt, Artificial Sequence
  derived and/or modified sequence opt5 from hemagglutinin__InfluenzaA__ADL60253
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcggccugcuuaucuccaaagaaucuuggagcuacauuguggagaagccgaaccccgaaaaugggaccuguuauccuggauacuuugccgauuaugaggagcugagagaacaacucuccucugucagcuccuucgagcgguuugaaaucuuccccaaggagagcucuuggccuaaccauacggugaccggcguuuccgccagcugcucucacaauggcgaguccagcuuuuaccgcaaccugcuuuggcugacagggaaaaauggacucuaucccaaccugucuaaguccuacgcuaauaacaaagaaaaggaggugcugguccucuggggcgugcaucacccuccgaacaucgggaaucagaaagcccuguaccacaccgaaaacgcuuaugugagcgucguuuccucucauuacagcagaaaguucacacccgagauugccaagcggccuaaagugcgcgaccaggaaggaagaaucaauuauuacuggacccuucuggagcccggcgauacgauuaucuuugaggcgaacgggaaucucauugccccucgguaugcuuucgcccugucccgcggauuuggcagcggcaucauuaacucuaaugcucccauggacaagugugaugccaaaugccagacaccgcaaggggcgaucaacuccagccuuccuuuccagaaugugcaccccgucaccaucggagaauguccuaaguacgugagaucugccaaacugcggaugguuacaggccuccgcaacauucccagcauccaguccagagggcuguuuggagcuauugccggcuucaucgaagggggauggaccggcaugguggacggcugguauggguaccaucaccagaaugaacaaggaucuggcuacgcugccgaucaaaagagcacccagaacgccauuaaugggaucacaaacaaagucaauuccgugaucgagaagaugaacacgcaguuuaccgcuguuggaaaggaguucaacaaacuggagcggcgcauggagaaucucaacaagaaaguggacgauggcuucauugacaucuggacauauaaugcggaacugcuuguccugcucgagaacgaaagaacccuggauuuucacgacagcaaugugaagaaccuuuacgagaaagucaagucucagcugaagaauaacgccaaagaaauugggaauggcugcuucgaguuuuaucauaaguguaacgacgagugcauggaauccgugaaaaauggaacauacgauuaucccaaguacagcgaggaaucuaaacucaaccgggagaagaucgacggcguuaagcuggaguccauggggguguaucagauucuggcuaucuacagcaccgucgccuccucucucgugcugcuuguuagccugggagccaucuccuucuggaugugcucuaauggcagccuccagugucgcauuugcaucuga

SEQ ID NO: 188542 - RNA, 1698 nt, Artificial Sequence; identical to SEQ ID NO: 188540
  derived and/or modified sequence opt5 from hemagglutinin__InfluenzaA__ADL60264

SEQ ID NO: 188543 - RNA, 1698 nt, Artificial Sequence; identical to SEQ ID NO: 188540
  derived and/or modified sequence opt5 from hemagglutinin__InfluenzaA__ADL60275

SEQ ID NO: 188544 - RNA, 1698 nt, Artificial Sequence
  derived and/or modified sequence opt5 from hemagglutinin__InfluenzaA__ADL60286
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgagcaucuccaaccagaaaacccuguaccauacagagaaugccuacgugucugucguuagcucccacuauagcagaaaguucacccccgaaguggcuaagcggccuaaagugcgcgaccaggagggcagaauuaacuacuauuggacgcuucuggagcccggggauacaaucauuuuugaagccaauggaaaccucaucgcgccucgguacgccuucgcucugucucgcggcuuuggguccggaauuaucaauagcaacgcccccauggacaagugugaugcuaaaugccagaccccgcaaggcgccauuaauucuagccuuccuuuccagaacguccaucccgugacaaucggcgaguguccuaaguauguuagauccgcgaaacugcggauggugaccgggcuccgcaauauccccucuauucagagcagaggacuguuuggcgccaucgcuggguucauugaaggaggcuggaccgggauggucgacggaugguacggcuaucaccaccagaacgagcaaggcuccggguacgccgcugaucaaaagagcacacagaaugccaucaacggaauuacgaauaaagugaacucuguuaucgaaaagaugaauacccaguuuacagccgugggcaaggaguucaacaaacuggagcggcgcauggaaaaccucaauaagaaagucgacgauggguucaucgacauuuggaccuacaacgcugagcugcuugugcugcucgaaaaugagagaacacuggauuuucaugacuccaacgucaagaaucuuuaugaaaaaguuaagagccagcugaagaacaaugcgaaagagaucggaaacggcugcuucgaguuuuaccacaaguguaaugacgaaugcauggagucugugaaaaacgggaccuaugauuaccccaaguauuccgaagagagcaaacucaaucgggagaagauugacggcgugaagcuggaauccaugggagucuaccagauccuggccauuuauucuacgguggcuagcucccucguucugcuugugucucugggcgccaucagcuucuggaugugcuccaacgggagccuccagugucgcaucugcauuuga

SEQ ID NO: 188545 - RNA, 1698 nt, Artificial Sequence
  derived and/or modified sequence opt5 from hemagglutinin__InfluenzaA__ADL60297
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaagaaagaauggccucuaccccaaccugucuaaguccuaugcuaauaacaaagagaaggaagugcugguccucuggggagugcaccacccuccgaacaucggggaccagaaaacccuguaccauacagagaaugccuacgugagcgucguuuccucucacuauagccggaaguucacccccgaaauugcuaagcgcccuaaagugagagaucaggagggccggaucaacuacuauuggacgcuucuggagcccggggacacaauuaucuuugaagccaauggaaaccucauugcgccucgcuacgccuucgcucuguccagaggcuuugggagcggaaucauuaauucuaacgcccccauggauaagugugacgcuaaaugccagaccccgcaaggcgccaucaauuccagccuuccuuuccagaacgugcaucccgucacaaucggcgaguguccuaaguaugugcggucugcgaaacugcgcaugguuaccgggcucagaaauauucccagcauccagucccggggacuguuuggcgccauugcuggguucaucgaaggaggcuggaccgggaugguggauggaugguacggcuaucaccaccagaacgagcaaggcucuggguacgccgcugaccagaaaagcacacagaaugccauuaacggaaucacgaauaaagucaacuccgugaucgaaaagaugaauacccaguuuacagccguuggcaaggaguucaacaaacuggagcgcagaauggaaaaccucaauaagaaaguggaugacggguucauugauaucuggaccuacaacgcugagcugcuuguccugcucgaaaaugagcggacacuggacagccaugacucuaacgugaagaaucuuuaugaaaaagucaagucccaacugaagaacaaugcgaaagagauuggaaacggcugcuuugaguucuaccacaaguguaaugaugaaugcauggagagcgugaaaaacgggaccuaugacuaccccaaguauucugaagaguccaaacucaaucgcgagaagaucgauggcguuaagcuggaaagcaugggaguguaccagauucuggccaucuauuccacggucgcuucuagccucgugcugcuuguuucccugggcgccaucucuuuuuggaugugcagcaacgggucccuccaguguagaauuugcaucuga

SEQ ID NO: 188546 - RNA, 1698 nt, Artificial Sequence
  derived and/or modified sequence opt5 from hemagglutinin__InfluenzaA__ADL60308
augaaggugaaacugcucguccugcuuugcaccuucgccgcuacauacgccgacacgaucuguauuggcuaucacgcgaacaauagcaccgauacaguugacaccgugcuggagaagaacgugacagucacccauuccgugaaucuccuggaaaacucucacaaugggaaacuuugccugcucaagggaaucgcuccccugcagcugggcaacuguagcguugccggguggauucucggaaauccugagugcgaacugcuuaucuccaaagagucuuggagcuacauuguggaaaagccgaaccccgagaauggcacauguuauccugggcauuuugccgauuacgaggaacugagagagcaacucuccucugucagcuccuucgaacgguuugagaucuuccccaaggagagcucuuggccuaaccacaccgugacgggaguuuccgcuagcugcucucauaauggcgaauccagcuuuuaucgcaaccugcuuuggcugaccggcaaaaaugggcucuaccccaaccugucuaaguccuaugccaauaacaaagagaaggaagugcugguccucuggggagugcaccacccuccgaacaucggcgugcagaaagcucuguaccauacagagaaugccuacgucagcguuguguccucucacuauagcagaaaguucacccccgaaauugcgaagcggccuaaagugcgcgaccaggaggggagaaucaacuacuauuggacacuucuggagcccggagauaccauuaucuuugaagccaauggcaaccucauugcuccucgguacgccuucgcucugucccgcggguuuggaagcggcaucauuaauucuaacgcccccauggacaagugugaugcgaaaugccagacgccgcaaggcgccaucaauuccagccuuccuuuccagaacguccaucccgugacaaucggggaguguccuaaguauguuagaucugcuaaacugcggauggugaccggacuccgcaauauucccagcauccaguccagaggccuguuuggggccauugcuggauucaucgaaggcggguggacaggaauggucgacggcugguacggcuaucaccaccagaacgagcaagggucuggauacgccgccgaucaaaagagcacccagaaugcuauuaacggcaucaccaauaaagugaacuccguuaucgaaaagaugaauacacaguuuacggcgguggggaaggaguucaacaaacuggagcggcgcauggaaaaccucaauaagaaagucgacgauggauucauugacaucuggaccuacaacgccgagcugcuugugcugcucgaaaaugagagaacacuggauuuucaugacagcaacgucaagaaucuuuaugaaaaagugaagucucagcugaagaacaaugcuaaagagauuggcaacgggugcuucgaguuuuaccacaaguguaaugacgaaugcauggaguccguuaaaaacggcaccuaugauuaccccaaguauagcgaagagucuaaacucaaucgggagaagaucgacggagugaagcuggaauccaugggcgucuaccagauucuggccaucuauagcacaguggccuccucucucguucugcuugugagccugggggcuaucuccuucuggaugugcucuaacggaagccuccagugucgcauuugcaucuga

SEQ ID NO: 188547 - RNA, 1698 nt, Artificial Sequence
  derived and/or modified sequence opt5 from hemagglutinin__InfluenzaA__ADL60341
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgugcagaaagcccuguaccauaccgagauugcuuacgucagcguuguguccucucacuauagcagaaaguucacacccgaaaucgccaagcggccuaaagugcgcgaccaggaggggagaauuaauuacuauuggaccauccuugagcccggagauacgauuaucuuugaagcgaacggcaaucugauugccccucgguacgcuuucgcccucucccgcggguuuggaagcggcaucaucaacucuaaugcucccauggacaagugugaugccaaaugccagacaccgcaaggcgcgauuaacuccagccugccuuuccagaauguccaucccgugaccaucggggaguguccuaaguauguuagaucugccaaacuucggauggugacaggacugcgcaacauucccagcauccaguccagaggccucuuuggggcuauugccggauucaucgaaggcggguggaccggaauggucgacggcugguacggcuaucaccaccagaaugagcaagggucuggauacgcugccgaucagaaguccacccagaacgccaucaauggcauuacaaacaaagugaauagcguuaucgaaaagaugaacacgcaguuuaccgcuguggggaaggaguucaauaaacuggagcggcgcauggaaaaccugaacaagaaagucgacgauggauucauugacaucuggacauacaaugcggagcuccuggugcuucuggaaaacgagagaacccucgauuuucaugacagcaaugucaagaaccuguaugaaaaagugaagucucaacuuaagaauaacgccaaagagauuggcaaugggugcuucgaguuuuaccacaaguguaacgacgaaugcauggaguccguuaaaaauggcacauaugauuaccccaaguauagcgaagagucuaaacugaaccgggagaagaucgacggagugaagcucgaauccaugggcgucuaccagauccuggcuauuuauagcaccguggccuccucucugguucuccuggugagccuuggggccaucuccuucuggaugugcucuaauggaagccugcagugucgcauuugcaucuga

SEQ ID NO: 188548 - RNA, 1698 nt, Artificial Sequence
  derived and/or modified sequence opt5 from hemagglutinin__InfluenzaA__ADL60352
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccggauacgaggaacugagagagcaacucuccucugucagcuccuucgaacgguuugagaucuuccccaaggagagcucuuggccuaaccacacggugaccggcguuuccgccagcugcucucauaauggcgaacgcuccuuuuauagaaaccugcuuuggcugacagggaaaaauggacucuaccccaaccugagcaagucuuaugcuaauaacaaagagaaggaagugcugguccucuggggcgugcaccacccuccggauaucgggaaccagaaaacccuguaccauacagagaaugccuacguguccgucguuagcucccacuauucucggaaguucacccccgaaauugcuaagcgcccuaaagugagagaccaggagggacggaucaacuacuauuggacgcuucuggagcccggcgauacaauuaucuuugaagccaaugggaaccucauugcgccucgcuacgccuucgcucugagcagaggauuuggcuccggcaucauuaauagcaacgcccccauggacaagugugaugcuaaaugccagaccccgcaaggggccaucaauucuucccuuccuuuccagaacgugcaucccgucacaaucggagaguguccuaaguaugugcggagcgcgaaacugcgcaugguuaccggccucagaaauauucccucuauccagagccgggggcuguuuggagccauugcuggcuucaucgaagggggauggaccggcaugguggacggcugguacggguaucaccaccagaacgagcaaggauccggcuacgccgcugaucagaagucuacacagaaugccauuaacgggaucacgaauaaagucaacagcgugaucgaaaagaugaauacccaguuuacagccguuggaaaggaguucaacaaacuggagcgcagaauggaaaaccucaauaagaaaguggacgauggcuucauugacaucuggaccuacaacgcugagcugcuuguccugcucgaaaaugagcggacacuggauuuucaugacuccaacgugaagaaucuuuaugaaaaagucaagagccaacugaagaacaaugcgaaagagauugggaacggcugcuucgaguuuuaccacaaguguaaugacgaaugcauggagucugugaaaaacggaaccuaugauuaccccaaguauuccgaagagagcaaacucaaucgcgagaagaucgacggcguuaagcuggaaucuauggggguguaccagauucuggccaucuauuccacggucgcuagcucccucgugcugcuuguuucucugggagccaucagcuucuggaugugcuccaacggcucucuccaguguagaauuugcaucuga

SEQ ID NO: 188549 - RNA, 1701 nt, Artificial Sequence
  derived and/or modified sequence opt5 from hemagglutinin__InfluenzaA__ADL60363
augaagaccaucauugcccugagcuacauccucugccugguguucgcucagaaauuucccggcaacgacaauuccacagccacgcuuugucuggggcaccaugcggucccuaacggaaccauuguuaagacaaucaccaaugaucaaauugaggugacaaacgcuaccgaacucgugcagucuagcuccacaggcgagaucugcgacucuccgcaccagauccuggauggggaaaauuguacccuuauugacgcccugcucggagauccccagugcgacggcuuccaaaacaaaaauugggaucuguuugucgagagaagcaaggccuauuccaacuguuacccuuaugacgugcccgauuacgcuucucugcggagccucaucgccuccagcgggacgcuggaguucaauaacgaaucuuuuaauuggaccggaguuacacagaacggcaccuccagcgcuugcauucgcagaucuaauaacuccuucuuuagccggcuuaauuggcugacacauucuaaauucaaguauccugcccucaacgugaccaugcccaacaaugagaacuuugacaagcuguacaucuggggcguccaccauccugggacggauaaugaccagauuuuccuuuaugcgcaggccuccggacgcaucacaauuagcaccaaaagaucccaacagacagugaucccgaacaucggcucucggccccgcguuagagauauuccuagccggaucuccauuuacuggaccaucgugaagcccggggacauucugcucaucaauagcaccggaaaccugaucgcuccucgcggcuacuuuaaaauuagaucugggaaguccagcaucaugcggucugacgcccccauuggaaaauguaauagcgaaugcaucacaccgaacggcuccauuccuaaugauaagcccuuccagaacgucaaucgcaucacguauggcgcuuguccuagauacgugaagcagaacacccugaaacucgccacagggaugcggaaugugcccgagaagcaaacccgcggaaucuuuggcgcgauugccggguucaucgaaaacggaugggagggcauggucgacgggugguauggauucagacaccaaaauucugagggcguuggccaggcugccgaucugaaaagcacacaggcugccauugaccagaucaacgggaaacuuaaccggcugauuggaaagaccaaugaaaaguuucaccagaucgagaaagaguucuccgaaguggaaggccgcauucaggaucucgagaaguacguggaggacacgaagaucgaucuguggagcuauaacgccgaacuucuggucgcucucgagaaucaacauacaaucgaccugaccgauucugaaaugaacaaacuguuugagaagaccaaaaagcagcucagagaaaaugcggaggacauggggaacggaugcuucaaaauuuaccacaagugugauaaugccugcaucggcuccauucggaacgggacauaugaccaugacguguacagagaugaggcucugaauaaccgcuuucagaucaagggcguugaacuuaaaagcggauacaaggacuggauucuguggaucucuuucgccaucuccugcuuucuccuguguauugcccuucugggcuucaucaugugggcuugccagaaagggaauauucgguguaacaucugcauuuga

SEQ ID NO: 188550 - RNA, 1698 nt, Artificial Sequence
  derived and/or modified sequence opt5 from hemagglutinin__InfluenzaA__ADL60374
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucaugacggcgaauccagcuuuuaucgcaaucugcuuuggcugacaggcaaaaacgggcucuaccccaaucugucuaaguccuaugcuaacaauaaagagaaggaagugcugguccucuggggagugcaccacccuccgaacaucggcgaucagaaagcccuguaccauaccgagaacgcuuacgugagcgucguuuccucucacuauagcagaaaguucacacccgaaauugccaagcggccuaaagugcgcgaccaggaggggagaaucaauuacuauuggacccuucuggagcccggagauacgauuaucuuugaagcgaacggcaaucucauugccccucgguacgcuuucgcccugucccgcggguuuggaagcggcaucauuaacucuaaugcucccauggacaagugugaugccaaaugccagacaccgcaaggcgcgaucaacuccagccuuccuuuccagaaugugcaucccgucaccaucggggaguguccuaaguaugugagaucugccaaacugcggguugugacaggacuccgcaacauucccagcauccaguccagaggccuguuuggggcuauugccggauucaucgaaggcggguggaccggaauggucgacggcugguacggcuaucaccaccagaaugagcaagggucuggauacgcugccgaucagaaguccacccagaacgccauuaauggcaucacaaacaaagugaauagcguuaucgaaaagaugaacacgcaguuuaccgcuguggggaaggaguucaauaaacuggagcggcgcauggaaaaccucaacaagaaagucgacgauggauucauugacaucuggacauacaaugcggagcugcuugugcugcucgaaaacgagagaacccuggacuuucaugauagcaaugucaagaaccuuuaugaaaaagugaagucucaacugaagaauaacgccaaagagauuggcaaugggugcuucgaguuuuaccacaaguguaacgacgaaugcauggaguccguuaaaaauggcacauaugauuaccccaaguauagcgaagagucuaaacucaaccgggagaagaucgacggagugaagcuggaauccaugggcgucuaccagauucuggcuaucuauagcaccguggccuccucucucguucugcuugugagccugggggccaucuccuucuggaugugcucuaauggaagccuccagugucgcauuugcaucuga

SEQ ID NO: 188551 - RNA, 1701 nt, Artificial Sequence
  derived and/or modified sequence opt5 from hemagglutinin__InfluenzaA__ADM07135
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaauccaacaagggagugacagccgcuuguccccaugccggcgcgaaaucuuuuuauaagaaucugaucuggcucguuaaaaagggcaacagcuacccuaaacuguccaagagcuauauuaaugauaaggggaaagaggugcuuguccuguggggaauccaccaccccuccaccucugccgaccaacagagccucuaccagaacgcugaugccuacguguucgugggcacauccagauauagcaagaaauuuaagccugagauugcuauccggccgaaaguccgcgaccaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaccugaaaagcacacagaacgccaucgaugagauuaccaauaaggucaacuccgugaucgaaaagaugaauacgcaguuuacagcuguuggaaaggaguucaaccaccuugaaaagagaauugagaaucugaacaaaaagguggacgauggcuuccucgacaucuggaccuacaaugccgaacugcugguccuccuggagaacgagcggacccuugauuaucaugacagcaaugugaaaaaccuguacgaaaagguccgcucucagcucaaaaacaaugccaaggagauugggaacggauguuuugaguucuaucacaagugcgauaauacauguauggaguccgugaaaaacggcaccuacgacuauccuaaguacagcgaagaggcuaaacugaauagagaggaaaucgaugggguuaaacuugagucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 188552 - RNA, 1701 nt, Artificial Sequence; identical to SEQ ID NO: 186178
  derived and/or modified sequence opt5 from hemagglutinin__InfluenzaA__ADM07144

SEQ ID NO: 188553 - RNA, 1701 nt, Artificial Sequence
  derived and/or modified sequence opt5 from hemagglutinin__InfluenzaA__ADM07154
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaucccccuaccuccgccgaucaacagucucucuaccagaacgcugacgccuacguguucgugggcacaagcagauauuccaagaaauuuaagccggagauugcuauccggcccaaaguccgcgaucaggaggggagaaugaauuacuauuggacccugguugaaccuggagacaagauuacguucgaggccacaggcaaccugguggugccccgguacgcguuugccaugguccgcaacgcugggagcggaaucauuaucucugauaccccugugcacgacugcaauacaaccugucaaacccccaaaggcgccaucaacacaucccucccguuccagaauauucacccuaucacgauuggcaagugccccaaguauguuaaaagcaccaagcugagacuugcuacagggcugcggaacgugccuucuauccagagccgcggacucuuuggcgccauugccggguucaucgaaggaggcuggaccgggauggucgacggaugguacggcuaucaucaccagaaugagcaaggcuccggguacgcugcggaucugaaaucuacacagaacgccaucgacgaaauuaccaauaaggugaacagcguuaucgagaaaaugaauacgcaguuuacagcugugggaaaggaguucaaccaccuugaaaagagaauugagaaucugaacaaaaaggucgaugacggcuuccucgauaucuggaccuacaaugccgaacugcuggugcuccuggagaacgaacggacccuugacuaucaugauuccaaugucaaaaaccuguacgagaaggugcgcagccagcucaaaaacaaugccaaggagauugggaacggauguuuugaguucuaucacaagugcgacaauacauguauggagucuguuaaaaacggcaccuacgauuaucccaaguacuccgaagaggcuaaacugaauagagaagagaucgacggggugaaacuugagagcacacggaucuaucaaauucuggccaucuacucuacggucgcguccagccucgugcugguugugucccugggcgcuauuucuuuuuggaugugcagcaacggaucccuccagugccgcaucuguauuuga

SEQ ID NO: 188554 - RNA, 1701 nt, Artificial Sequence; identical to SEQ ID NO: 186178
  derived and/or modified sequence opt5 from hemagglutinin__InfluenzaA__ADM07163

SEQ ID NO: 188555 - RNA, 1698 nt, Artificial Sequence; identical to SEQ ID NO: 188537
  derived and/or modified sequence opt5 from hemagglutinin__InfluenzaA__ADM07460

SEQ ID NO: 188556 - RNA, 1701 nt, Artificial Sequence
  derived and/or modified sequence opt5 from hemagglutinin__InfluenzaA__ADM07504
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaauuuuaaguauccugcccuuaacgucaccaugcccaacaaugagcaguucgacaagcuguacauuuggggcgugcaccauccugggacggauaaagaccagaucuuucucuaugcgcaagccucuggacgcauuacaguuuccaccaagagaagccagcaggcugugaucccgaacauuggcucccggccccgcgucagaaauaucccuucucggaucagcauuuacuggacaaucgugaaacccggggauauucugcugaucaacuccaccggaaaucucauugccccucgcggcuacuucaagaucagaaacgggaaaagcucuaucaugcgguccgacgcucccauuggaaaguguaauagcgaaugcaucaccccgaacggcucuauuccuaaugacaagcccuuucagaacgugaaucgcaucacauauggcgccuguccuagauacgucaaacaaaacacgcugaaacuugcgaccgggaugcggaauguucccgagaagcagacacgcggaauuuucggcgccaucgcuggguuuaucgaaaacggaugggagggcaugguggaugggugguauggauucagacaccagaauagcgagggccggggccaagccgcugaccugaaguccacccaggccgccauugaucagaucaacgggaaacucaacagacugauuggaaagacaaaugaaaaauuccaccagaucgagaaggaauuuucugagguggaaggccgcauucaagaccuugagaaguacgucgaggauaccaaaaucgaccuguggagcuauaacgcugaacuccugguggcgcuggagaaucagcauacgauugaucucacagacuccgaaaugaacaagcuguucgagaaaaccaagaaacagcuucgggaaaaugccgaggauauggggaacggaugcuuuaagaucuaccacaagugugacaaugcuugcaucggcagcauuagaaacgggaccuaugaucaugacguuuaccgcgacgaggcccugaauaaccgguuccagaucaaaggcguggaacucaagucuggauacaaagauuggauucuguggaucuccuuugccauuagcugcuuccuucugugugucgcucuccugggcuuuaucaugugggccugccaaaaggggaauaucagauguaacauuugcaucuga

SEQ ID NO: 188557 - RNA, 1701 nt, Artificial Sequence
  derived and/or modified sequence opt5 from hemagglutinin__InfluenzaA__ADM12806
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaauuuuaaguauccugcccuuaacgucaccaugcccaacaaugagcaguucgacaagcuguacauuuggggcgugcaccauccugggacggauaaagaccagaucuuucucuaugcgcaagccucuggacgcauuacaguuuccaccaagagaagccagcaggcugugaucccgaacauuggcucccggccccgcgucagaaauaucccuucucggaucagcauuuacuggacaaucgugaaacccggggauauucugcugaucaacuccaccggaaaucucauugccccucgcggcuacuucaagaucagaagcgggaaaucuuccaucaugcggagcgacgcucccauuggaaaguguaacucugaaugcaucaccccgaauggcagcauuccuaacgacaagcccuuucagaaugugaaccgcaucacauauggcgccuguccuagauacgucaaacaauccacgcugaagcuggcgaccgggaugcggaauguucccgagaaacagacacgcggaauuuucggcgccaucgcuggguuuaucgaaaacggaugggagggcaugguggaugggugguauggauucagacaccaaaauucugagggccggggccaggccgcugaccuuaagagcacccaggccgccauugaucagaucaacgggaaacucaauagacugauuggaaagacaaacgaaaaauuccaccagaucgagaaggaauuuuccgagguggaaggccgcauucaagaccuugagaaguacgucgaggauaccaaaaucgaccuguggagcuauaacgcugaacuccugguggcgcuggagaaucagcauacgauugaucucacagacucugaaaugaacaagcuguucgagaaaaccaagaaacagcuucgggaaaaugccgaggauauggggaacggaugcuuuaccaucuaccacaagugugacaaugcuugcaucggcuccauuagaaacgggacauaugaucauaauguuuaccgcgacgaggcccugaacaaucgguuccagaucaagggcguggaacucaaaagcggauacaaggacuggauucuguggaucucuuuugccauuuccugcuuccuucugugugucgcucuccugggcuuuaucaugugggccugccaaaaagggaacaucagauguaauauuugcaucuga

SEQ ID NO: 188558 - RNA, 1701 nt, Artificial Sequence; identical to SEQ ID NO: 188557
  derived and/or modified sequence opt5 from hemagglutinin__InfluenzaA__ADM12817

SEQ ID NO: 188559 - RNA, 1701 nt, Artificial Sequence; identical to SEQ ID NO: 188557
  derived and/or modified sequence opt5 from hemagglutinin__InfluenzaA__ADM12828

SEQ ID NO: 188560 - RNA, 1701 nt, Artificial Sequence; identical to SEQ ID NO: 188557
  derived and/or modified sequence opt5 from hemagglutinin__InfluenzaA__ADM12839

SEQ ID NO: 188561 - RNA, 1701 nt, Artificial Sequence
  derived and/or modified sequence opt5 from hemagglutinin__InfluenzaA__ADM12850
augaaggccaucauugcucugagcuacauccucugccugguguucgcccagaaacuucccggcaacgacaauuccaccgcgacacugugucucgggcaccaugcugucccuaacggaacgauuguuaagaccaucacaaaugaucaaauugaggugaccaacgccacagaacuggugcagucuagcuccaccggcgagaucugcgacucuccgcaccagauccuugauggggaaaauuguacacugauugacgcccuccugggagauccccagugcgacggcuuucaaaacaaaaagugggaucuguucgucgagagaagcaaggcuuauuccaauuguuacccuuaugacgugcccgauuacgccucucuccggagccugguugcuuccagcgggacccuugaauuuaacaaugagucuuucaacuggacgggagugacccagaauggcacauccagcgccugcauccgcagaucuaacaauuccuuuuucagccggcugaacuggcucacccaucugaauuuuaaguauccugcgcuuaacgucacaaugcccaacaaugagcaguucgacaagcuguacauuuggggcgugcaccauccugggaccgauaaagaccagaucuuucucuaugcccaggcuucuggacgcauuacgguuuccacaaagagaagccagcaggccgugaucccgaacauuggcucccggccccgcgucagaaauaucccuucucggaucagcauuuacuggaccaucgugaaacccggggauauucugcugaucaacuccacaggaaaucucauugcuccucgcggcuacuucaagaucagaagcgggaaaucuuccaucaugcggagcgacgcccccauuggaaaguguaacucugaaugcaucaccccgaauggcagcauuccuaacgacaagcccuuucagaaugugaaccgcaucaccuauggcgcguguccuagauacgucaaacaauccacacugaaacuugccacggggaugcggaauguucccgagaaacagacccgcggaauuuucggcgcuaucgccggguuuaucgaaaacggaugggagggcaugguggaugggugguauggauucagacaccaaaauucugagggccggggccaagcugccgaccucaagagcacacaggccgcuauugaucagaucaacgggaaacugaauagacugauuggaaagaccaacgaaaaauuccaccagaucgagaaggaauuuuccgagguggaaggccgcauucaagaccuugagaaguacgucgaggauacaaaaaucgaccuguggagcuauaacgcggaacuccugguggcccuggagaaucagcauaccauugaucucacggacucugaaaugaacaagcuguucgagaaaacaaagaaacagcuucgggaaaaugcugaggauauggggaacggaugcuuuaccaucuaccacaagugugacaaugccugcaucggcuccauuagaaacgggaccuaugaucauaauguuuaccgcgacgaggcccugaacaaucgguuccagaucaagggcguggaacucaaaagcggauacaaggacuggauucuguggaucucuuuugcuauuuccugcuuccuucugugugucgcccuccugggcuuuaucaugugggcgugccaaaaagggaacaucagauguaauauuugcaucuga

SEQ ID NO: 188562 - RNA, 1701 nt, Artificial Sequence; identical to SEQ ID NO: 185693
  derived and/or modified sequence opt5 from hemagglutinin__InfluenzaA__ADM12861

SEQ ID NO: 188563 - RNA, 1701 nt, Artificial Sequence; identical to SEQ ID NO: 185693
  derived and/or modified sequence opt5 from hemagglutinin__InfluenzaA__ADM12871

SEQ ID NO: 188564 - RNA, 1701 nt, Artificial Sequence; identical to SEQ ID NO: 185693
  derived and/or modified sequence opt5 from hemagglutinin__InfluenzaA__ADM12881

SEQ ID NO: 188565 - RNA, 1701 nt, Artificial Sequence; identical to SEQ ID NO: 185693
  derived and/or modified sequence opt5 from hemagglutinin__InfluenzaA__ADM12891

SEQ ID NO: 188566 - RNA, 1701 nt, Artificial Sequence; identical to SEQ ID NO: 185693
  derived and/or modified sequence opt5 from hemagglutinin__InfluenzaA__ADM12901

SEQ ID NO: 188567 - RNA, 1701 nt, Artificial Sequence; identical to SEQ ID NO: 186795
  derived and/or modified sequence opt5 from hemagglutinin__InfluenzaA__ADM12911

SEQ ID NO: 188568 - RNA, 1701 nt, Artificial Sequence; identical to SEQ ID NO: 185693
  derived and/or modified sequence opt5 from hemagglutinin__InfluenzaA__ADM12921

SEQ ID NO: 188569 - RNA, 1701 nt, Artificial Sequence; identical to SEQ ID NO: 185693
  derived and/or modified sequence opt5 from hemagglutinin__InfluenzaA__ADM12931

SEQ ID NO: 188570 - RNA, 1701 nt, Artificial Sequence; identical to SEQ ID NO: 185693
  derived and/or modified sequence opt5 from hemagglutinin__InfluenzaA__ADM12941

SEQ ID NO: 188571 - RNA, 1701 nt, Artificial Sequence; identical to SEQ ID NO: 185693
  derived and/or modified sequence opt5 from hemagglutinin__InfluenzaA__ADM12951

SEQ ID NO: 188572 - RNA, 1701 nt, Artificial Sequence
  derived and/or modified sequence opt5 from hemagglutinin__InfluenzaA__ADM12961
augaaggccgugcuggucguucuccuguacaccuucgcuacagccaacgcggacacgcuuugcaucggcuaucacgcuaauaacagcaccgauacaguggacaccgugcuggagaaaaaugucacagugacccauuccguuaacauucucgaagauaagcacaaugggaaacuguguaaacuuggaggcguggcuccccugcaucucgggaagugcaacaucgccggauggauucugggcaauccugagugugaaucucugagcacagccuccucuuggagcuacaucgucgagaccuccucuagcgacaacgggacgugcuauccgggagauuuuauugacuacgaagaacucagagagcagcuguccagcgugucuuccuucgaacgguuugagaucuuccccaagaccagcucuuggccuaaucacgauuccaacaagggcguuacagccgcuuguccccaugccggcgcgaaaucuuuuuauaagaaucuuaucuggcuggugaaaaaggggaacagcuacccuaaacucuccaagagcuauauuaaugacaagggaaaagaaguccuggugcuuuggggcauccaccaccccuccaccucugccgaucaacagagccuguaccagaacgcugacgccuacguguucgucgggacaucccgcuauagcaagaaauuuaagccugagauugcuaucagaccgaaaguucgggaucaggagggacgcaugaauuacuauuggacccucguggaacccggcgacaagauuacguucgaggccacagggaaccugguggucccuagauacgcguuugccauggaacggaacgcuggaucuggcaucauuaucuccgauacccccgugcaugacugcaauacaaccugucaaaccccuaaaggcgccaucaacacaagccugcccuuccagaauauucacccgaucacgauugggaagugcccuaaguauguuaaaucuaccaagcuccgccuggcuacaggacuuagaaacgugcccagcauccagucccggggccuguuuggggccauugccggauucaucgagggcggguggaccggaauggucgacggcugguacggcuaucaucaccagaaugaacaagggucuggauacgcugcggaucucaaaagcacacagaacgccaucgacgagauuaccaauaaggugaacuccguuaucgagaaaaugaauacgcaguuuacagcugugggcaaggaguucaaccaccuggagaagcgcauugaaaaucuuaacaaaaaggucgaugacggguuccuggauaucuggaccuacaaugccgagcuccuggugcugcucgaaaacgagagaacccuggacuaucaugauagcaaugucaaaaaccuuuacgagaaggugcggucucagcugaaaaacaaugccaaggaaauuggaaacggcuguuuugaguucuaucacaagugcgacaauacauguauggaauccguuaaaaacgggaccuacgauuauccuaaguacagcgaggaagcuaaacucaaucgcgaggagaucgacggcgugaagcuggaaucuacaagaaucuaucaaauucuugccaucuacuccacggucgcgagcucccuggugcucguugugucucugggagcuauuagcuuuuggaugugcuccaacggcucucugcagugccggaucuguauuuga

SEQ ID NO: 188573 - RNA, 1701 nt, Artificial Sequence; identical to SEQ ID NO: 187342
  derived and/or modified sequence opt5 from hemagglutinin__InfluenzaA__ADM12971

SEQ ID NO: 188574 - RNA, 1701 nt, Artificial Sequence; identical to SEQ ID NO: 186794
  derived and/or modified sequence opt5 from hemagglutinin__InfluenzaA__ADM12981

SEQ ID NO: 188575 - RNA, 1701 nt, Artificial Sequence
  derived and/or modified sequence opt5 from hemagglutinin__InfluenzaA__ADM12991
augaaggccauccuggugguccuccuguacaccuucgagacagcuaacgccgacacgcuuugcauuggcuaucacgcgaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugaaugugagucucucagcacagccuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaagaccagcucuuggccuaaucacgauuccaacaagggagugacagcugccuguccccaugcuggcgccaagagcuuuuauaagaaucugaucuggcucguuaaaaagggcaacucuuacccuaaacuguccaagagcuauauuaaugacaaggggaaagaggugcuuguccuguggggaauccaccaccccuccaccucugcggaucaacagagccucuaccagaacgccgacgcuuacguguucgugggcacauccagauauagcaagaaauuuaagccugagauugccauccggccgaaaguccgcgaucaggaagggagaaugaauuacuauuggacccugguugagcccggagacaagauuacguucgaagcuacaggcaaccugguggugccucgguacgccuuugcgauggagcgcaacgccgggucuggaaucauuaucuccgauacccccguccaugacugcaauacaaccugucaaaccccuaaaggcgcuaucaacacaagccuccccuuccagaauauucacccgaucacgauuggcaagugcccuaaguaugugaaaucuaccaagcugagacuugccacagggcugcggaacguucccagcauccagucccgcggacucuuuggcgcuauugccggguucaucgaaggaggcuggaccgggaugguggacggaugguacggcuaucaucaccagaaugagcaaggcucuggguacgccgcugaucugaaaagcacacagcacgcgaucgacgagauuaccaacaaggucaauuccgugaucgaaaagaugaacacgcaguuuacagccguuggaaaagaguucaaucaucuugaaaagagaauugagaaccugaauaaaaagguggaugacggcuuccucgauaucuggaccuacaacgcugaacugcugguccuccuggagaaugagcggacccuugacuaucacgauagcaacgugaaaaaucuguacgaaaagguccgcucucagcucaaaaacaacgccaaggagauugggaauggauguuuugaguucuaucauaagugcgacaacacauguauggaauccgugaaaaauggcaccuacgauuauccuaaguacagcgaagaggccaaacugaacagagaggaaaucgacgggguuaaacuugagucuacacggaucuaucaaauucuggcuaucuacuccacgguggccagcucccucguccuggugguuucucugggcgcgauuagcuuuuggaugugcuccaauggaucucuccagugccgcaucuguauuuga

SEQ ID NO: 188576 - RNA, 1701 nt, Artificial Sequence
  derived and/or modified sequence opt5 from hemagglutinin__InfluenzaA__ADM13001
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaauccuuuuauaagaaucugaucuggcucguuaaaaagggcaacucuuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacauccccagcauucagucccgcggacucuuuggcgccaucgccggguucaucgagggaggcuggaccgggaugguugacggaugguacggcuaucaucaccagaaugaacaaggcucuggguacgcugcggaucugaaaagcacacagcacgccauugacgagaucaccaacaaggugaauagcgucauugagaaaaugaacacgcaguuuacagcugugggaaaggaguucaaucaucuugagaagagaaucgaaaaccugaauaaaaagguugaugacggcuuccucgauauuuggaccuacaacgccgagcugcuggugcuccuggaaaaugagcggacccuugacuaucacgauagcaacgucaaaaaucuguacgagaaggugcgcucucagcucaaaaacaacgccaaggaaaucgggaauggauguuuugaguucuaucauaagugcgacaacacauguauggaauccgucaaaaauggcaccuacgauuauccuaaguacagcgaggaagcuaaacugaacagagaggagaucgacggggugaaacuugaaucuacacggauuuaucaaauccuggccauuuacuccacgguugcgagcucccucgugcuggucgugucucugggcgcuaucagcuuuuggaugugcuccaauggaucucuccagugccgcauuuguaucuga

SEQ ID NO: 188577 - RNA, 1701 nt, Artificial Sequence; identical to SEQ ID NO: 186857
  derived and/or modified sequence opt5 from hemagglutinin__InfluenzaA__ADM13011

SEQ ID NO: 188578 - RNA, 1701 nt, Artificial Sequence
  derived and/or modified sequence opt5 from hemagglutinin__InfluenzaA__ADM13021
augaaggccauccuggugguccuccuguacaccuucgcuacagccaacgcggacacgcuuugcauuggcuaucacgcuaauaacagcaccgauacaaucgacaccguucuggagaaaaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccaagagcuauaucaaugacaaggggaaagaaguucuugugcuguggggcauucaccaccccuccaccucugccgaucaacagagccucuaccagaacgcugacgccuacgucuucgugggaacauccagauauagcaagaaauuuaagccugagaucgcuauucggccgaaagugcgcgaucaggaggggagaaugaauuacuauuggacccuggucgaacccggagacaagaucacguucgaggccacaggcaaccugguugugccucgguacgcguuugccauggaacgcaacgcugggucuggaauuaucaucuccgauacccccgugcaugacugcaauacaaccugucaaaccccuaaaggcgccauuaacacaagccuccccuuccagaauauccacccgauuacgaucggcaagugcccuaaguaugucaaaucuaccaagcugagacuugcuacagggcugcggaacgugcccagcauucagucccgcggacucuuuggcgccaucgccggguucaucgagggaggcuggaccgggaugguugacggaugguacggcuaucaucaccagaaugaacaaggcucuggguacgcugcggaucugaaaagcacacagaacgccauugacaagaucaccaauaaagugaacuccgucauugagaagaugaauacgcaguuuacagcugugggaaaggaguucaaccaccuugagaaaagaaucgagaaucugaacaagaaaguugaugacggcuuccucgauauuuggaccuacaaugccgaacugcuggugcuccuggagaacgaacggacccuugacuaucaugauagcaaugucaagaaccuguacgagaaagugcgcucucagcucaagaacaaugccaaggagaucgggaacggauguuuugaguucuaucacaaaugcgacaauacauguauggaauccgucaagaacggcaccuacgauuauccuaaauacagcgaagaggcuaagcugaauagagaagagaucgacggggugaaacuugagucuacacggauuuaucaaauccuggccauuuacuccacgguugcgagcucccucgugcuggucgugucucugggcgcuaucagcuuuuggaugugcuccaacggaucucuccagugccgcauuuguaucuga

SEQ ID NO: 188579 - RNA, 1701 nt, Artificial Sequence; identical to SEQ ID NO: 187039
  derived and/or modified sequence opt5 from hemagglutinin__InfluenzaA__ADM13031

SEQ ID NO: 188580 - RNA, 1701 nt, Artificial Sequence
  derived and/or modified sequence opt5 from hemagglutinin__InfluenzaA__ADM13041
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccagaaugugcacccgauuacgaucggcaagugcccuaaguauguuaaaucuaccaagcugagacuugcuacagggcugcggaacgugcccagcauucagucccgcggacucuuuggcgccaucgccggguucauugaaggaggcuggaccgggauggucgacggaugguacggcuaucaucaccagaaugagcaaggcucuggguacgcugcggaccugaaaagcacacagaacgccaucgaugagaucaccaauaaggugaacuccguuauugaaaagaugaauacgcaguuuacagcugugggaaaggaguucaaccaccuugaaaagagaaucgagaaucugaacaaaaaggucgacgauggcuuccucgacauuuggaccuacaaugccgaacugcuggugcuccuggagaacgagcggacccuugauuaucaugacagcaaugucaaaaaccuguacgaaaaggugcgcucucagcucaaaaacaaugccaaggagaucgggaacggauguuuugaguucuaucacaagugcgauaauacauguauggaguccguuaaaaacggcaccuacgacuauccuaaguacagcgaagaggcuaaacugaauagagaggaaauugauggggugaaacuugagucuacacggaucuaucaaauccuggccauuuacuccacggucgcgagcucccucgugcugguugugucucugggcgcuaucagcuuuuggaugugcuccaacggaucucuccagugccgcauuuguaucuga

SEQ ID NO: 188581 - RNA, 1701 nt, Artificial Sequence
  derived and/or modified sequence opt5 from hemagglutinin__InfluenzaA__ADM13051
augaaggccauccuggugguccuccuguacaccuucgcuacaacgaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaaaaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacaagauuacgaauaaagucaacuccgugaucgagaagaugaauacacaguuuaccgccguuggaaaggaguucaaccaccuugagaaaagaauugagaaucugaacaagaaaguggaugacggcuuccucgauaucuggaccuacaaugcugaacugcugguccuccuggagaacgaacggacacuugacuaucaugauagcaaugugaagaaccuguacgagaaaguccgcucucagcucaagaacaaugccaaggagauugggaacggauguuuugaguucuaucacaaaugcgacaauaccuguauggaauccgugaagaacggcacauacgauuauccuaaauacagcgaagaggccaagcugaauagagaagagaucgacgggguuaaacuugagucuacgcggaucuaucaaauucuggcuaucuacuccaccguggccagcucccucguccuggugguuucucugggcgcgauuagcuuuuggaugugcuccaacggaucucuccagugccgcaucuguauuuga

SEQ ID NO: 188582 - RNA, 1701 nt, Artificial Sequence
  derived and/or modified sequence opt5 from hemagglutinin__InfluenzaA__ADM13061
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaaucgcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccaagagcuauaucaaugacaaggggaaagaaguucuugugcuguggggcauucaccaccccuccaccucugccgaucaacagagccucuaccagaacgcugacgccuacgucuucgugggaacauccagauauagcaagaaauuuaagccugagaucgcuauucggccgaaagugcgcgaucaggaggggagaaugaauuacuauuggacccuggucgaacccggagacaagaucacguucgaggccacaggcaaccugguugugccucgguacgcguuugccauggaacgcaacgcugggucuggaauuaucaucuccgauacccccgugcaugacugcaauacaagcugucaaaccccuaaaggcgccauuaacaccucucuccccuuccagaauauccacccgauuacaaucggcaagugcccuaaguaugucaaaagcacgaagcugagacuugcuaccgggcugcggaacgugcccuccauucagucucgcggacucuuuggcgccaucgccggguucaucgagggaggcuggacagggaugguugacggaugguacggcuaucaucaccagaaugaacaaggcagcggguacgcugcggaucugaaauccacccagaacgccauugacgagaucacaaauaaggugaacagcgucauugagaaaaugaauacccaguuuacggcugugggaaaggaguucaaccaccuugagaagagaaucgaaaaucugaacaaaaagguugaugacggcuuccucgauauuuggacauacaaugccgagcugcuggugcuccuggaaaacgagcggacccuugacuaucaugauucuaaugucaaaaaccuguacgagaaggugcgcucccagcucaaaaacaaugccaaggaaaucgggaacggauguuuugaguucuaucacaagugcgacaauaccuguauggaaagcgucaaaaacggcacauacgauuauccuaaguacucugaggaagcuaaacugaauagagaggagaucgacggggugaaacuugaauccacccggauuuaucaaauccuggccauuuacagcacaguugcguccucucucgugcuggucgugagccugggcgcuaucuccuuuuggaugugcucuaacggaagccuccagugccgcauuuguaucuga

SEQ ID NO: 188583 - RNA, 1701 nt, Artificial Sequence; identical to SEQ ID NO: 187860
  derived and/or modified sequence opt5 from hemagglutinin__InfluenzaA__ADM13071

SEQ ID NO: 188584 - RNA, 1701 nt, Artificial Sequence
  derived and/or modified sequence opt5 from hemagglutinin__InfluenzaA__ADM13081
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaaucgcuccccuccaucugggcaaaugcaacauugccggguggauccugggaaauccugagugugaaucucucagcacagccuccucuuggagcuacauuguugagaccuccggcucugacaacgggacgugcuauccgggagauuuuaucgacuacgaagaacugcgggagcagcuuagcuccgugagcucuuucgaacgcuuugagaucuuccccaagaccuccagcuggccuaaucacgauucuaacaagggcgucacagccgcuuguccccaugccggcgcgaaauccuuuuauaagaaucugauuuggcucgugaaaaaggggaacagcuacccuaaacugucuaaguccuauaucaaugacaaggaaaaagagguucuugugcuguggggcauucaccaccccagcaccuccgccgaucaacagucucucuaccagaacgcugacgccuacgucuucgugggaacaagcagauauuccaagaaauuuaagccugagaucgcuauucggccgaaagugcgcgaucaggaagggagaaugaauuacuauuggacccuggucgagcccggagacaagaucacguucgaagccacaggcaaccugguugugccucgguacgcguuugccauggagcgcaacgcugggagcggaauuaucaucucugauacccccgugcaugacugcaauacaaccugucaaaccccuaaaggcgccauuaacacaucccuccccuuccagaauauccacccgauuacgaucggcaagugcccuaaguaugucaaaagcaccaagcugagacuugcuacagggcugcggaacgugcccucuauucagagccgcggacucuuuggcgccaucgccggguucaucgaaggaggcuggaccgggaugguugacggaugguacggcuaucaucaccagaaugagcaaggcuccggguacgcugcggaucugaaaucuacacagaacgccauugacgagaucaccaauaaggugaacagcgucauugaaaagaugaauacgcaguuuacagcugugggaaaggaguucaaccaccuugaaaagagaaucgagaaucugaacaaaaagguugaugacggcuuccucgauauuuggaccuacaaugccgaacugcuggugcuccuggagaacgagcggacccuugacuaucaugauuccaaugucaaaaaccuguacgaaaaggugcgcagccagcucaaaaacaaugccaaggagaucgggaacggauguuuugaguucuaucacaagugcgacaauacauguauggagucugucaaaaacggcaccuacgauuauccuaaguacuccgaagaggcuaaacugaauagagaggaaaucgacggggugaaacuugagagcacacggauuuaucaaauccuggccauuuacucuacgguugcguccagccucgugcuggucgugucccugggcgcuaucucuuuuuggaugugcagcaacggaucccuccagugccgcauuuguaucuga

SEQ ID NO: 188585 - RNA, 1701 nt, Artificial Sequence; identical to SEQ ID NO: 187113
  derived and/or modified sequence opt5 from hemagglutinin__InfluenzaA__ADM13091

SEQ ID NO: 188586 - RNA, 1701 nt, Artificial Sequence; identical to SEQ ID NO: 186857
  derived and/or modified sequence opt5 from hemagglutinin__InfluenzaA__ADM13101

SEQ ID NO: 188587 - RNA, 1701 nt, Artificial Sequence
  derived and/or modified sequence opt5 from hemagglutinin__InfluenzaA__ADM13111
augaaggccauccuggugguccuccuguacaccuucgagacagcuaacgccgacacgcuuugcauuggcuaucacgcgaauaacagcaccgauacaguugacaccgugcuggaaaagaaugugacagucacccauuccgugaaccuccuggaggauaagcacaaugggaaacuuuguaagcugagaggaguugcuccccuccaucugggcaaaugcaacaucgccggguggauucugggaaauccugaaugugagucucucagcacagccuccucuuggagcuacaucguggaaaccuccucuagcgacaacggcacgugcuauccgggggauuuuauuaauuacgaggagcugcgggaacagcuuuccagcgucucuuccuucgagcgcuuugaaaucuuccccaagaccagcucuuggccuaaccacgacuccaauaagggagugacagcugccuguccccaugcuggcgccaagagcuuuuauaagaaccugaucuggcucguuaaaaagggcaauucuuacccuaaacuguccaagagcuauauuaacgauaaggggaaagaggugcuuguccuguggggaauccaccaccccuccaccucugcggaccaacagagccucuaccagaaugccgaugcuuacguguucgugggcacauccagauauagcaagaaauuuaagccugagauugccauccggccgaaaguccgcgaccaggaagggagaaugaacuacuauuggacccugguugaucccggagacaagauuacguucgaggcuacaggcaaccugguggugccucgguacgccuuugcgauggaacgcaaugccgggucuggaaucauuaucuccgauacccccguccaugacugcaacacaaccugucaaaccccuaauggcgcuaucaacacaagccuccccuuccagaauauucacccgaucacgauuggcaaaugcccuaaguaugugaagucuaccaaacugagacuugccacagggcugcggaacguucccagcauccagucccgcggacucuuuggcgcuauugccggguucaucgagggaggcuggaccgggaugguggacggaugguacggcuaucaucaccagaaugaacaaggcucuggguacgccgcugaucugaaaagcacacagaacgcgaucgacaaaauuaccaauaaggucaacuccgugaucgagaaaaugaauacgcaguuuacagccguuggaaaggaguucaaccaccuugaaaagagaauugagaaucugaacaaaaagguggaugacggcuuccucgauaucuggaccuacaaugcugaacugcugguccuccuggagaacgaacggacccuugacuaucaugauagcaacgugaaaaaucuguacgagaagguccgcucucagcucaaaaacaaugccaaggagauugggaacggauguuuugaguucuaucacaagugcgacaauacauguauggaauccgugaaaaacggcaccuacgauuauccuaaguacagcgaagaggccaaacugaauagagaagagaucgacgggguuaaacuugagucuacacggaucuaucaaauucuggcuaucuacuccacgguggccagcucccucguccuggugguuucucugggcgcgauuagcuuuuggaugugcuccaacggaucucuccagugccgcaucuguauuuga

SEQ ID NO: 188588 - RNA, 1701 nt, Artificial Sequence; identical to SEQ ID NO: 185693
  derived and/or modified sequence opt5 from hemagglutinin__InfluenzaA__ADM13121

SEQ ID NO: 188589 - RNA, 1701 nt, Artificial Sequence; identical to SEQ ID NO: 186857
  derived and/or modified sequence opt5 from hemagglutinin__InfluenzaA__ADM13131

SEQ ID NO: 188590 - RNA, 1701 nt, Artificial Sequence; identical to SEQ ID NO: 187021
  derived and/or modified sequence opt5 from hemagglutinin__InfluenzaA__ADM13141

SEQ ID NO: 188591 - RNA, 1701 nt, Artificial Sequence; identical to SEQ ID NO: 187021
  derived and/or modified sequence opt5 from hemagglutinin__InfluenzaA__ADM13151

SEQ ID NO: 188592 - RNA, 1701 nt, Artificial Sequence; identical to SEQ ID NO: 186794
  derived and/or modified sequence opt5 from hemagglutinin__InfluenzaA__ADM13161

SEQ ID NO: 188593 - RNA, 1701 nt, Artificial Sequence; identical to SEQ ID NO: 187342
  derived and/or modified sequence opt5 from hemagglutinin__InfluenzaA__ADM13171

SEQ ID NO: 188594 - RNA, 1701 nt, Artificial Sequence; identical to SEQ ID NO: 187342
  derived and/or modified sequence opt5 from hemagglutinin__InfluenzaA__ADM13181

SEQ ID NO: 188595 - RNA, 1701 nt, Artificial Sequence
  derived and/or modified sequence opt5 from hemagglutinin__InfluenzaA__ADM13191
augaaggccauccuggugguccuccuguacacccuugcuacagccaacgcggacacgcugugcauuggcuaucacgcuaauaacagcaccgauacaguugacaccgugcucgagaaaaaugugacagucacccauuccgugaaccugcuugaagauaagcacaaugggaaacuguguaagcucagaggaguugcuccccugcaucugggcaaaugcaacaucgccggguggauucucggaaauccugagugugaaucucugagcacagccuccucuuggagcuacaucguggagaccuccucuagcgacaacggcacgugcuauccgggggauuucauugacuacgaggaacuucgggagcagcuguccagcgucucuuccuuugaacgcuucgagaucuuucccaagaccagcucuuggccuaaucacgauuccaacaagggagugacagccgcuuguccccaugccggcgcgaaaucuuucuauaagaaucucaucuggcugguuaaaaagggcaacagcuacccuaaacuuuccaagagcuauauuaaugacaaggggaaagaagugcugguccucuggggaauccaccaccccuccaccucugccgaucaacagagccuguaccagaacgcugacgccuacguguuugugggcacauccagauauagcaagaaauucaagccugagauugcuauccggccgaaaguccgcgaucaggaggggagaaugaauuacuauuggacccugguugaacccggagacaagauuacguuugaggccacaggcaaccucguggugccucgguacgcguucgccauggaacgcaacgcugggucuggaaucauuaucuccgauacccccguccaugacugcaauacaaccugucaaaccccuaaaggcgccaucaacacaagccugcccuuucagaauauucacccgaucacgauuggcaagugcccuaaguaugugaaaucuaccaaacuuagacuggcuacagggcuccggaacguucccagcauccagucccgcggacuguucggcgccauugccggguuuaucgagggaggcuggaccgggaugguggacggaugguacggcuaucaucaccagaaugaacaaggcucuggguacgcugcggaucuuaagagcacacagcacgccaucgacgagauuaccaacaaggucaauuccgugaucgagaaaaugaacacgcaguucacagcuguuggaaaggaauuuaaucaucuggagaagagaauugaaaaccucaauaaaaagguggaugacggcuuccuggauaucuggaccuacaacgccgagcugcucguccugcuugaaaaugagcggacccuggacuaucacgauagcaacgugaaaaaucucuacgagaagguccgcucucagcugaaaaacaacgccaaggaaauugggaauggauguuucgaguuuuaucauaagugcgacaacacauguauggaauccgugaaaaauggcaccuacgauuauccuaaguacagcgaggaagcuaaacuuaacagagaggagaucgacgggguuaagcuggaaucuacacggaucuaucaaauucucgccaucuacuccacgguggcgagcucccugguccuggugguuucucucggcgcuauuagcuucuggaugugcuccaauggaucucugcagugccgcaucuguauuuga

SEQ ID NO: 188596 - RNA, 1701 nt, Artificial Sequence
  derived and/or modified sequence opt5 from hemagglutinin__InfluenzaA__ADM13211
augaaggccauccuggugguccuccuguacacccuugcuacagccaacgcggacacgcugugcauuggcuaucacgcuaauaacagcaccgauacaguugacaccgugcucgagaaaaaugugacagucacccauuccgugaaccugcuugaagauaagcacaaugggaaacuguguaagcucagaggaaucgcuccccugcaucugggcaaaugcaacauugccggguggauccucggaaauccugagugugaaucucugagcacagccuccucuuggagcuacauuguugagaccuccucuagcgacaacggcacgugcuauccgggggauuucaucgacuacgaggaacuucgggagcagcuguccagcgugucuuccuuugaacgcuucgagaucuuucccaagaccagcucuuggccuaaucacgauuccaacaagggagucacagccgcuuguccccaugccggcgcgaaaucuuucuauaagaaucucauuuggcuggugaaaaagggcaacagcuacccuaaacuuuccaagagcuauaucaaugacaaggggaaagaaguucuggugcucuggggcauucaccaccccuccaccucugccgaucaacagagccuguaccagaacgcugacgccuacgucuuugugggaacauccagauauagcaagaaauucaagccugagaucgcuauucggccgaaagugcgcgaucaggaggggagaaugaauuacuauuggacccuggucgaacccggagacaagaucacguuugaggccacaggcaaccucguugugccucgguacgcguucgccauggaacgcaacgcugggucuggaauuaucaucuccgauacccccgugcaugacugcaauacaaccugucaaaccccuaaaggcgccauuaacacaagccugcccuuucagaauauccacccgauuacgaucggcaagugcccuaaguaugucaaaucuaccaaacuuagacuggcuacagggcuccggaacgugcccagcauucagucccgcggacuguucggcgccaucgccggguuuaucgagggaggcuggaccgggaugguugacggaugguacggcuaucaucaccagaaugaacaaggcucuggguacgcugcggaucuuaagagcacacagaacgccauugacgagaucaccaauaaggugaacuccgucauugagaaaaugaauacgcaguucacagcugugggaaaggaauuuaaccaccuggagaagagaaucgaaaaucucaacaaaaagguugaugacggcuuccuggauauuuggaccuacaaugccgagcugcucgugcugcuugaaaacgagcggacccuggacuaucaugauagcaaugucaaaaaccucuacgagaaggugcgcucucagcugaaaaacaaugccaaggaaaucgggaacggauguuucgaguuuuaucacaagugcgacaauacauguauggaauccgucaaaaacggcaccuacgauuauccuaaguacagcgaggaagcuaaacuuaauagagaggagaucgacggggugaagcuggaaucuacacggauuuaucaaauccucgccauuuacuccacgguugcgagcucccuggugcuggucgugucucucggcgcuaucagcuucuggaugugcuccaacggaucucugcagugccgcauuuguaucuga

SEQ ID NO: 188597 - RNA, 1701 nt, Artificial Sequence; identical to SEQ ID NO: 188596
  derived and/or modified sequence opt5 from hemagglutinin__InfluenzaA__ADM13221

SEQ ID NO: 188598 - RNA, 1701 nt, Artificial Sequence
  derived and/or modified sequence opt5 from hemagglutinin__InfluenzaA__ADM13231
augaaggccauccuggugguccuccuguacaccuucgagacagcuaacgccgacacgcuuugcauuggcuaucacgcgaauaacagcaccgauacaguugacaccgugcuggaaaagaaugugacagucacccauuccgugaaccuccuggaggauaagcacaaugggaaacuuuguaagcugagaggaguugcuccccuccaucugggcaaaugcaacaucgccggguggauucugggaaauccugaaugugagucucucagcacagccuccucuuggagcuacaucguggaaaccuccucuagcgacaacggcacgugcuauccgggggauuuuauuaauuacgaggagcugcgggaacagcuuuccagcgucucuuccuucgagcgcuuugaaaucuuccccaagaccagcucuuggccuaaccacgacuccaauaagggagugacagcugccuguccccaugcuggcgccaagagcuuuuauaagaaccugaucuggcucguuaaaaagggcaauucuuacccuaaacuguccaagagcuauauuaacgauaaggggaaagaggugcuuguccuguggggaauccaccaccccuccaccucugcggaccaacagagccucuaccagaaugccgaugcuuacguguucgugggcacauccagauauagcaagaaauuuaagccugagauugccauccggccgaaaguccgcgaccaggaagggagaaugaacuacuauuggacccugguugagcccggagauaagauuacguucgaagcuacaggcaaccugguggugccucgguacgccuuugcgauggagcgcaaugccgggucuggaaucauuaucuccgacacccccguccaugauugcaacacaaccugucaaaccccuaauggcgcuaucaacacaagccuccccuuccagaauauucacccgaucacgauuggcaaaugcccuaaguaugugaagucuaccaaacugagacuugccacagggcugcggaacguucccagcauccagucccgcggacucuuuggcgcuauugccggguucaucgaaggaggcuggaccgggaugguggacggaugguacggcuaucaucaccagaaugagcaaggcucuggguacgccgcugaccugaaaagcacacagaacgcgaucgauaaaauuaccaauaaggucaacuccgugaucgagaaaaugaauacgcaguuuacagccguuggaaaggaguucaaccaccuugaaaagagaauugaaaaucugaacaaaaagguggacgauggcuuccucgacaucuggaccuacaaugcugagcugcugguccuccuggaaaacgagcggacccuugauuaucaugacagcaacgugaaaaaucuguacgagaagguccgcucucagcucaaaaacaaugccaaggaaauugggaacggauguuuugaguucuaucacaagugcgauaauacauguauggaauccgugaaaaacggcaccuacgacuauccuaaguacagcgaggaagccaaacugaauagagaggagaucgaugggguuaaacuugaaucuacacggaucuaucaaauucuggcuaucuacuccacgguggccagcucccucguccuggugguuucucugggcgcgauuagcuuuuggaugugcuccaacggaucucuccagugccgcaucuguauuuga

SEQ ID NO: 188599 - RNA, 1701 nt, Artificial Sequence; identical to SEQ ID NO: 186857
  derived and/or modified sequence opt5 from hemagglutinin__InfluenzaA__ADM13241

SEQ ID NO: 188600 - RNA, 1701 nt, Artificial Sequence
  derived and/or modified sequence opt5 from hemagglutinin__InfluenzaA__ADM13251
augaaggccauccuggugguccuccuguacaccuucgcuacaacgaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaaaaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcgaugccgggucuggaaucauuaucuccgacacacccguccaugacugcaacaccaccugucaaacaccuaaaggcgcuaucaauacgagccuccccuuccagaacauucacccgaucaccauuggcaagugcccuaaguaugugaaaucuacaaagcugagacuugccaccgggcugcggaauguucccagcauccagucccgcggacucuuuggcgcuauugccggguucaucgagggaggcuggacagggaugguggauggaugguacggcuaucaucaccagaacgaacaaggcucuggguacgccgcugaccugaaaagcacccagaaugcgaucgauaagauuacgaacaaagucaauuccgugaucgagaagaugaacacacaguuuaccgccguuggaaaggaguucaaucaccuugagaaaagaauugagaaccugaauaagaaaguggacgauggcuuccucgacaucuggaccuacaacgcugaacugcugguccuccuggagaaugaacggacacuugauuaucaugacagcaacgugaagaaucuguacgagaaaguccgcucucagcucaagaacaacgccaaggagauugggaauggauguuuugaguucuaucacaaaugcgauaacaccuguauggaauccgugaagaauggcacauacgacuauccuaaauacagcgaagaggccaagcugaacagagaagagaucgaugggguuaaacuugagucuacgcggaucuaucaaauucuggcuaucuacuccaccguggccagcucccucguccuggugguuucucugggcgcgauuagcuuuuggaugugcuccaauggaucucuccagugccgcaucuguauuuga

SEQ ID NO: 188601 - RNA, 1701 nt, Artificial Sequence
  derived and/or modified sequence opt5 from hemagglutinin__InfluenzaA__ADM13261
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaaucgcuccccuccaucugggcaaaugcaacauugccggguggauccugggaaauccugagugugaaucucucagcacagccuccucuuggagcuacauuguugagaccuccggcucugacaacgggacgugcuauccgggagauuuuaucgacuacgaagaacugcgggagcagcuuagcuccgugagcucuuucgaacgcuuugagaucuuccccaagaccuccagcuggccuaaucacgauucuaacaagggcgucacagccgcuuguccccaugccggcgcgaaauccuuuuauaagaaucugauuuggcucgugaaaaaggggaacagcuacccuaaacugucuaaguccuauaucaaugacaagggaaaagaaguucuugugcuguggggcauucaccaccccagcaccuccgccgaucaacagucucucuaccagaacgcugacgccuacgucuucguggggacaagcagauauuccaagaaauuuaagccugagaucgcuauucggccgaaagugcgcgaucaggagggaagaaugaauuacuauuggacccuggucgaacccggcgacaagaucacguucgaggccacagggaaccugguugugccucgguacgcguuugccauggaacgcaacgcuggaagcggcauuaucaucucugauacccccgugcaugacugcaauacaaccugucaaaccccuaaaggcgccauuaacacaucccuccccuuccagaauauccacccgauuacgaucgggaagugcccuaaguaugucaaaagcaccaagcugagacuugcuacaggacugcggaacgugcccucuauucagagccgcggccucuuuggggccaucgccggauucaucgagggcggguggaccggaaugguugacggcugguacggcuaucaucaccagaaugaacaaggguccggauacgcugcggaucugaaaucuacacagaacgccauugacgagaucaccaauaaggugaacagcgucauugagaaaaugaauacgcaguuuacagcugugggcaaggaguucaaccaccuugagaagagaaucgaaaaucugaacaaaaagguugaugacggguuccucgauauuuggaccuacaaugccgagcugcuggugcuccuggaaaacgagcggacccuugacuaucaugauuccaaugucaaaaaccuguacgagaaggugcgcagccagcucaaaaacaaugccaaggaaaucggaaacggcuguuuugaguucuaucacaagugcgacaauacauguauggaaucugucaaaaacgggaccuacgauuauccuaaguacuccgaggaagcuaaacugaauagagaggagaucgacggcgugaaacuugaaagcacacggauuuaucaaauccuggccauuuacucuacgguugcguccagccucgugcuggucgugucccugggagcuaucucuuuuuggaugugcagcaacggcucccuccagugccgcauuuguaucuga

SEQ ID NO: 188602 - RNA, 1701 nt, Artificial Sequence
  derived and/or modified sequence opt5 from hemagglutinin__InfluenzaA__ADM13271
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacaagauuaccaauaaagucaacuccgugaucgagaagaugaauacgcaguuuacagcuguuggaaaggaguucaaccaccuugagaaaagaauugagaaucugaacaagaaaguggaugacggcuuccucgauaucuggaccuacaaugccgaacugcugguccuccuggagaacgaacggacccuugacuaucaugauagcaaugugaagaaccuguacgagaaaguccgcucucagcucaagaacaaugccaaggagauugggaacggauguuuugaguucuaucacaaaugcgacaauacauguauggaauccgugaagaacggcaccuacgauuauccuaaauacagcgaagaggcuaagcugaauagagaagagaucgacgggguuaaacuugagucuacacggauccaucaaauucuggccaucuauuccacgguggcgagcucccucguccuggugguuucucugggcgcuauuagcuuuuggaugugcuccaacggaucucuccagugccgcaucuguauuuga

SEQ ID NO: 188603 - RNA, 1701 nt, Artificial Sequence; identical to SEQ ID NO: 188598
  derived and/or modified sequence opt5 from hemagglutinin__InfluenzaA__ADM13281

SEQ ID NO: 188604 - RNA, 1701 nt, Artificial Sequence; identical to SEQ ID NO: 186794
  derived and/or modified sequence opt5 from hemagglutinin__InfluenzaA__ADM13291

SEQ ID NO: 188605 - RNA, 1701 nt, Artificial Sequence
  derived and/or modified sequence opt5 from hemagglutinin__InfluenzaA__ADM13301
augaaggccauccuggugguccuccuguacaccuucgcuacagccaacgcggacacgcuuugcauuggcuaucacgcuaauaacagcaccgauacaguugacaccauccuggagaaaaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaaggaaaacagcuacccuaaacuguccaagagcuauaucaaugacaagggcaaagagguucuugugcugugggggauucaccaccccuccaccucugccgaucaacagagccucuaccagaacgucgacgcuuacguguucgugggaacauccagauauagcaagaaauuuaagccugagaucgccauucggccgaaaguccgcgaucaggaaggcagaaugaauuacuauuggacccugguugagcccggggacaagaucacguucgaagcuacaggaaaccugguggugccucgguacgccuuugcgauggagcgcaacgccggcucugggauuaucaucuccgauacccccguccaugacugcaauacaaccugucaaaccccuaaaggagcuauuaacacaagccuccccuuccagaauauccacccgauuacgaucggcaagugcccuaaguaugugaaaucuaccaagcugagacuugccacaggccugcggaacguucccagcauucagucccgcgggcucuuuggagcuaucgccggcuucaucgaagggggauggaccggcaugguggacgggugguacggauaucaucaccagaaugagcaaggcucuggcuacgccgcugaucugaaaagcacacagaacgcgauugacgagaucaccaauaaggucaacuccgugauugaaaagaugaauacgcaguuuacagccguugggaaggaguucaaccaccuugaaaagagaaucgagaaucugaacaaaaagguggaugacggauuccucgauauuuggaccuacaaugcugaacugcugguccuccuggagaacgagcggacccuugacuaucaugauagcaaugugaaaaaccuguacgaaaagguccgcucucagcucaaaaacaaugccaaggagaucggcaacggguguuuugaguucuaucacaagugcgacaauacauguauggaguccgugaaaaacggaaccuacgauuauccuaaguacagcgaagaggccaaacugaauagagaggaaaucgacggcguuaaacuugagucuacacggauuuaucaaauccuggcuauuuacuccacgguggccagcucccucguccuggugguuucucugggggcgaucagcuuuuggaugugcuccaacggcucucuccagugccgcauuuguaucuga

SEQ ID NO: 188606 - RNA, 1701 nt, Artificial Sequence
  derived and/or modified sequence opt5 from hemagglutinin__InfluenzaA__ADM13311
augaaggccauccuggugguccuccuguacaccuucgcuacagccaacgcggacacgcuuugcauuggcuaucacgcuaauaacagcaccgauacaguugacaccauccuggagaagaaugugacagugacccauuccgucaaccuccuggaaaauaagcacaacgggaaacuuuguaagcugagaggagugucuccccuccaucugggcaaaugcaauauugccggguggauccugggaaacccugagugugaaagccucuccacagccucuagcugguccuacauuguugagaccucuagcuccgauaauggcacgugcuauccgggggacuuuaucgauuacgaagaacugcgggagcagcuuagcucuguguccagcuucgaacgcuuugagaucuuccccaagaccucuuccuggccuaaccacgacagcaauaagggagucacagcugccuguccccaugcuggcgccaaaucuuuuuauaagaaccugauuuggcucgugaaaaagggcaauuccuacccuaaacugagcaaguccuauaucaacgauaaggggaaagaaguucuugugcuguggggcauucaccaccccucuaccagcgcggaccaacagucccucuaccagaaugccgaugcuuacgucuucgugggaacaagcagauauucuaagaaauuuaagccugagaucgccauucggccgaaagugcgcgaccaggaggggagaaugaacuacuauuggacccuggucgaacccggagauaagaucacguucgaggcuacaggcaaccugguugugccucgguacgccuuugcgauggaacgcaaugccggguccggaauuaucaucagcgacacccccgugcaugauugcaacacaaccugucaaaccccuaaaggcgcuauuaauacaucucuccccuuccagaacauccacccgauuacgaucggcaagugcccuaaguaugucaaaagcaccaagcugagacuugccacagggcugcggaaugugcccuccauucagucucgcggacucuuuggcgcuaucgccggguucaucgagggaggcuggaccgggaugguugacggaugguacggcuaucaucaccagaacgaacaaggcagcggguacgccgcugaccugaaauccacacagaaugcgauugaugagaucaccaacaaggugaauagcgucauugagaaaaugaacacgcaguuuacagccgugggaaaggaguucaaucaccuugagaagagaaucgaaaaccugaauaaaaagguugacgauggcuuccucgacauuuggaccuacaacgcugagcugcuggugcuccuggaaaaugagcggacccuugauuaucaugacucuaacgucaaaaaccuguacgagaaggugcgcucccagcucaaaaauaacgccaaggaaaucgggaauggauguuuugaguucuaucacaagugcgauaacacauguauggaaagcgucaaaaauggcaccuacgacuauccuaaguacucugaggaagccaaacugaacagagaggagaucgauggggugaaacuugaauccacacggauuuaucaaauccuggcuauuuacagcacggccgcguccucucucguucugguggucagccugggcgcuaucuccuuuuggaugugcucuaauggaagccuccagugccgcauuuguaucuga

SEQ ID NO: 188607 - RNA, 1701 nt, Artificial Sequence; identical to SEQ ID NO: 186857
  derived and/or modified sequence opt5 from hemagglutinin__InfluenzaA__ADM13321

SEQ ID NO: 188608 - RNA, 1701 nt, Artificial Sequence
  derived and/or modified sequence opt5 from hemagglutinin__InfluenzaA__ADM13331
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccugaucacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaucugguggugccucgguacgcguuugccauggaacgcaacgcugggucuggaaucauuaucuccgacacccccguccaugacugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggauggaugguacggcuaucaucaccagaacgaacaaggcucuggguacgcugcggaccugaaaagcacacagaaugccaucgauaagauuaccaacaaagucaauuccgugaucgagaagaugaacacgcaguuuacagcuguuggaaaggaguucaaucaccuugagaaaagaauugagaaccugaauaagaaaguggacgauggcuuccucgacaucuggaccuacaacgccgaacugcugguccuccuggagaaugaacggacccuugauuaucaugacagcaacgugaagaaucuguacgagaaaguccgcucucagcucaagaacaacgccaaggagauugggaauggauguuuugaguucuaucacaaaugcgauaacacauguauggaauccgugaagaauggcaccuacgacuauccuaaauacagcgaagaggcuaagcugaacagagaagagaucgaugggguuaaacuugagucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 188609 - RNA, 1701 nt, Artificial Sequence; identical to SEQ ID NO: 187306
  derived and/or modified sequence opt5 from hemagglutinin__InfluenzaA__ADM13341

SEQ ID NO: 188610 - RNA, 1701 nt, Artificial Sequence; identical to SEQ ID NO: 188272
  derived and/or modified sequence opt5 from hemagglutinin__InfluenzaA__ADM13351

SEQ ID NO: 188611 - RNA, 1701 nt, Artificial Sequence; identical to SEQ ID NO: 185353
  derived and/or modified sequence opt5 from hemagglutinin__InfluenzaA__ADM13442

SEQ ID NO: 188612 - RNA, 1701 nt, Artificial Sequence; identical to SEQ ID NO: 185353
  derived and/or modified sequence opt5 from hemagglutinin__InfluenzaA__ADM13443

SEQ ID NO: 188613 - RNA, 1701 nt, Artificial Sequence; identical to SEQ ID NO: 185353
  derived and/or modified sequence opt5 from hemagglutinin__InfluenzaA__ADM13444

SEQ ID NO: 188614 - RNA, 1701 nt, Artificial Sequence; identical to SEQ ID NO: 186300
  derived and/or modified sequence opt5 from hemagglutinin__InfluenzaA__ADM13445

SEQ ID NO: 188615 - RNA, 1701 nt, Artificial Sequence; identical to SEQ ID NO: 185353
  derived and/or modified sequence opt5 from hemagglutinin__InfluenzaA__ADM13446

SEQ ID NO: 188616 - RNA, 1701 nt, Artificial Sequence
  derived and/or modified sequence opt5 from hemagglutinin__InfluenzaA__ADM13447
augaagaccaucauugcccugagcuacaucuucugccucgcucugggccaggaccuucccgggaacgauaauuccacagccacgcugugucucggacaccaugcggugccuaacggcacccuggucaaaacaauuaccgacgaucaaaucgagguuacaaaugcuaccgaacuugugcagucuagcuccacagggaagauuugcaacaauccgcacagaauccuggacggaaucgauuguacccucauugacgcccugcugggcgauccccauugcgacguguuucagaacgagacgugggaucucuucgucgaacggucuaaagccuuuagcaauuguuauccuuacgacgugcccgauuaugcuucccugcgcucucuuguugccagcuccgggacccuggaguucaucacagaaggauuuaccuggacaggcgugacccagaacggcgggagcaaugcuugcaagagaggaccuggcucuggguucuuuucccggcucaacuggcugacgaaaagcggaucuacauacuccguccuuaaugugaccaugcccaacaaugacaacuucgauaagcuguauauuuggggcguucaccauccuagcacaaaucaagagcagaccucucucuacgugcaggccuccgggcgcgucaccgugagcacaagacggucccagcaaacgaucauuccgaacaucggaucucgccccugggugagaggccugagcucccggauuagcaucuauuggaccaucgucaagccuggcgacguucuggugauuaacucuaaugggaaccucaucgcgccccgcggauacuuuaaaaugagaacaggcaaguccagcauuaugcggucugacgccccuaucgauaccuguauuagcgagugcaucacacccaauggguccaucccgaacgacaaaccuuuccagaaugugaacaagauuaccuacggagcuugucccaaauaugucaagcagaauacgcugaaacuugccacaggcaugcgcaacgugccugaaaagcagaccagagggcuguuuggagcuaucgccggcuucauugagaauggcugggaagggaugaucgauggaugguacggcuuucggcaccaaaacucugaggggaccggacaggcggccgaccucaagagcacacaggcugccauugaucaaaucaauggcaaacugaaccgcguuaucgagaagaccaaugaaaaauuccaccagauugagaaggaguucuccgaaguggaagggagaauccaggaccuugagaaauaugucgaggauacaaagauugaccuguggagcuacaacgcugaacuccugguggcccuggagaaucagcauacgaucgaucucaccgacucugaaaugaacaagcuguuugagaaaacacggagacaacuucgcgaaaacgccgaggauaugggcaauggaugcuucaagauuuaucacaaaugugacaacgcuugcaucgaguccauucggaauggcaccuacgaccaugauguuuauagagacgaagcgcugaacaaucgcuuucagaucaaggggguggagcucaaaagcggauacaaggauuggauccuguggauuucuuucgccaucuccugcuuucuucugugugucgugcuccugggcuucauuaugugggcuugccagcgggggaacaucagauguaauauuugcaucuga

SEQ ID NO: 188617 - RNA, 1701 nt, Artificial Sequence; identical to SEQ ID NO: 185423
  derived and/or modified sequence opt5 from hemagglutinin__InfluenzaA__ADM13448

SEQ ID NO: 188618 - RNA, 1701 nt, Artificial Sequence
  derived and/or modified sequence opt5 from hemagglutinin__InfluenzaA__ADM13449
augaagaccaucauugcccugagcuacaucuucugccucgcuuuuggccaggaccugcccgggaacgauaauuccacagccacgcuuugucugggacaccaugcggugccuaacggcacccucgucaaaacaauuaccgacgaucaaaucgagguuacaaaugcuaccgaacuggugcagucuagcuccacagggaagauuugcaacaauccgcacagaauccuugacggaaucgauuguacccugauugacgcccuccugggcgauccccauugcgacguguuccagaacgagacgugggaucuguuugucgaacggucuaaagccuucagcaauuguuauccuuacgacgugcccgauuaugcuucccuccgcucucugguugccagcuccgggacccuugaguuuaucacagaaggauucaccuggacaggcgugacccagaacggcgggagcaaugcuugcaagagaggaccuggcucuggguuuuucucccggcugaacuggcucacgaaaagcggaucuacauaccccguccugaaugugaccaugccuaacaaugacaacuuugauaaacuuuauauuuggggcguucaccauccguccacaaaucaagagcagaccagccuguacgugcaggccucugggcgcgucaccguguccacaagacggagccagcaaacgaucauucccaacaucgagucccgcccuugggugagaggacucucuagccggauuuccaucuauuggaccaucgucaaccccggcgacguucuggugauuaauagcaacggcaaucugaucgcgccucgcggguacuucaagaugagaacaggaaaaucuuccauuaugcggagcgacgcccccaucgauaccuguauuucugaaugcaucacaccgaacggcagcaucccuaaugacaagcccuuucagaacgugaauaaaauuaccuacggggcuuguccuaaguaugucaaacagaacacgcucaagcuggccacaggaaugcgcaaugugcccgagaagcagaccagaggccuuuucggggcuaucgccggauuuauugaaaacggcugggagggcaugaucgaugggugguacggauuccggcaccaaaauuccgagggcaccgggcaggcggccgaccugaaaucuacacaggcugccauugaucaaaucaacggaaagcucaaucgcguuaucgaaaagaccaacgagaaguuccaccagauugaaaaagaguuuagcgaaguggagggcagaauccaggaccuggagaaguaugucgaagauacaaaaauugaccuuugguccuacaaugcugagcugcucguggcccuggaaaaccagcauacgaucgaucugaccgacagcgagaugaacaaacucuucgaaaagacacggagacaacugcgcgagaaugccgaggauauggggaacggcugcuuuaagauuuaucacaagugugacaaugcuugcaucgaaucuauucggaacggaaccuacgaccaugauguuuauagagacgaggcgcuuaauaaccgcuuccagaucaaaggcguggaacugaaguccggguacaaagauuggauccucuggauuagcuuugccaucucuugcuuccugcuuugugucgugcugcucggauuuauuaugugggcuugccagcggggcaauaucagauguaacauuugcaucuga

SEQ ID NO: 188619 - RNA, 1701 nt, Artificial Sequence; identical to SEQ ID NO: 185455
  derived and/or modified sequence opt5 from hemagglutinin__InfluenzaA__ADM13450

SEQ ID NO: 188620 - RNA, 1701 nt, Artificial Sequence
  derived and/or modified sequence opt5 from hemagglutinin__InfluenzaA__ADM13451
augaagaccaucauugcccugagcuacaucuucugccucgcucugggccaggaccuucccgggaacgauaauagaacagccacgcugugucucggacaccaugcggugccuaacggcacccuggucaaaacaauuaccgacgaucaaaucgagguuacaaaugcuaccgaacuugugcaguccucuagcacagggaagauuugcaacaauccgcaccggauccuggacggaaucgauuguacccucauugacgcccugcugggcgauccccauugcgacguguuucagaacgagacgugggaucucuucgucgaacgcuccaaagccuuuucuaauuguuauccuuacgacgugcccgauuaugcuagccugagaucccuuguugccucuagcgggacccuggaguucaucacagaaggauuuaccuggacaggcgugacccagaacggcggguccaaugcuugcaagcggggaccuggcagcggguucuuuucucgccucaacuggcugacgaaauccggaagcacauaccccguccuuaaugugaccaugccuaacaaugacaacuucgauaagcuguauauuuggggcguucaccauccgucuacaaaucaagagcagaccucccucuacgugcaggccagcgggagagucaccgugucuacacggcgcucccagcaaacgaucauucccaacaucggaagcagaccuugggugcggggccuguccucucgcauuagcaucuauuggaccaucgucaagcccggcgacguucuggugauuaacuccaaugggaaccucaucgcgccuagaggauacuuuaaaaugcggacaggcaagagcucuauuaugcgcuccgacgcccccaucgauaccuguauuagcgagugcaucacaccgaaugggucuaucccuaacgacaaacccuuccagaaugugaacaagauuaccuacggagcuuguccuaaauaugucaagcagaauacgcugaaacuugccacaggcaugagaaacgugcccgaaaagcagacccgggggcuguuuggagcuaucgccggcuucauugagaauggcugggaagggaugaucgauggaugguacggcuuucgccaccaaaacagcgaggggaccggacaggcggccgaccucaaguccacacaggcuaccauugaucaaaucaauggcaaacugaacagaguuaucgagaagacaaaugaaaaauuccaccagauugagaaggaguucucugaaguggaagggcggauccaggaccuugagaaauaugucgaggauacgaagauugaccuguggagcuacaacgccgaacuccugguggcucuggagaaucagcauaccaucgaucucacagacuccgaaaugaacaagcuguuugagaaaaccagacgccaacuucgggaaaacgccgaggauaugggcaauggaugcuucaagauuuaucacaaaugugacaacgccugcaucgagagcauuagaaauggcacauacgaccaugauguuuaucgcgacgaagcucugaacaaucgguuucagaucaaggggguggagcucaaaucuggauacaaggauuggauccuguggauuuccuucgcgaucagcugcuuucuucugugugucgugcuccugggcuucauuaugugggccugccagagagggaacauccgcuguaauauuugcaucuga

SEQ ID NO: 188621 - RNA, 1701 nt, Artificial Sequence; identical to SEQ ID NO: 185340
  derived and/or modified sequence opt5 from hemagglutinin__InfluenzaA__ADM13452

SEQ ID NO: 188622 - RNA, 1701 nt, Artificial Sequence
  derived and/or modified sequence opt5 from hemagglutinin__InfluenzaA__ADM14467
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguagccaugccggcgcgaaaucuuuuuauaagaaucugaucuggcucguuaaaaagggcaacuccuaccccaaacugagcaaguccuauauuaaugacaaggggaaagaagugcuuguccuguggggaauccaccacccuucuaccagcgccgaucaacagucccucuaccagaacgcugacgccuacguguucgugggcacaagcagauauucuaagaaauuuaagcccgagauugcuauccggccuaaaguccgcgaucaggaggggagaaugaauuacuauuggacccugguugaaccgggagacaagauuacguucgaggccacaggcaaccugguggugccccgguacgcguuugccauggaacgcaacgcuggguccggaaucauuaucagcgauaccccuguccaugacugcaauacaaccugucaaacccccaaaggcgccaucaacacaucucucccuuuccagagcauucaccccaucacgauuggcaagugcccgaaguaugugaaauccaccaagcugagacuugcuacagggcugcggaauguuccuucuauccagagccgcggacucuuuggcgccauugccggguucaucgagggaggcuggaccgggaugguggacggaugguacggcuaucaucaccagaacgaacaaggcuccggguacgcugcggaucugaaaagcacacagaaugccaucgacaagauuaccaacaaagucaauucugugaucgagaagaugaacacgcaguuuacagcuguuggaaaggaguucaaucaccuugagaaaagaauugagaaccugaauaagaaaguggaugacggcuuccucgauaucuggaccuacaacgccgaacugcugguccuccuggagaaugaacggacccuugacuaucaugauuccaacgugaagaaucuguacgagaaaguccgcagccagcucaagaacaacgccaaggagauugggaauggauguuuugaguucuaucacaaaugcgacaacacauguauggaaucugugaagaauggcaccuacgauuaucccaaauacuccgaagaggcuaagcugaacagagaagagaucgacgggguuaaacuugagagcacacggaucuaucaaauucuggccaucuacuccacgguggcgucuagccucguccuggugguuucccugggcgcuauuucuuuuuggaugugcagcaauggaucccuccagugccgcaucuguauuuga

SEQ ID NO: 188623 - RNA, 1695 nt, Artificial Sequence
  derived and/or modified sequence opt5 from hemagglutinin__InfluenzaA__ADM14516
augaaggccauccuggugguccuccuguacaccuucgcuacagccaacgcggacacgcuuugcauuggcuaucacgcuaauaacagcaccgauacaguuaauaccgugcuggagaagaacgugacagucacccauuccgugaaucuccuggaagacaagcacaacgggaaacuuuguaagcugagaggaguugcuccccuccaucugggcaaaugcaauaucgccggguggauucugggaaacccugagugugaaucucucagcacagccuccucuuggagcuacaucguggagaccuccucuagcgauaauggcacgugcuauccgggggacuuuauugauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucuacagaccaacagagccucuaccagaaugccgaugcuuacguguucgugggcaccuccagauauagcaagaaauuuaagccugagauugccauccggccgaaaguccgcgaccaggaggggagaaugaacuacuauuggacgcugguugaacccggagauaagauuacauucgaggcuaccggcaaccugguggugccucgguacgccuuugcgauggaacgcaaugccgggucuggaaucauuaucuccgacacacccguccaugauugcaacaccaccugucaaacaccuaaaggcgcuaucaauacgagccuccccuuccagaacauucacccgaucaccauuggcaagugcccuaaguaugugaaaucuacaaagcugagacuugccaccgggcugcggaauguucccagcauccagucccgcggacucuuuggcgcuauugccggguucaucgagggaggcuggacagggaugguggacggaugguacggcuaucaucaccagaacgaacaaggcucuggguacgccgcugaccugaaaagcacccagaaugcgaucgaugagauuacgaacaaggucaauuccgugaucgagaaaaugaacacacaguuuaccgccguuggaaaggaguucaaucaccuugagaagagaauugaaaaccugaauaaaaagguggacgauggcuuccucgacaucuggaccuacaacgcugagcugcugguccuccuggaaaaugagcggacacuugauuaucaugacagcaacgugaaaaaccuguacgagaagguccgcucucagcucaaaaauaacgccaaggaaauugggaauggauguuuugaguucuaucacaagugcgauaacaccuguauggaauccgugaaaaauggcacauacgacuauccuaaguacagcgaggaagccaaacugaacagagaggagaucgaugggguuaaacuugaaucuacgcggaucuaucaaauucuggcuaucuacuccaccguggccagcucccucguccuggugguuucucugggcgcgauuagcuuuuggaugugcuccggacauucuugccgcaucuguauuuga

SEQ ID NO: 188624 - RNA, 1701 nt, Artificial Sequence
  derived and/or modified sequence opt5 from hemagglutinin__InfluenzaA__ADM14525
augaaggccacccuggugguccuccuguacacauucgcuacggccaacgcggacacccuuugcaucggcuaucacgcuaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacguccucuagcgacaacggaaccugcuauccgggggauuuuaucgacuacgaagaacugcgggagcagcuuuccagccugucuuccuucgaacgcuuugagauuuuccccaagacaagcucuuggccuaaucacgauuccaacaagggagucaccgccgcuuguccccaugccggcgcgaaaucuuuuuauaagaaucucaucuggcuggugaaaaagggcaacagcuacccuaaacuuuccaagagcuauaucaaugacaaggggaaagauguucuggugcucuggggcauucaccaccccuccacaucugccgaccaacagagccuguaccagaacgcugaugccuacgucuucgugggcaccuccagauauagcaagaaauuuaagccugaaaucgcuauucggccgaaagugcgcgaccaggaggggagaaugaauuacuauuggacgcuggucgagcccggagauaagaucacauucgaagccaccggcaaccucguugugccucgguacgcguuugccauggagcgcaacgcugggucuggaauuaucauuuccgacacacccgugcaugacugcaauaccaccugucaaacaccuaaaggcgccaucaacacgagccugcccuuccagaauauccacccgauuaccaucggcaagugcccuaaguaugucaaaucuacaaaacuuagacuggcuaccgggcuccggaacgugcccagcauucagucccgcggacuguuuggcgccaucgccggguucauugaaggaggcuggacagggaugguugauggaugguacggcuaucaucaccagaaugagcaaggcucuggguacgcugcggaccuuaagagcacccagaacgccaucgaugaaaucacgaauaaggugaacuccgucauugagaaaaugaauacacaguuuaccgcugugggaaaggaguucaaccaccuggaaaagagaaucgagaaucucaacaaaaagguugacgauggcuuccuggacauuuggaccuacaaugccgaacugcucgugcugcuugagaacgaacggacacuggauuaucaugacagcaaugucaaaaaccucuacgagaaggugcgcucucagcugaaaaacaaugccaaggagaucgggaacggauguuuugaguucuaucacaagugcgauaauaccuguauggaguccgucaaaaacggcacauacgacuauccuaaguacagcgaagaggcuaaacuuaauagagaagagauugauggggugaagcuggagucuacgcggaucuaucaaauccucgccauuuacuccaccguugcgagcucccuggugcuggucgugucucucggcgcuaucagcuuuuggaugugcuccaacggaucucugcagugccgcauuuguaucuga

SEQ ID NO: 188625 - RNA, 1695 nt, Artificial Sequence
  derived and/or modified sequence opt5 from hemagglutinin__InfluenzaA__ADM14553
augaaggccauccuggugguccuccuguacaccuucgcuacagccaacgcggacacgcuuugcauuggcuaucacgcuaauaacagcaccgauacaguugacaccauccuggagaaaaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccaagagcuauaucaaugacaaggggaaagaaguucuugugcuguggggcauucaccaccccuccaccucugccgaucaacagagccucuaccagaacgcugacgccuacgucuucguggagacauccagauauagcaagaaauuuaagccugagaucgcuauucggccgaaagugcgcgaucaggaaggaagaaugaauuacuauuggacccuggucgagcccggggacaagaucacguucgaagccacaggaaaccugguugugccucgguacgcguuugccauggagcgcaacgcuggcucugggauuaucaucuccgauaccagcgugcaugacugcaauacaaccugucaaacccccaaaggagccauuaacacaucucucccuuuccagaauauccaccccauuacgaucggcaagugcccgaaguaugucaaaagcaccaagcugagacuugcuacaggccugcggaacgugccuuccauucagucucgcgggcucuuuggagccaucgccggcuucaucgaagggggauggaccggcaugguugacgggugguacggauaucaucaccagaaugagcaaggcagcggcuacgcugcggaucugaaauccacacagaacgccauugacgagaucaccaauaaggugaacagcgucauugaaaagaugaauacgcaguuuacagcuguggggaaggaguucaaccaccuugaaaagagaaucgagaaucugaacaaaaagguugaugacggauuccucgauauuuggaccuacaaugccgaacugcuggugcuccuggagaacgagcggacccuugacuaucaugauucuaaugucaaaaaccuguacgaaaaggugcgcucccagcucaaaaacaaugccaaggagaucggcaacggguguuuugaguucuaucacaagugcgacaauacauguauggagagcgucaaaaacggaaccuacgauuaucccaaguacucugaagaggcuaaacugaauagagaggaaaucgacggcgugaaacuugaguccacacggauuuaucaaauccuggccauuuacagcacgguugcguccucucucgugcuggucgugagccugggggcuaucuccuuuuggaugugcucuggccauagcugccgcauuuguaucuga

SEQ ID NO: 188626 - RNA, 1701 nt, Artificial Sequence; identical to SEQ ID NO: 186140
  derived and/or modified sequence opt5 from hemagglutinin__InfluenzaA__ADM14562

SEQ ID NO: 188627 - RNA, 1701 nt, Artificial Sequence; identical to SEQ ID NO: 185693
  derived and/or modified sequence opt5 from hemagglutinin__InfluenzaA__ADM14571

SEQ ID NO: 188628 - RNA, 1701 nt, Artificial Sequence
  derived and/or modified sequence opt5 from hemagglutinin__InfluenzaA__ADM14580
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaaaagaacgcugggucuggaaucauuaucuccgauacccccguccaugacugcaauacaaccugucaaaccccuaagggcgccaucaacacaagccuccccuuccagaauauucacccgaucacgauuggcaagugcccuaaauaugugaagucuaccaaacugcgccuugcuacagggcugagaaacguucccagcauccagucccggggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaagucaacuccgugaucgagaagaugaauacgcaguuuacagcuguuggaaaggaguucaaccaccuugagaaacgcauugaaaaucugaacaagaaaguggaugacggcuuccucgauaucuggaccuacaaugccgagcugcugguccuccuggaaaacgagagaacccuugacuaucaugauagcaaugugaagaaccuguacgagaaaguccggucucagcucaagaacaaugccaaggaaauugggaacggauguuuugaguucuaucacaaaugcgacaauacauguauggaauccgugaagaacggcaccuacgauuauccuaaauacagcgaggaagcuaagcugaaucgcgaggagaucaacgggguuaaacuugaaucuacaagaaucuaucaaauucuggccaucuacuccacgguggcgagcucccucguccuggugguuucucugggcgcuauuagcuuuuggaugugcuccaauggaucucuccagugccggaucuguauuuga

SEQ ID NO: 188629 - RNA, 1701 nt, Artificial Sequence
  derived and/or modified sequence opt5 from hemagglutinin__InfluenzaA__ADM14589
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaaaagaacgcugggucuggaaucauuaucuccgauacccccguccaugacugcaauacaaccugucaaaccccuaagggcgccaucaacacaagccuccccuuccagaauauucacccgaucacgauuggcaagugcccuaaauaugugaagucuaccaaacugcgccuugcuacagggcugagaaacguucccagcauccagucccggggacucuuuggcgccauugccggguucaucgagggaggcuggaccgggaugguggacggaugguacggcuaucaucaccagaauggccaagggucuggauacgcugcggaucugaaaagcacacagaacgccaucgacgaaauuaccaauaaagucaacuccgugaucgagaagaugaauacgcaguuuacagcuguuggcaaggaguucaaccaccuugaaaaacgcauugagaaucugaacaagaaaguggaugacggguuccucgauaucuggaccuacaaugccgaacugcugguccuccuggagaacgaaagaacccuugacuaucaugauagcaaugugaagaaccuguacgagaaaguccggucucagcucaagaacaaugccaaggagauuggaaacggcuguuuugaguucuaucacaaaugcgacaauacauguauggaguccgugaagaacgggaccuacgauuauccuaaauacagcgaagaggcuaagcugaaucgcgaagagaucaacggcguuaaacuugagucuacaagaaucuaucaaauucuggccaucuacuccacgguggcgagcucccucguccuggugguuucucugggagcuauuagcuuuuggaugugcuccaauggcucucuccagugccggaucuguauuuga

SEQ ID NO: 188630 - RNA, 1701 nt, Artificial Sequence
  derived and/or modified sequence opt5 from hemagglutinin__InfluenzaA__ADM14599
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugucauccggccgaaaguucgcgaucaggaggggagaaugaauuacuauuggacccugguggaacccggagacaagauuacguucgaggcuacaggcaaccugguggucccucgguacgccuuugcgauggaacgcaacgccgggucuggaaucauuaucuccgauacccccgugcaugacugcaauacaaccugucaaaccccuaaaggcgcuaucaacacaagccuccccuuccagaauauucacccgaucacgauuggcaagugcccuaaguauguuaaaucuaccaagcugagacuugccacagggcugcggaacgugcccagcauccagucccgcggacucuuuggcgcuauugccggguucaucgagggaggcuggaccgggauggucgacggaugguacggcuaucaucaccagaaugaacaaggcucuggguacgccgcugaucugaaaagcacacagaacgcgaucgacgagauuaccaauaaggugaacuccguuaucgagaaaaugaauacgcaguuuacagccgugggaaaggaguucaaccaccuugagaagagaauugaaaaucugaacaaaaaggucgaugacggcuuccucgauaucuggaccuacaaugcugagcugcuggugcuccuggaaaacgagcggacccuugacuaucaugauagcaaugucaaaaaccuguacgagaaggugcgcucucagcucaaaaacaaugccaaggaaauugggaacggauguuuugaguucuaucacaagugcgacaauacauguauggaauccguuaaaaacggcaccuacgauuauccuaaguacagcgaggaagccaaacugaauagagaggagaucgacggggugaaacuugaaucuacacggaucuaucaaauucuggcuaucuacuccacggucgccagcucccucgugcugguugugucucugggcgcgauuagcuuuuggaugugcuccaacggaucucuccagugccgcaucuguauuuga

SEQ ID NO: 188631 - RNA, 1701 nt, Artificial Sequence; identical to SEQ ID NO: 186853
  derived and/or modified sequence opt5 from hemagglutinin__InfluenzaA__ADM14609

SEQ ID NO: 188632 - RNA, 1701 nt, Artificial Sequence
  derived and/or modified sequence opt5 from hemagglutinin__InfluenzaA__ADM14618
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauaaccacccgauuacgaucggcaagugcccuaaguaugugaaaucuaccaagcugagacuugcuacagggcugcggaauguucccagcauucagucccgcggacucuuuggcgccaucgccggguucauugagggaggcuggaccgggaugguggacggaugguacggcuaucaucaccagaacgaacaaggcucuggguacgcugcggaucugaaaagcacacagaaugccaucgacgagaucaccaacaaggucaauuccgugauugagaaaaugaacacgcaguuuacagcuguuggaaaggaguucaaucaccuugagaagagaaucgaaaaccugaauaaaaagguggaugacggcuuccucgauauuuggaccuacaacgccgagcugcugguccuccuggaaaaugagcggacccuugacuaucaugauagcaacgugaaaaaccuguacgagaagguccgcucucagcucaaaaauaacgccaaggaaaucgggaauggauguuuugaguucuaucacaagugcgacaacacauguauggaauccgugaaaaauggcaccuacgauuauccuaaguacagcgaggaagcuaaacugaacagagaggagauugacgggguuaaacuugaaucuacacggaucuaucaaauccuggccauuuacuccacgguggcgagcucccucguccuggugguuucucugggcgcuaucagcuuuuggaugugcuccaauggaucucuccagugccgcauuuguaucuga

SEQ ID NO: 188633 - RNA, 1701 nt, Artificial Sequence; identical to SEQ ID NO: 185693
  derived and/or modified sequence opt5 from hemagglutinin__InfluenzaA__ADM14627

SEQ ID NO: 188634 - RNA, 1701 nt, Artificial Sequence
  derived and/or modified sequence opt5 from hemagglutinin__InfluenzaA__ADM14655
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugagaucuaccaaacugcggcuugcuacagggcugcgcaacguucccagcauccaguccagaggacucuuuggcgccauugccggguucaucgagggaggcuggaccgggaugguggacggaugguacggcuaucaucaccagaaugaacaaggcucuggguacgcugcggaucuuaagagcacacagaacgccaucgacgagauuaccaauaaagucaacuccgugaucgagaagaugaauacgcaguuuacagcuguuggaaaagaguucaaccaccuggagaagcggauugaaaaucugaacaagaaaguggaugacggcuuccucgauaucuggaccuacaaugccgagcugcugguccuccuggaaaacgagcgcacccuugacuaucaugauagcaaugugaagaaccuguacgagaaagucagaucucagcucaagaacaaugccaaagaaauugggaacggauguuuugaguucuaucacaagugcgacaauacauguauggaauccgugaagaacggcaccuacgauuauccuaaauacagcgaggaagcuaagcugaaucgggaggagaucgacgggguuaaacuugaaucuacacgcaucuaucaaauucuggccaucuacuccacgguggcgagcucccucguccuggugguuucucugggcgcuauuagcuuuuggaugugcuccaacggaucucuccagugcagaaucuguauuuga

SEQ ID NO: 188635 - RNA, 1701 nt, Artificial Sequence
  derived and/or modified sequence opt5 from hemagglutinin__InfluenzaA__ADM14664
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaauccuuuuauaagaaucugaucuggcucguuaaaaagggcaacucuuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaacggcgccaucaauacaagccuccccuuccagaacauucacccgaucacgauuggcaaaugcccuaaguaugugaagucuaccaaacugagacuugcuacagggcugcggaauauccccagcauucagucccgcggacucuuuggcgccaucgccggguucaucgagggaggcuggaccgggaugguugacggaugguacggcuaucaucaccagaacgaacaaggcucuggguacgcugcggaucuuaagagcacacagaaugccauugacgagaucaccaacaaagugaauagcgucauugagaagaugaacacgcaguuuacagcugugggaaaagaguucaaucaccuggagaagagaaucgaaaaccugaauaagaaaguugaugacggcuuccucgauauuuggaccuacaacgccgagcugcuggugcuccuggaaaaugagcggacccuugacuaucaugauagcaacgucaagaaccuguacgagaaagugcgcucucagcucaagaauaacgccaaagaaaucgggaauggauguuuugaguucuaucacaagugcgacaacacauguauggaauccgucaagaauggcaccuacgauuauccuaaauacagcgaggaagcuaagcugaacagagaggagaucgacggggugaaacuugaaucuacacggauuuaucaaauccuggccauuuacuccacgguugcgagcucccucgugcuggucgugucucugggcgcuaucagcuuuuggaugugcuccaauggaucucuccagugccgcauuuguaucuga

SEQ ID NO: 188636 - RNA, 1701 nt, Artificial Sequence; identical to SEQ ID NO: 185693
  derived and/or modified sequence opt5 from hemagglutinin__InfluenzaA__ADM14673

SEQ ID NO: 188637 - RNA, 1701 nt, Artificial Sequence; identical to SEQ ID NO: 185693
  derived and/or modified sequence opt5 from hemagglutinin__InfluenzaA__ADM14682

SEQ ID NO: 188638 - RNA, 1701 nt, Artificial Sequence; identical to SEQ ID NO: 185693
  derived and/or modified sequence opt5 from hemagglutinin__InfluenzaA__ADM14691

SEQ ID NO: 188639 - RNA, 1701 nt, Artificial Sequence; identical to SEQ ID NO: 186857
  derived and/or modified sequence opt5 from hemagglutinin__InfluenzaA__ADM14700

SEQ ID NO: 188640 - RNA, 1695 nt, Artificial Sequence
  derived and/or modified sequence opt5 from hemagglutinin__InfluenzaA__ADM14709
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccaauagcuggccuaaccacgauucuaauaagggagugacagccgcuuguccccaugccggcgcgaaauccuuuuauaagaaccugaucuggcucguuaaaaagggcaauagcuacccuaaacugucuaaguccuauauuaacgacaaggggaaagaagugcuuguccuguggggaauccaccaccccagcaccuccgccgaucaacagucucucuaccagaaugcugacgccuacguguucgugggcacaagcaaguauuccaaaaaguuuaaaccugagauugcuaucagaccgaagguccgggaucaggaggggcgcaugaacuacuauuggacccugguugaacccggagacaaaauuacguucgaggccacaggcaaccugguggugccuagauacgcguuugccauggaacggaaugcugggagcggaaucauuaucucugauacccccguccaugacugcaacacaaccugucaaaccccuaagggcgccaucaauacaucccuccccuuccagaacauucacccgaucacgauuggcaagugcccuaaauauguuaagagcaccaaacugcgccuugcuacagggcugagaaaugugcccucuauccagagccggggacucuuuggcgccauugccggguucaucgagggaggcuggaccgggaugguggacggaugguacggcuaucaucaccagaacgaacaaggcuccggguacgcugcggaucugaagucuacacagaaugccaucgacggaauuaccaacaaaaucaauagcgucauugagaagaugaacacgcaguuuacagcugugggcaaggaguucaaucaccuugaaaaacgcaucgagaaccugaauaagaaaguugaugacggguuccucgauauuuggaccuacaacgccgaacugcuggugcuccuggagaaugaaagaacccuuaacuaucaugacuccaacgucaagaaucuguacgagaaagugcggagccagcucaagaacaaugccaaggagaucggaaacggcuguuuugaguucuaucacaaaugcgauaauacauguauggagucugucaagaacgggaccuacgacuauccuaaauacuccgaagaggcuaagcugaaucgcgaagagaucgauggcgugaaacuugagagcacaagaauuuaucaaauccuggccauuuacucuacgguugcguccagccucgugcuggucgugucccugggagcuaucucuuuuuggaugugcagcggccauuccugccggauuuguaucuga

SEQ ID NO: 188641 - RNA, 1701 nt, Artificial Sequence
  derived and/or modified sequence opt5 from hemagglutinin__InfluenzaA__ADM14718
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcaugucuuccuucgaacgcuuugagaucuuccccaagaccagcucuuggccuaaucacgauuccaacaagggagucacagccgcuuguccccaugccggcgcgaaaucuuuuuauaagaaucugaucuggcucgugaaaaagggcaacagcuacccuaaacuguccaagagcuauauuaaugacaaggggaaagaaguucuugugcuguggggaauccaccaccccuccaccucugccgaucaacagagccucuaccagaacgcugacgccuacgucuucgugggcacauccagauauagcaagaaauuuaagccugagauugcuauccggccgaaagugcgcgaucaggaggggagaaugaauuacuauuggacccuggucgaacccggagacaagauuacguucgaggccacaggcaaccugguugugccucgguacgcguuugccauggaacgcaacgcugggucuggaaucauuaucuccgauacccccgugcaugacugcaauacaaccugucaaaccccuaaaggcgccaucaacacaagccuccccuuccagaauauucacccgaucacgauuggcaagugcccuaaguaugucaaaucuaccaagcugagacuugcuacagggcugcggaacgugcccagcauccagucccgcggacucuuuggcgccauugccggguucaucgagggaggcuggaccgggaugguugacggaugguacggcuaucaucaccagaaugaacaaggcucuggguacgcugcggaucugaaaagcacacagaacgccaucgacaagauuaccaauaaagugaacuccgucaucgagaagaugaauacgcaguuuacagcugugggaaaggaguucaaccaccuugagaaaagaauugagaaucugaacaagaaaguugaugacggcuuccucgauaucuggaccuacaaugccgaacugcuggugcuccuggagaacgaacggacccuugacuaucaugauagcaaugucaagaaccuguacgagaaagugcgcucucagcucaagaacaaugccaaggagauugggaacggauguuuugaguucuaucacaaaugcgacaauacauguauggaauccgucaagaacggcaccuacgauuauccuaaauacagcgaagaggcuaagcugaauagagaagagaucgacggggugaaacuugagucuacacggaucuaucaaauucuggccaucuacuccacgguugcgagcucccucgugcuggucgugucucugggcgcuauuagcuuuuggaugugcuccaacggaucucuccagugccgcaucuguauuuga

SEQ ID NO: 188642 - RNA, 1695 nt, Artificial Sequence
  derived and/or modified sequence opt5 from hemagglutinin__InfluenzaA__ADM14728
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaauccuuuuauaagaaucugaucuggcucguuaaaaagggcaacucuuacccuaaacuguccaauagcuauauuaacgacaaggggaaggaagugcuuguccuguggggaauccaccaccccuccaccucugccgaucaacagagccucuaccagaaugcugacgccuacguguucgugggcacauccagauauagcaaaaaguuuaaaccugagauugcuauccggccgaagguccgcgaucaggaggggagaaugaacuacuauuggacccugguugaacccggagacaaaauuacguucgaggccacaggcaaccugguggugccucgguacgcguuugccauggaacgcaaugcugggucuggaaucauuaucuccgauacccccgcccaugacugcaacacaaccugucaaaccccuaagggcgcuaucaauacaagccuccccuuccagaacauucacccgaucacgauuggcaaaugcccuaaguaugucaagucuaccaaacugagacuugccacagggcugcggaaugugcccagcauccagucccgcggacucuuuggcgccauugcuggguucaucgagggaggcuggaccgggaugguugacggaugguacggcuaucaucaccagaacgaacaaggcucuggguacgcggccgaucuuaagagcacacagaaugcuaucgacgagauuaccaacaaagugaauagcgucaucgagaagaugaacacgcaguuuacagccgugggaaaagaguucaaucaccuggagaagagaauugaaaaccugaauaagaaaguugaugacggcuuccucgauaucuggaccuacaacgccgagcugcuggugcuccuggaaaaugagcggacccuugacuaucaugauagcaacgucaagaaccuguacgagaaagugcgcucucagcucaagaauaacgcuaaagaaauugggaauggauguuuugaguucuaucacaagugcgacaacacauguauggaauccgucaagaauggcaccuacgauuauccuaaauacagcgaggaagccaagcugaacagagaggagaucgacggggugaaacuugaaucuacacggaucuaucaaauucuggcgaucuacuccacgguugcuagcucccucgugcuggucgugucucugggcgccauuagcuuuuggaugugcuccggacauucuugccgcaucuguauuuga

SEQ ID NO: 188643 - RNA, 1701 nt, Artificial Sequence
  derived and/or modified sequence opt5 from hemagglutinin__InfluenzaA__ADM14737
augaaggccauccuggugguccuccuguacaccuucgcuacagccaacgcggacacgcuuugcauuggcuaucacgcuaauaacagcaccgauacaguuaauaccgugcuggagaaaaacgugacagucacccauuccgugaaucuccuggaagacaagcacaacgggaaacuuuguaagcugagaggaguugcuccccuccaucugggcaaaugcaauaucgccggguggauucugggaaacccugagugugaaucucucagcacagccuccucuuggagcuacaucguggagaccuccucuagcgauaauggcacgugcuauccgggggacuuuauugauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaccugguggugccucgguacgcguuugccauggaaaagaaugcugggucuggaaucauuaucuccgacacccccguccaugauugcaacacaaccugucaaaccccuaagggcgccaucaauacaagccuccccuuccagaacauucacccgaucacgauuggcaagugcccuaaauaugugaagucuaccaaacugcgccuugcuacagggcugagaaauguucccagcauccagucccggggacucuuuggcgccauugccggguucaucgagggaggcuggaccgggaugguggacggaugguacggcuaucaucaccagaacgaacaaggcucuggguacgcugcggaccugaaaagcacacagaaugccaucgaugagauuaccaacaaagucaauuccgugaucgagaagaugaacacgcaguuuacagcuguuggaaaggaguucaaucaccuugagaaacgcauugaaaaccugaauaagaaaguggacgauggcuuccucgacaucuggaccuacaacgccgagcugcugguccuccuggaaaaugagagaacccuugauuaucaugacagcaacgugaagaaccuguacgagaaaguccggucucagcucaagaauaacgccaaggaaauugggaauggauguuuugaguucuaucacaaaugcgauaacacauguauggaauccgugaagaauggcaccuacgacuauccuaaauacagcgaggaagcuaagcugaaccgcgaggagaucgaugggguuaaacuugaaucuacaagaaucuaucaaauucuggccaucuacuccacgguggcgagcucccucguccuggugguuucucugggcgcuauuagcuuuuggaugugcuccaauggaucucuccagugccggaucuguauuuga

SEQ ID NO: 188644 - RNA, 1701 nt, Artificial Sequence
  derived and/or modified sequence opt5 from hemagglutinin__InfluenzaA__ADM14746
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccgggugggugcugggaaauccugagugugaaucucucagcacagccuccucuuggagcuacauugucgagaccccguccucugacaacggcacgugcuaucccggggauuuuaucgacuacgaagaacugcgggagcagcuuagcuccgugagcucuuucgaacgcuuugagauuuucccuaagaccuccagcuggcccaaucacgauucuaacaagggaguuacagccgcuuguccucaugccggcgcgaaauccuuuuauaagaaucugaucuggcucgugaaaaagggcaacagcuaccccaaacugucuaaguccuauaucaaugacaaggggaaagaaguccuugugcuguggggcauucaccacccuagcaccuccgccgaucaacagucucucuaccagaacgcugacgccuacguguucgucggaacaagcagauauuccaagaaauuuaagccggagaucgcuauucggcccaaaguucgcgaucaggaggggagaaugaauuacuauuggacccugguggaaccuggagacaagaucacguucgaggccacaggcaaccugguggucccccgguacgcguuugccauggaacgcaacgcugggagcggaauuaucauuucugauaccccugugcaugacugcaauacaaccugucaaacccccaaaggcgccaucaacacaucccucccguuccagaauauccacccuauuacgaucggcaagugccccaaguauguuaaaagcaagaaacugagacuugcuaccgggcugcggaacgugccuucuauucagagccgcggacucuuuggcgccaucgccggguucauugagggaggcuggacagggauggucgacggaugguacggcuaucaucaccagaaugaacaaggcuccggguacgcugcggaucugaagucuacccagaacgccaucgacgagaucacaaauaaagugaacagcguuauugagaagaugaauacccaguuuacggcugugggaaaggaguucaaccaccuugagaaaagaaucgaaaaucugaacaagaaagucgaugacggcuuccucgauauuuggacauacaaugccgagcugcuggugcuccuggaaaacgagcggacccuugacuaucaugauuccaaugucaagaaccuguacgagaaagugcgcagccagcucaagaacaaugccaaggaaaucgggaacggauguuuugaguucuaucacaaaugcgacaauaccuguauggaaucuguuaagaacggcacauacgauuaucccaaauacuccgaggaagcuaagcugaauagagaggagauugacggggugaaacuugaaagcacccggaucuaucaaauccuggccauuuacucuacagucgcguccagccucgugcugguugugucccugggcgcuaucucuuuuuggaugugcagcaacggaucccuccagugccgcauuuguaucuga

SEQ ID NO: 188645 - RNA, 1695 nt, Artificial Sequence
  derived and/or modified sequence opt5 from hemagglutinin__InfluenzaA__ADM14756
augaaggccauccuggugguccuccuguacaccuucgcuacagccaacgcggacacgcuuugcguuggcuaucacgcuaauaacagcaccgauacaguggacaccgugcuggagaaaaaugucacagugacccauuccguuaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauugucgagaccuccucuagcgacaacggcacgugcuauccgggggauuuuaucgacuacgaagaacugcgggagcagcuuuccagcgugucuuccuucgaacgcuuugagauuuuccccaagaccagcucuuggccuaaucacgauuccaacaagggaguuacagccgcuuguccccaugccggcgcgaaaucuuuuuauaagaaucugaucuggcucgugaaaaagggcaacagcuacccuaaacuguccaagagcuauaucaaugacaaggggaaagaaguccuugugcuguggggcauucaccaccccuccaccucugccgaucaacagagccucuaccagaacgcugacgccuacguguucgucggaacauccagauauagcaagaaauuuaagccugagaucgcuauucggccgaaaguucgcgaucaggaggggagaaugaauuacuauuggacccugguggaacccggagacaagaucacguucgaggccacaggcaaccugguggucccucgguacgcguuugccauggaacgcaacgcugggucuggaauuaucauuuccgauacccccgugcaugacugcaauacaaccugucaaaccccuaaaggcgccaucaacacaagccuccccuuccagaauauccacccgauuacgaucggcaagugcccuaaguauguuaaaucuaccaagcugagacuugcuacagggcugcggaacgugcccagcauucagucccgcggacucuuuggcgccaucgccggguucauugagggaggcuggaccgggauggucgacggaugguacggcuaucaucaccagaaugaacaaggcucuggguacgcugcggaucugaaaagcacacagaacgccaucgacaagaucaccaauaaagugaacuccguuauugagaagaugaauacgcaguuuacagcugugggaaaggaguucaaccaccuugagaaaagaaucgagaaucugaacaagaaagucgaugacggcuuccucgauauuuggaccuacaaugccgaacugcuggugcuccuggagaacgaacggacccuugacuaucaugauagcaaugucaagaaccuguacgagaaagugcgcucucagcucaagaacaaugccaaggagaucgggaacggauguuuugaguucuaucacaaaugcgacaauacauguauggaauccguuaagaacggcaccuacgauuauccuaaauacagcgaagaggcuaagcugaauagagaagagauugacggggugaaacuugagucuacacggaucuaucaaauccuggccauuuacuccacggucgcgagcucccucgugcugguugugucucugggcgcuaucagcuuuuggaugugcuccggacauucuugccgcauuuguaucuga

SEQ ID NO: 188646 - RNA, 1701 nt, Artificial Sequence; identical to SEQ ID NO: 186857
  derived and/or modified sequence opt5 from hemagglutinin__InfluenzaA__ADM14765

SEQ ID NO: 188647 - RNA, 1695 nt, Artificial Sequence
  derived and/or modified sequence opt5 from hemagglutinin__InfluenzaA__ADM14775
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacugaauaaguccuauauuaacgacaaggggaaagaagugcuuguccuguggggaauccaccaccccagcaccuccgccgaucaacagucucucuaccagaaugcugacgccuacguguucgugggcacaagcagauauuccaagaaauuuaagccugagauugcuauccggccgaaaguccgcgaucaggaggggagaaugaacuacuauuggacccugguugaacccggagacaagauuacguucgaggccacaggcaaccugguggugccucgguacgcguuugccauggaacgcaaugcugggagcggaaucauuaucucugauacccccguccaugacugcaacacaaccugucaaaccccuaaaggcgccaucaauacaucccuccccuuccagaacauucacccgaucacgauuggcgagugcccuaaguauguuaagagcaccaaacugagacuugcuacagggcugcggaaugugcccucuauccagagccgcggacucuuuggcgccauugccggguucaucgaaggaggcuggaccgggaugguggacggaugguacggcuaucaucaccagaacgagcaaggcuccggguacgcugcggaucugaagucuacacagaaugccaucgacaaaauuaccaacaaggucaauagcgugaucgagaaaaugaacacgcaguuuacagcuguuggaaaggaguucaaucaccuugagaagagaauugaaaaccugaauaaaaagguggaugacggcuuccucgauaucuggaccuacaacgccgagcugcugguccuccuggaaaaugagcggacccuugacuaucaugauuccaacgugaaaaaccuguacgagaagguccgcagccagcucaaaaauaacgccaaggaaauugggaauggauguuuugaguucuaucacaagugcgacaacacauguauggaaucugugaaaaauggcaccuacgauuauccuaaguacuccgaggaagcuaaacugaacagagaggagaucgacgggguuaaacuugaaagcacacggaucuaucaaauucuggccaucuacucuacgguggcguccagccucguccuggugguuucccugggcgcuauuucuuuuuggaugugcagcggacauuccugccgcaucuguauuuga

SEQ ID NO: 188648 - RNA, 1695 nt, Artificial Sequence
  derived and/or modified sequence opt5 from hemagglutinin__InfluenzaA__ADM14802
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagaucagaggaguugcuccccugcaucucggcaaaugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggaacauccagauauagcaagaaauuuaagccugagaucgcuauucggccgaaaguccgcgaucaggaggggagaaugaauuacuauuggacccucguugaacccggagacaagaucacguucgaggccacaggcaaccugguggugccucgguacgcguuugccauggaacgcaacgcugggucuggaauuaucaucuccgauacccccguccaugacugcaauacaaccugucaaaccccuaaaggcgccauuaacacaagccugcccuuccagaauauccacccgauuacgaucggcaagugcccuaaguaugugaaaucuaccaagcucagacuggcuacagggcuucggaacguucccagcauucagucccgcggacuguuuggcgccaucgccggguucaucgagggaggcuggaccgggaugguggacggaugguacggcuaucaucaccagaaugaacaaggcucuggguacgcugcggaucucaaaagcacacagaacgccauugacgagaucaccaauaaggucaacuccgugauugagaaaaugaauacgcaguuuacagcuguuggaaaggaguucaaccaccuggagaagagaaucgaaaaucuuaacaaaaagguggaugacggcuuccuggauauuuggaccuacaaugccgagcuccugguccugcucgaaaacgagcggacccuggacuaucaugauagcaaugugaaaaaccuuuacgagaagguccgcucucagcugaaaaacaaugccaaggaaaucgggaacggauguuuugaguucuaucacaagugcgacaauacauguauggaauccgugaaaaacggcaccuacgauuauccuaaguacagcgaggaagcuaaacucaauagagaggagaucgacgggguuaagcuggaaucuacacggauuuaucaaauccuugccauuuacuccacgguggcgagcucccugguccucgugguuucucugggcgcuaucagcuuuuggaugugcuccggacauucuugccgcauuuguaucuga

SEQ ID NO: 188649 - RNA, 1704 nt, Artificial Sequence
  derived and/or modified sequence opt5 from hemagglutinin__InfluenzaA__ADM14830
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaacuccugucuacagccagcuccuggucuuacaucguggagaccagcuccucugacaacggcacgugcuauccgggggauuuuauugacuacgaagaacuucgggagcagcugagcuccgucagcucuuucgaacgcuuugagaucuuccccaagaccuccagcuggccuaaucacgauucuaacaagggagugacagccgcuuguccccaugccggcgcgaaauccuuuuauaagaaucucaucuggcugguuaaaaagggcaacagcuacccuaaacuuucuaaguccuauauuaaugacaaggggaaagaagugcugguccucuggggaauccaccaccccagcaccuccgccgaucaacagucucuguaccagaacgcugacgccuacguguucgugggcacaagcagauauuccaagaaauuuaagccugagauugcuauccggccgaaaguccgcgaucaggaggggagaaugaauuacuauuggacccugguugaacccggagacaagauuacguucgaggccacaggcaaccucguggugccucgguacgcguuugccauggaacgcaacgcugagagcgggaucauuaucucugauacccccguccaugacugcaauacaaccugucaaaccccuaaaggagccaucaacacaucccugcccuuccagaauauucacccgaucacgauuggcaagugcccuaaguaugugaaaagcaccaaacuuagacuggcuacaggccuccggaacguucccucuauccagagccgcgggcuguuuggagccauugccggcuucaucgaagggggauggaccggcaugguggacgggugguacggauaucaucaccagaaugagcaaggcuccggcuacgcugcggaucuuaaaucuacacagaacgccaucgacgagauuaccaauaaggucaacagcgugaucgaaaagaugaauacgcaguuuacagcuguugggaaggaguucaaccaccuggaaaagagaauugagaaucucaacaaaaagguggaugacggauuccuggauaucuggaccuacaaugccgaacugcucguccugcuugagaacgagcggacccuggacuaucaugauuccaaugugaaaaagcucuacgaaaaaguccgcagccagcugaagaacaacgccaaggagauuggcaauggguguuuugaguucuaucacaaaugcgacaacacauguauggagucugugaagaauggaaccuacgauuauccuaaauacuccgaagaggcuaaacuuaacagagaggaaaucgacggcguuaagcuggagagcacacggaucuaucaaauucucgccaucuacucuacgguggcguccagccugguccuggugguuucccucggggcuauuucuuuuuggaugugcagcggccauuccugccugcagugucgcaucugcauuuga

SEQ ID NO: 188650 - RNA, 1695 nt, Artificial Sequence
  derived and/or modified sequence opt5 from hemagglutinin__InfluenzaA__ADM14848
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucuccccuuccagaauauucacccgaucacaauuggcaagugcccuaaguaugugaaaagcacgaagcugagacuugcuaccgggcugcggaacguucccuccauccagucucgcggacucuuuggcgccauugccggguucaucgagggaggcuggacagggaugguggacggaugguacggcuaucaucaccagaaugaacaaggcagcggguacgcugcggaucugaaauccacccagaacgccaucgacgagauuacaaauaaggucaacagcgugaucgagaaaaugaauacccaguuuacggcuguuggaaaggaguucaaccaccuugagaagagaauugaaaaucugaacaaaaagguggaugacggcuuccucgauaucuggacauacaaugccgagcugcugguccuccuggaaaacgagcggacccuugacuaucaugauucuaaugugaaaaaccuguacgagaagguccgcucccagcucaaaaacaaugccaaggaaauugggaacggauguuuugaguucuaucacaagugcgacaauaccuguauggaaagcgugaaaaacggcacauacgauuauccuaaguacucugaggaagcuaaacugaauagagaggagaucgacgggguuaaacuugaauccacccggaucuaucaaauucuggccaucuacagcacaguggcguccucucucguccuggugguuagccugggcgcuauuuccuuuuggaugugcucuggacauagcugccgcaucuguauuuga

SEQ ID NO: 188651 - RNA, 1695 nt, Artificial Sequence
  derived and/or modified sequence opt5 from hemagglutinin__InfluenzaA__ADM14866
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccgacaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaucugguggugccucgguacgcguuugccauggaacgcaacgcugggucuggaaucauuaucuccgacacccccguccaugacugcaacacaaccugucaaaccccuaaaggcgccaucaauacaagccuccccuuccagaacauucacccgaucacgauuggcaagugcccuaaguaugugaaaucuaucaagcugagacuugcuaccgggcugcggaauguucccagcauucagucccgcggacucuuuggcgccaucgccggguucaucgagggaggcuggacagggaugguggauggaugguacggcuaucaucaccagaacgaacaaggcucuggguacgcugcggaccugaaaagcacccagaaugccauugaugagaucacaaacaaggucaauuccgugauugagaaaaugaacacccaguuuacggcuguuggaaaggaguucaaucaccuugagaagagaaucgaaaaccugaauaaaaagguggacgauggcuuccucgacauuuggacauacaacgccgagcugcugguccuccuggaaaaugagcggacccuugauuaucaugacagcaacgugaaaaaucuguacgagaagguccgcucucagcucaaaaacaacgccaaggaaaucgggaauggauguuuugaguucuaucacaagugcgauaacaccuguauggaauccgugaaaaauggcacauacgacuauccuaaguacagcgaggaagcuaaacugaacagagaggagaucgaugggguuaaacuugaaucuacccggauuuaucaaauccuggccauuuacuccacaguggcgagcucccucguccuggugguuucucugggcgcuaucagcuuuuggaugugcuccggacauucuugccgcauuuguaucuga

SEQ ID NO: 188652 - RNA, 1695 nt, Artificial Sequence
  derived and/or modified sequence opt5 from hemagglutinin__InfluenzaA__ADM14876
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggaaaaagaggugcuuguccugugggggauccaccaccccuccaccucugccgaucaacagagccucuaccagaacgcugacgccuacguguucgugggaacauccagauauagcaagaaauuuaagccugagauugcuauccggccgaaaguccgcgaucaggaaggcagaaugaauuacuauuggacccugguugagcccggggacaagauuacguucgaagccacaggaaaccugguggugccucgguacgcguuugccauggagcgcaacgcuggcucugggaucauuaucuccgauacccccguccaugacugcaauacaaccugucaaaccccuaaaggagccaucaacacaagccuccccuuccagaauauucacccgaucacgauuggcaagugcccuaaguaugugaaaucuaccaagcugagacuugcuacaggccugcggaacguucccagcauccagucccgcgggcucuuuggagccauugccggcuucaucgaagggggauggaccggcaugguggacgggugguacggauaucaucaccagaaugagcaaggcucuggcuacgcugcggaucugaaaagcacacagaacgccaucgacgagauuaccaauaaggucaacuccgugaucgaaaagaugaauacgcaguuuacagcuguugggaaggaguucaaccaccuugaaaagagaauugagaaucugaacaaaaagguggaugacggauuccucgauaucuggaccuacaaugccgaacugcugguccuccuggagaacgagcggacccuugacuaucaugauagcaaugugaaaaaccuguacgaaaagguccgcucucagcucaaaaacaaugccaaggagauuggcaacggguguuuugaguucuaucacaagugcgacaauacauguauggaguccgugaaaaacggaaccuacgauuauccuaaguacagcgaagaggcuaaacugaauagagaggaaaucgacggcguuaaacuugagucuacacggaucuaucaaauucuggccaucuacuccacgguggcgagcucccucguccuggugguuucucugggggcuauuagcuuuuggaugugcuccggccauucuugccgcaucuguauuuga

SEQ ID NO: 188653 - RNA, 1704 nt, Artificial Sequence
  derived and/or modified sequence opt5 from hemagglutinin__InfluenzaA__ADM14885
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaacuccugucuacagccagcuccuggucuuacaucguggagaccagcuccucugacaacggcacgugcuauccgggggauuuuauugacuacgaagaacuucgggagcagcugagcuccgucagcucuuucgaacgcuuugagaucuuccccaagaccuccagcuggccuaaucacgauucuaacaagggagugacagccgcuuguccccaugccggcgcgaaauccuuuuauaagaaucucaucuggcugguuaaaaagggcaacagcuacccuaaacuuucuaaguccuauauuaaugacaaggaaaaagaggugcugguccucugggggauccaccaccccagcaccuccgccgaucaacagucucuguaccagaacgcugacgccuacguguucgugggaacaagcagauauuccaagaaauuuaagccugagauugucauccggccgaaaguucgcgaucaggaaggcagaaugaauuacuauuggacccugguggagcccggggacaagauuacguucgaagcuacaggaaaccucguggucccucgguacgccuuugcgauggagcgcaacgccgaaagcggcaucauuaucucugauacccccgugcaugacugcaauacaaccugucaaaccccuaaaggggcuaucaacacaucccugcccuuccagaauauucacccgaucacgauuggaaagugcccuaaguauguuaaaagcaccaaacuuagacuggccacaggccuccggaacgugcccucuauccagagccgcggccuguuuggggcuauugccggauucaucgagggcggguggaccggaauggucgacggcugguacggguaucaucaccagaaugagcaaggauccggcuacgccgcugaucuuaagucuacacagaacgcgaucgacgaaauuaccaauaaggugaacagcguuaucgagaaaaugaauacgcaguuuacagccgugggcaaggaguucaaccaccuggagaagagaauugaaaaucucaacaaaaaggucgaugacggguuccuggauaucuggaccuacaaugcugagcugcucgugcugcuugagaacgaacggacccuggacuaucaugauuccaaugucaaaaagcucuacgagaaagugcgcagccagcugaagaacaacgccaaggaaauuggaaauggcuguuuugaguucuaucacaaaugcgacaacacauguauggaaucuguuaagaaugggaccuacgauuauccuaaauacuccgaggaggccaaacuuaacagagaagagaucgacggagugaagcuggaaagcacacggaucuaucaaauucucgcuaucuacucuacggucgccuccagccuggugcugguugugucccucggcgcgauuucuuuuuggaugugcagcgggcauggcucccugcagugccgcaucuguauuuga

SEQ ID NO: 188654 - RNA, 1695 nt, Artificial Sequence
  derived and/or modified sequence opt5 from hemagglutinin__InfluenzaA__ADM14894
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggaaaaagaggugcuuguccugugggggauccaccaccccuccaccucugccgaucaacagagccucuaccagaacgcugacgccuacguguucgugggaacauccagauauagcaagaaauuuaagccugagauugucauccggccgaaaguucgcgaucaggaaggcagaaugaauuacuauuggacccugguggagcccggggacaagauuacguucgaagcuacaggaaaccugguggucccucgguacgccuuugcgauggagcgcaacgccggcucugggaucgugauuuccgauacccccguucaugacugcaauacaaccugucaaaccccuaaaggagcuaucaacacaagccuccccuuccagaauauccacccgauuacgaucggcaagugcccuaaguaugugaaaucuaccaagcugagacuugccacaggccugcggaacguccccagcauucagucccgcgggcucuuuggagcuaucgccggcuucauugaagggggauggaccggcaugguggacgggugguacggauaucaucaccagaaugagcaaggcucuggcuacgccgcugaucugaaaagcacacagaacgcgaucgacgagaucaccaauaagguuaacuccgugauugaaaagaugaauacgcaguuuacagccgucgggaaggaguucaaccaccuugaaaagagaaucgagaaucugaacaaaaagguggaugacggauuccucgauauuuggaccuacaaugcugaacugcugguccuccuggagaacgagcggacccuugacuaucaugauagcaaugugaaaaagcuguacgaaaaaguucgcucucagcucaagaacaacgccaaggagaucggcaauggguguuuugaguucuaucacaaaugcgacaacacauguaugaaguccgugaaaaauggaaccuacgauuauccuaaguacagcgaggaagccaaacugaacagagaggagauugacggcgucaaacuugaaucuacacggaucuaucaaauccuggcuauuuacuccacgguggccagcucccucguucugguggucucucugggggcgaucagcuuuuggaugugcuccggccauucuugccgcauuuguaucuga

SEQ ID NO: 188655 - RNA, 1695 nt, Artificial Sequence
  derived and/or modified sequence opt5 from hemagglutinin__InfluenzaA__ADM14903
augaaggccauccuggugguccuccugugcaccuucgcuacagccaacgcggacacgcuuuguauuggcuaccacgcuaauaacagcaccgauacaguugacaccgugcuggagaaaaaugugacagucacccauuccgugaaccuccuggaagauaagcacaaugggaaacuuugcaagcugagaggaguugcuccccuccaucugggcaaauguaacaucgccggguggauucugggaaauccugagugcgaaucucucagcacagccuccucuuggagcuauaucguggagaccuccucuagcgacaacggcacguguuacccgggggauuuuauugacuaugaagaacugcgggagcagcuuuccagcgucucuuccuucgaacgcuuugagaucuuccccaagaccagcucuuggccuaaucacgauuccaacaagggagugacagccgcuugcccccaugccggcgcgaaaucuuuuuacaagaaucugaucuggcucguuaaaaagggcaacagcuauccuaaacuguccaagagcuacauuaaugacaaggggaaagaagugcuuguccuguggggaauccaccaccccuccaccucugccgaucaacagagccucuaucagaacgcugacgccuacguguucgugggcacauccagauacagcaagaaauuuaagccugagauugcuauccggccgaaaguccgcgaucaggaggggagaaugaauuauuacuggacccugguugaacccggagacaagauuacguucgaggccacaggcaaccugguggugccucgguaugcguuugccauggaacgcaacgcugggucuggaaucauuaucuccgauacccccguccaugacuguaauacaaccugccaaaccccuaaaggcgccaucaacacaagccuccccuuccagaauauucacccgaucacgauuggcaaguguccuaaguacgugaaaucuaccaagcugagacuugcuacagggcugcggaacguucccagcauccagucccgcggacucuuuggcgccauugccggguucaucgagggaggcuggaccgggaugguggacggaugguauggcuaccaucaccagaaugaacaaggcucuggguaugcugcggaucugaaaagcacacagaacgccaucgacaagauuaccaauaaagucaacuccgugaucgagaagaugaauacgcaguuuacagcuguuggaaaggaguucaaccaccuugagaaaagaauugagaaucugaacaagaaaguggaugacggcuuccucgauaucuggaccuacaaugccgaacugcugguccuccuggagaacgaacggacccuugacuaccaugauagcaaugugaagaaccuguaugagaaaguccgcucucagcucaagaacaaugccaaggagauugggaacggaugcuuugaguucuaccacaaaugugacaauacaugcauggaauccgugaagaacggcaccuaugauuacccuaaauauagcgaagaggcuaagcugaauagagaagagaucgacgggguuaaacuugagucuacacggaucuaccaaauucuggccaucuauuccacgguggcgagcucccucguccuggugguuucucugggcgcuauuagcuuuuggaugugcuccggacauucuugucgcaucugcauuuga

SEQ ID NO: 188656 - RNA, 1695 nt, Artificial Sequence
  derived and/or modified sequence opt5 from hemagglutinin__InfluenzaA__ADM14912
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccugagggcgccaucaacacaagccuccccuuccagaauauucacccgaucacgauuggcaaaugcccuaaguaugugaagucuaccaaacugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaucuuaagagcacacagaacgccaucgacgagauuaccaauaaagucaacuccgugaucgaaaagaugaauacgcaguuuacagcuguuggaaaagaguucaaccaccuggaaaagagaauugagaaucugaacaagaaaguggaugacggcuuccucgauaucuggaccuacaaugccgaacugcugguccuccuggagaacgagcggacccuugacuaucaugauagcaaugugaagaaccuguacgaaaaaguccgcucucagcucaagaacaaugccaaagagauugggaacggauguuuugaguucuaucacaagugcgacaauacauguauggaguccgugaagaacggcaccuacgauuauccuaaauacagcgaagaggcuaagcugaauagagaggaaaucgacgggguuaaacuugagucuacacggaucuaucaaauucuggccaucuacuccacgguggcgagcucccucguccuggugguuucucugggcgcuauuagcuuuuggaugugcuccggacauucuugccgcaucuguauuuga

SEQ ID NO: 188657 - RNA, 1695 nt, Artificial Sequence
  derived and/or modified sequence opt5 from hemagglutinin__InfluenzaA__ADM14921
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggaucuaucaaauucuggccaucuacuccacgguggcgagcucccucguccuggugguuucucugggcgcuauuagcuuuuggaugugcuccggacauucuugccgcaucuguauuuga

SEQ ID NO: 188658 - RNA, 1701 nt, Artificial Sequence; identical to SEQ ID NO: 186857
  derived and/or modified sequence opt5 from hemagglutinin__InfluenzaA__ADM14930

SEQ ID NO: 188659 - RNA, 1701 nt, Artificial Sequence
  derived and/or modified sequence opt5 from hemagglutinin__InfluenzaA__ADM14948
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuaaguccuauauuaaugacaagggaaaagaagugcuuguccuguggggcauccaccaccccagcaccuccgccgaucaacagucucucuaccagaacgcugacgccuacguguucguggggacaagcagauauucccggaaguuuaaaccugagauugcuauccgcccgaaggucagagaucaggagggacggaugaauuacuauuggacccugguugaacccggcgacaaaauuacguucgaggccacagggaaccugguggugccucgcuacgcguuugccauggaaagaaacgcuggaagcggcaucauuaucucugauacccccguccaugacugcaauacaaccugucaaaccccugagggcgccaucaacacaucccuccccuuccagaauauucacccgaucacgauugggaagugcccuaaauauguuaagagcaccaagcugcggcuugcuacaggacugcgcaacgugcccucuauccagagcagaggccucuuuggggccauugccggauucaucgaaggcggguggaccggaaugguggacggcugguacggcuaucaucaccagaaugagcaaggguccggauacgcugcggaucugaaaucuacacagaacgccaucgacgagauuaccaauaaggucaacagcgugaucgaaaagaugaauacgcaguuuacagcuguuggcaaggaguucaaccaccuugaaaaacggauugagaaucugaacaagaagguggaugacggguuccucgauaucuggaccuacaaugccgaacugcugguccuccuggagaacgagcgcacccuugacuaucaugauuccaaugugaaaaaccuguacgaaaaggucagaagccagcucaaaaacaaugccaaggagauuggaaacggcuguuuugaguucuaucacaaaugcgacaauacauguauggagucugugaagaacgggaccuacgauuauccuaaguacuccgaagaggcuaaacugaaucgggaggaaaucgacggcguuaaacuugagagcacacgcaucuaucaaauucuggccaucuacucuacgguggcguccagccucguccuggugguuucccugggagcuauuucuuuuuggaugugcagcaacggcucccuccagugcagaaucuguauuuga

SEQ ID NO: 188660 - RNA, 1695 nt, Artificial Sequence
  derived and/or modified sequence opt5 from hemagglutinin__InfluenzaA__ADM14966
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggauccagcagauauucuaagaaauuuaagccugagaucgcuauucggccgaaaguccgcgaucaggaggggagaaugaauuacuauuggacacucguugaacccggagacaagaucaccuucgaggccacgggcaaccugguggugccucgguacgcguuugccauggaacgcaacgcuggguccggaauuaucaucagcgauacacccguccaugacugcaauaccacaugucaaaccccuaaaggcgccauuaacaccucucugcccuuccagaauauccacccgauuacaaucggcaagugcccuaaguaugugaaaagcacgaagcucagacuggcuaccgggcuucggaacguucccuccauucagucucgcggacuguuuggcgccaucgccggguucaucgagggaggcuggacagggaugguggacggaugguacggcuaucaucaccagaaugaacaaggcagcggguacgcugcggaucucaaauccacccagaacgccauugacgagaucacaaauaaggucaacagcgugauugagaaaaugaauacccaguuuacggcuguuggaaaggaguucaaccaccuggagaagagaaucgaaaaucuuaacaaaaagguggaugacggcuuccuggauauuuggacauacaaugccgagcuccugguccugcucgaaaacgagcggacccuggacuaucaugauucuaaugugaaaaaccuuuacgagaagguccgcucccagcugaaaaacaaugccaaggaaaucgggaacggauguuuugaguucuaucacaagugcgacaauaccuguauggaaagcgugaaaaacggcacauacgauuauccuaaguacucugaggaagcuaaacucaauagagaggagaucgacgggguuaagcuggaauccacccggauuuaucaaauccuugccauuuacagcacaguggcguccucucugguccucgugguuagccugggcgcuaucuccuuuuggaugugcucuggacauagcugccgcauuuguaucuga

SEQ ID NO: 188661 - RNA, 1701 nt, Artificial Sequence; identical to SEQ ID NO: 185873
  derived and/or modified sequence opt5 from hemagglutinin__InfluenzaA__ADM14975

SEQ ID NO: 188662 - RNA, 1701 nt, Artificial Sequence
  derived and/or modified sequence opt5 from hemagglutinin__InfluenzaA__ADM14985
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggaaaaagaggugcuuguccugugggggauccaccaccccuccaccucugccgaucaacagagccucuaccagaacgcugacgccuacguguucgugggaacauccagauauagcaagaaauuuaagccugagauugcuauccggccgaaaguccgcggccaggaagggagaaugaauuacuauuggacccugguugagcccggagauaagauuacguucgaagccacaggcaaccugguggugccucgguacgcguuugccauggagcgcaacgcugggucuggaaucgucauuuccgacacccccgugcaugauugcaauacaaccugucaaaccccuaaaggcgccaucaacacaagccuccccuuccagaauauccacucuauuacgaucggcaagugcccgaaguauguuaaaagcaccaagcugagacuugcuacagggcugcggaacgugccuuccauucagucucgcggacucuuuggcgccaucgccggguucauugaaggaggcuggaccgggauggucgacggaugguacggcuaucaucaccagaaugagcaaggcagcggguacgcugcggaccugaaauccacacagaacgccaucgaugagaucaccaauaaggugaacagcguuauugaaaagaugaauacgcaguuuacagcugugggaaaggaguucaaccaccuugaaaagagaaucgagaaucugaacaaaaaggucgacgauggcuuccucgacauuuggaccuacaaugccgaacugcuggugcuccuggagaacgagcggacccuugauuaucaugacucuaaugucaaaaaccuguacgaaaaggugcgcucccagcucaaaaacaaugccaaggagaucgggaacggauguuuugaguucuaucacaagugcgauaauacauguauggagagcguuaaaaacggcaccuacgacuaucccaaguacucugaagaggcuaaacugaauagagaggaaauugauggggugaaacuugaguccacacggaucuaucaaauccuggccauuuacagcacggucgcguccucucucgugcugguugugagccugggcgcuaucuccuuuuggaugugcucuaacggaagccuccagugccgcauuuguaucuga

SEQ ID NO: 188663 - RNA, 1701 nt, Artificial Sequence
  derived and/or modified sequence opt5 from hemagglutinin__InfluenzaA__ADM23841
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccaauccaccucugccgaucagcagagccucuaccagaacgcugacgccuacguguucgugggcacauccagauauagcaagaaauuuaagcccgagauugcuauccggccuaaaguccgcgaucaagaggggagaaugaauuacuauuggacccugguugaaccgggagacaagauuacguucgaggccacaggcaaccugguggugccccgguacgcguuugccauggaacgcaacgcugggucuggaaucauuaucuccgauaccccuguccaugacugcaauacaaccugucagacccccaaaggcgccaucaacacaagccucccuuuccagaauauucaccccaucacgauuggcaagugcccgaaguaugugaaaucuaccaagcugagacuugcuacagggcugcggaacguuccuagcauccagucccgcggacucuuuggcgccauugccggguucaucgagggaggcuggaccgggaugguggacggaugguacggcuaucaucaccaaaaugaacagggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucaacucaaaaacaaugccaaggaaauugggaacggauguuuugaguucuaucacaagugcgacaauacauguauggaauccgugaaaaacggcaccuacgauuaucccaaguacagcgaggaagcuaaacugaauagagaggagaucgacgggguuaaacuugaaucuacacggaucuaucagauucuggccaucuacuccacgguggcgagcucccucguccuggugguuucucugggcgcuauuagcuuuuggaugugcuccaacggaucucuccagugccgcaucuguauuuga

SEQ ID NO: 188664 - RNA, 1701 nt, Artificial Sequence; identical to SEQ ID NO: 186857
  derived and/or modified sequence opt5 from hemagglutinin__InfluenzaA__ADM23843

SEQ ID NO: 188665 - RNA, 1701 nt, Artificial Sequence
  derived and/or modified sequence opt5 from hemagglutinin__InfluenzaA__ADM23844
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccauuucugacaacggcacgugcuauccgggggauuuuaucgacuacgaagaacugcgggagcagcuuagcuccgucagcucuuucgaacgcuuugagaucuuccccaagaccuccagcuggccuaaucacgauucuaacaagggagugacaaccgccuguccccaugcuggcgccaaaggcuuuuauaagaaucugauuuggcucguuaaaaaggggaacuccuacccuaaacugagcaagucuuauaucaaugacaagggaaaagaagugcuuguccuguggggcauucaccaccaauccacaagcgcggaucagcagucccucuaccagaacgccgacgcuuacguguucguggggaccucuagauauagcaagaaauuuaagcccgagaucgccauucggccuaaaguccgcgaucaagagggaagaaugaauuacuauuggacgcugguugaaccgggcgacaagaucacauucgaggcuaccgggaaccugguggugccccgguacgccuuugcgauggaacgcaacgccggauccggcauuaucaucagcgauacaccuguccaugacugcaauaccaccugucagacacccaaaggcgcuauuaacacgucucucccuuuccagaauauccaccccauuaccaucgggaagugcccgaaguaugugaaauccacaaagcugagacuugccaccggacugcggaacguuccuagcauucagucucgcggccucuuuggggcuaucgccggauucaucgagggcggguggacaggaaugguggacggcugguacggcuaucaucaccaaaaugaacaggggagcggauacgccgcugaucugaaauccacccagaacgcgauugacaagaucacgaauaaagucaacucugugauugagaagaugaauacacaguuuaccgccguuggcaaggaguucaaccaccuugagaaaagaaucgagaaucugaacaagaaaguggaugacggguuccucgauauuuggaccuacaaugcugaacugcugguccuccuggagaacgaacggacacuugacuaucaugauagcaaugugaagaaccuguacgagaaaguccgcucccaacucaagaacaaugccaaggagaucggaaacggcuguuuugaguucuaucacaaaugcgacaauaccuguauggaaagcgugaagaacgggacauacgauuaucccaaauacucugaagaggccaagcugaauagagaagagaucgacggcguuaaacuugaguccacgcggauuuaucagauccuggcuauuuacagcaccguggccucuucccucguccuggugguuagccugggagcgaucuccuuuuggaugugcucuaacggcagccuccagugccgcauuuguaucuga

SEQ ID NO: 188666 - RNA, 1701 nt, Artificial Sequence
  derived and/or modified sequence opt5 from hemagglutinin__InfluenzaA__ADM23845
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccauuucugacaacggcacgugcuauccgggggauuuuaucgacuacgaagaacugcgggagcagcuuagcuccgucagcucuuucgaacgcuuugagaucuuccccaagaccuccagcuggccuaaucacgauucuaacaagggagugacaaccgccuguccccaugcuggcgccaaauccuuuuauaagaaucugauuuggcucguuaaaaagggcaacagcuacccuaaacugucuaaguccuauaucaaugacaaggggaaagaagugcuuguccuguggggcauucaccaccaaagcacauccgcggaucagcagucucucuaccagaacgccgacgcuuacguguucgugggaaccagcagauauuccaagaaauuuaagcccgagaucgccauucggccuaaaguccgcgaucaagaggggagaaugaauuacuauuggacgcugguugaaccgggagacaagaucacauucgaggcuaccggcaaccugguggugccccgguacgccuuugcgauggaacgcaacgccgggagcggaauuaucaucucugauacaccuguccaugacugcaauaccaccugucagacacccaaaggcgcuauuaacacgucccucccuuuccagaauauccaccccauuaccaucggcaagugcccgaaguaugugaaaagcacaaagcugagacuugccaccgggcugcggaacguuccuucuauucagagccgcggacucuuuggcgcuaucgccggguucaucgagggaggcuggacagggaugguggacggaugguacggcuaucaucaccaaaaugaacagggcuccggguacgccgcugaucugaaaucuacccagaacgcgauugacaagaucacgaauaaagucaacagcgugauugagaagaugaauacacaguuuaccgccguuggaaaggaguucaaccaccuugagaaaagaaucgagaaucugaacaagaaaguggaugacggcuuccucgauauuuggaccuacaaugcugaacugcugguccuccuggagaacgaacggacacuugacuaucaugauuccaaugugaagaaccuguacgagaaaguccgcagccaacucaagaacaaugccaaggagaucgggaacggauguuuugaguucuaucacaaaugcgacaauaccuguauggaaucugugaagaacggcacauacgauuaucccaaauacuccgaagaggccaagcugaauagagaagagaucgacgggguuaaacuugagagcacgcggauuuaucagauccuggcuauuuacucuaccguggccuccagccucguccuggugguuucccugggcgcgaucucuuuuuggaugugcagcaacggaucccuccagugccgcauuuguaucuga

SEQ ID NO: 188667 - RNA, 1701 nt, Artificial Sequence
  derived and/or modified sequence opt5 from hemagglutinin__InfluenzaA__ADM23846
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccauuucugacaacggcacgugcuauccgggggauuuuaucgacuacgaagaacugcgggagcagcuuagcuccgucagcucuuucgaacgcuuugagaucuuccccaagaccuccagcuggccuaaucacgauucuaacaagggagugacaaccgccuguccccaugcuggcgccaaauccuuuuauaagaaucugauuuggcucguuaaaaagggcaacagcuacccuaaacugucuaaguccuauaucaaugacaaggggaaagaagugcuuguccuguggggcauucaccaccccagcacauccgcggaucaacagucucucuaccagaacgccgacgcuuacguguucgugggaaccagcagauauuccaagaaauuuaagccugagaucgccauucggccgaaaguccgcgaucaggaggggagaaugaauuacuauuggacgcugguugaacccggagacaagaucacauucgaggcuaccggcaaccugguggugccucgguacgccuuugcgauggaacgcaacgccgggagcggaauuaucaucucugauacacccguccaugacugcaauaccaccugucaaacaccuaaaggcgcuauuaacacgucccuccccuuccagaauauccacccgauuaccaucggcaagugcccuaaguaugugaaaagcacaaagcugagacuugccaccgggcugcggaacguucccucuauucagagccgcggacucuuuggcgcuaucgccggguucaucgagggaggcuggacagggaugguggacggaugguacggcuaucaucaccagaaugaacaaggcuccggguacgccgcugaucugaaaucuacccagaacgcgauugacaagaucacgaauaaagucaacagcgugauugagaagaugaauacacaguuuaccgccguuggaaaggaguucaaccaccuugagaaaagaaucgagaaucugaacaagaaaguggaugacggcuuccucgauauuuggaccuacaaugcugaacugcugguccuccuggagaacgaacggacacuugacuaucaugauuccaaugugaagaaccuguacgagaaaguccgcagccagcucaagaacaaugccaaggagaucgggaacggauguuuugaguucuaucacaaaugcgacaauaccuguauggaaucugugaagaacggcacauacgauuauccuaaauacuccgaagaggccaagcugaauagagaagagaucgacgggguuaaacuugagagcacgcggauuuaucaaauccuggcuauuuacucuaccguggccuccagccucguccuggugguuucccugggcgcgaucucuuuuuggaugugcagcaacggaucccuccagugccgcauuuguaucuga

SEQ ID NO: 188668 - RNA, 1701 nt, Artificial Sequence
  derived and/or modified sequence opt5 from hemagglutinin__InfluenzaA__ADM23847
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccauuucugacaacggcacgugcuauccgggggauuuuaucgacuacgaagaacugcgggagcagcuuagcuccgucagcucuuucgaacgcuuugagaucuuccccaagaccuccagcuggccuaaucacgauucuaacaagggagugacaaccgccuguccccaugcuggcgccaaaggcuuuuauaagaaucugauuuggcucguuaaaaaggggaacuccuacccuaaacugagcaagucuuauaucaaugacaagggaaaagaagugcuuguccuguggggcauucaccaccaauccacaagcgcggaucagcagucccucuaccagaacgccgacgcuuacguguucguggggaccucuagauauagcaagaaauuuaagcccgagaucgccauucggccuaaaguccgcgaucaagagggaagaaugaauuacuauuggacgcugguugaaccgggcgacaagaucacauucgaggcuaccgggaaccugguggugccccgguacgccuuugcgauggaacgcaacgucggauccggcauuaucaucagcgauacaccugugcaugacugcaauaccaccugucagacacccaaaggcgccauuaacacgucucucccuuuccagaauauccaccccauuaccaucgggaagugcccgaaguauguuaaauccacaaagcugagacuugcuaccggacugcggaacgugccuagcauucagucucgcggccucuuuggggccaucgcuggauucaucgagggcggguggacaggaauggucgacggcugguacggcuaucaucaccaaaaugaacaggggagcggauacgccgccgaucugaaauccacccagaacgcuauugacaagaucacgaauaaagugaacucuguuauugagaagaugaauacacaguuuaccgcggugggcaaggaguucaaccaccuugagaaaagaaucgagaaucugaacaagaaagucgaugacggguuccucgauauuuggaccuacaaugccgaacugcuggugcuccuggagaacgaacggacacuugacuaucaugauagcaaugucaagaaccuguacgagaaagugcgcucccaacucaagaacaaugcuaaggagaucggaaacggcuguuuugaguucuaucacaaaugcgacaauaccuguauggaaagcguuaagaacgggacauacgauuaucccaaauacucugaagaggccaagcugaauagagaagagaucgacggcgugaaacuugaguccacgcggauuuaucagauccuggccauuuacagcaccgucgcuucuucccucgugcugguugugagccugggagccaucuccuuuuggaugugcucuaacggcagccuccagugccgcauuuguaucuga

SEQ ID NO: 188669 - RNA, 1701 nt, Artificial Sequence
  derived and/or modified sequence opt5 from hemagglutinin__InfluenzaA__ADM23849
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccaauccaccucugccgaucagcagagccucuaccagaacgcugacgccuacguguucgugggcacauccagauauagcaagaaauuuaagcccgagauugcuauccggccuaaaguccgcgaucaagaggggagaaugaauuacuauuggacccugguugaaccgggagacaagauuacguucgaggccacaggcaaccugguggugccccgguacgcguuugccauggaacgcaacgcugggucuggaaucauuaucuccgauaccccuguccaugacugcaauacaaccugucagacccccaaaggcgccaucaacacaagccucccuuuccagaauauucaccccaucacgauuggcaagugcccgaaguaugugaaaucuaccaagcugagacuugcuacagggcugcggaacguuccuagcauccagucccgcggacucuuuggcgccauugccggguucaucgagggaggcuggaccgggaugguggacggaugguacggcuaucaucaccaaaaugaacagggcucuggguacgcugcggaucugaaaagcacacagaacgccaucgacaagauuaccaauaaagucaacuccgugaucgagaagaugaauacgcaguuuacagcuguuggaaaggaguucaaccaccuugagaaaagaauugagaaucugaacaagaaaguggaugacggcuuccucgauaucuggaccuacaaugccgaacugcugguccuccuggagaacgaacggacccuugacuaucaugauagcaaugugaagaaccuguacgagaaaguccgcucucaacucaagaacaaugccaaggagauugggaacggauguuuugaguucuaucacaaaugcgacaauacauguauggaauccgugaagaacggcaccuacgauuaucccaaauacagcgaagaggcuaagcugaauagagaagagaucgacgggguuaaacuugagucuacacggaucuaucagauucuggccaucuacuccacgguggcgagcucccucguccuggugguuucucugggcgcuauuagcuuuuggaugugcuccaacggaucucuccagugccgcaucuguauuuga

SEQ ID NO: 188670 - RNA, 1701 nt, Artificial Sequence
  derived and/or modified sequence opt5 from hemagglutinin__InfluenzaA__ADM23851
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaagcacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccaauccaccucugccgaucagcagagccucuaccagaacgcugacgccuacguguucgugggcuccagcagauauucuaaaaaguuuaaacccgagauugcuauccggccuaagguccgcgaucaagaagggagaaugaauuacuauuggacacugguugagccgggagacaaaauuaccuucgaagccacgggcaaccugguggugccccgguacgcguuugccauggagcgcaacgcuggguccggaaucauuaucagcgauacaccuguccaugacugcaauaccacaugucagacccccaagggcgccaucaacaccucucucccuuuccacaauauucaucccaucacaauuggcaaaugcccgaaguauguuaagagcacgaaacugagacuugcuaccgggcugcggaacgugccuuccauccagucucgcggacucuuuggcgccauugccggguucaucgaaggaggcuggacagggaugguggacggaugguacggcuaucaccaccagaaugagcaaggcagcggguacgcugcggaucugaaguccacccagaacgccaucgacgagauuacaaauaaagucaacagcgugaucgaaaagaugaauacccaguuuacggcuguuggaaaagaguucaaccaucuugaaaagagaauugagaaucugaacaagaaaguggaugacggcuuccucgauaucuggacauacaaugccgaacugcugguccuccuggagaacgagcggacccuugacuaucacgauucuaaugugaagaaccuguacgaaaaaguccgcucccagcucaagaacaaugccaaagagauugggaacggauguuuugaguucuaucauaagugcgacaauaccuguauggaaagcgugaagaacggcacauacgauuaucccaaauacucugaagaggcuaagcugaauagagagaaaaucgacgggguuaaacuugaauccacccggaucuaucaaauucuggccaucuacagcacaguggcguccucucucguccuggugguuagccugggcgcuauuuccuuuuggaugugcucuaacggaagccuccagugccgcaucuguauuuga

SEQ ID NO: 188671 - RNA, 1701 nt, Artificial Sequence
  derived and/or modified sequence opt5 from hemagglutinin__InfluenzaA__ADM23852
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaagcacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagagccucuaccagaacgcugacgccuacguguucgugggcuccagcagauauucuaaaaaguuuaaaccugagauugcuauccggccgaagguccgcgaucaggaagggagaaugaauuacuauuggacacugguugagcccggagacaaaauuaccuucgaagccacgggcaaccugguggugccucgguacgcguuugccauggagcgcaacgcuggguccggaaucauuaucagcgauacacccguccaugacugcaauaccacaugucaaaccccuaagggcgccaucaacaccucucuccccuuccacaauauucauccgaucacaauuggcaaaugcccuaaguauguuaagagcacgaaacugagacuugcuaccgggcugcggaacgugcccuccauccagucucgcggacucuuuggcgccauugccggguucaucgaaggaggcuggacagggaugguggacggaugguacggcuaucaccaccagaaugagcagggcagcggguacgcugcggaucugaaguccacccaaaacgccaucgacgagauuacaaauaaagucaacagcgugaucgaaaagaugaauacccaguuuacggcuguuggaaaagaguucaaccaucuugaaaagagaauugagaaucugaacaagaaaguggaugacggcuuccucgauaucuggacauacaaugccgaacugcugguccuccuggagaacgagcggacccuugacuaucacgauucuaaugugaagaaccuguacgaaaaaguccgcucccagcucaagaacaaugccaaagagauugggaacggauguuuugaguucuaucauaagugcgacaauaccuguauggaaagcgugaagaacggcacauacgauuauccuaaauacucugaagaggcuaagcugaauagagagaaaaucgacgggguuaaacuugaauccacccggaucuaucagauucuggccaucuacagcacaguggcguccucucucguccuggugguuagccugggcgcuauuuccuuuuggaugugcucuaacggaagccuccaaugccgcaucuguauuuga

SEQ ID NO: 188672 - RNA, 1701 nt, Artificial Sequence; identical to SEQ ID NO: 188671
  derived and/or modified sequence opt5 from hemagglutinin__InfluenzaA__ADM23853

SEQ ID NO: 188673 - RNA, 1701 nt, Artificial Sequence; identical to SEQ ID NO: 185935
  derived and/or modified sequence opt5 from hemagglutinin__InfluenzaA__ADM23855

SEQ ID NO: 188674 - RNA, 1701 nt, Artificial Sequence
  derived and/or modified sequence opt5 from hemagglutinin__InfluenzaA__ADM23856
augaaggccauccuggugguccuccuguacaccuucgcuacaguuaacgccgacacgcuuugcauuggcuaucacgcgaauaacagcaccgauacaguggacaccgugcuggagaaaaaugucacagugacccauuccguuaaccuccuggaagauaagcacaaugggaaacuuuguaagcugagaggaguggcuccccuccaucugggcaaaugcaacaucgccggguggauucugggaaauccugagugugaaucucucagcacagccuccucuuggagcuacaucgucgagaccuccucuagcgacaacggcacgugcuauccgggggauuuuauugacuacgaggagcugcgggagcagcuuuccagcgugucuuccuucgaacgcuuugagaucuuccccaagaccagcucuuggccuaaucacgauuccaacaagggaguuacagcugccuguccccaugcuggcgccaagagcuuuuauaaaaaucugaucuggcucgugaaaaagggcaacucuuacccuaaacuguccaagagcuauauuaaugacaagagaaaagaaguccuugugcugugggggauccaccaccaauccaccucugcggaucagcagagccucuaccagaacgccgacgcuuacguguucgucggaacaucccgguauagcaagaaauuuaagcccgagauugccauccgcccuaaaguuagagaucaagagggccggaugaauuacuauuggacccugguggaaccgggggacaagauuacguucgaggcuacaggaaaccugguggucccccgcuacgccuuugcgauggaaagaaacgccggcucugggaucauuaucuccgauaccccugugcaugacugcaauacaaccugucagacccccaaaggagcuaucaacacaagccucccuuuccagaauauucaccccaucacgauuggcaagugcccgaaguauguuaaaucuaccaagcugcggcuugccacaggccugcgcaacgugccuagcauccaguccagagggcucuuuggagcuauugccggcuucaucgaagggggauggaccggcauggucgacgggugguacggauaucaucaccaaaaugaacagggcucuggcuacgccgcugaucugaaaagcacacagaacgcgaucgacaagauuaccaauaaagugaacuccguuaucgagaagaugaauacgcaguuuacagccguggggaaggaguucaaccaccuugaaaaacggauugagaaucugaacaagaaagucgaugacggauuccucgauaucuggaccuacaaugcugaacugcuggugcuccuggagaacgaacgcacccuugacuaucaugauagcaaugucaagaaccuguacgagaaagugagaucucaacucaagaacaaugccaaggagauuggcaacggguguuuugaguucuaucacaaaugcgacaauacauguauggaauccguuaagaacggaaccuacgauuaucccaaauacagcgaagaggccaagcugaaucgggaagagaucgacggcgugaaacuugagucuacacgcaucuaucagauucuggcuaucuacuccacggucgccagcucccucgugcugguugugucucugggggcgauuagcuuuuggaugugcuccaacggcucucuccagugcagaaucuguauuuga

SEQ ID NO: 188675 - RNA, 1701 nt, Artificial Sequence; identical to SEQ ID NO: 185693
  derived and/or modified sequence opt5 from hemagglutinin__InfluenzaA__ADM25945

SEQ ID NO: 188676 - RNA, 1701 nt, Artificial Sequence; identical to SEQ ID NO: 185935
  derived and/or modified sequence opt5 from hemagglutinin__InfluenzaA__ADM25948

SEQ ID NO: 188677 - RNA, 1701 nt, Artificial Sequence; identical to SEQ ID NO: 187722
  derived and/or modified sequence opt5 from hemagglutinin__InfluenzaA__ADM26264

SEQ ID NO: 188678 - RNA, 1701 nt, Artificial Sequence; identical to SEQ ID NO: 187722
  derived and/or modified sequence opt5 from hemagglutinin__InfluenzaA__ADM26265

SEQ ID NO: 188679 - RNA, 1701 nt, Artificial Sequence; identical to SEQ ID NO: 187722
  derived and/or modified sequence opt5 from hemagglutinin__InfluenzaA__ADM26266

SEQ ID NO: 188680 - RNA, 1701 nt, Artificial Sequence; identical to SEQ ID NO: 187722
  derived and/or modified sequence opt5 from hemagglutinin__InfluenzaA__ADM26267

SEQ ID NO: 188681 - RNA, 1701 nt, Artificial Sequence
  derived and/or modified sequence opt5 from hemagglutinin__InfluenzaA__ADM26268
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaaaaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgagcaggaagggagaaugaauuacuauuggacgcugguugagcccggagauaagauuacauucgaagcuaccggcaaccugguggugccucgguacgccuuugcgauggagcgcaacgccgggucuggaaucauuaucuccgacacacccguccaugauugcaauaccaccugucaaacaccuaaaggcgcuaucaacacgagccuccccuuccagaauauucacucuaucaccauuggcaagugcccgaaguaugugaaaagcacaaagcugagacuugccaccgggcugcggaacguuccuuccauccagucucgcggacucuuuggcgcuauugccggguucaucgaaggaggcuggacagggaugguggacggaugguacggcuaucaucaccagaaugagcaaggcagcggguacgccgcugaccugaaauccacccagaacgcgaucgaugagauuacgaauaaggucaacagcgugaucgagaaaaugaauacacaguuuaccgccguuggaaaggaguucaaccaccuugaaaagagaauugagaaucugaacaaaaagguggacgauggcuuccucgacaucuggaccuacaaugcugaacugcugguccuccuggagaacgagcggacacuugauuaucaugacucuaaugugaaaaaccuguacgaaaagguccgcucccagcucaaaaacaaugccaaggagauugggaacggauguuuugaguucuaucacaagugcgauaauaccuguauggaaagcgugaaaaacggcacauacgacuaucccaaguacucugaagaggccaaacugaagagagaggaaaucgaugggguuaaacuugaguccacgcggaucuaucaaauucuggcuaucuacagcaccguggccuccucucucguccuggugguuagccugggcgcgauuuccuuuuggaugugcucuaauggaagccuccagugccgcaucuguauuuga

SEQ ID NO: 188682 - RNA, 1701 nt, Artificial Sequence
  derived and/or modified sequence opt5 from hemagglutinin__InfluenzaA__ADM26269
augaagaccauccuggugguccuccuguacacauucacgaccgccaacgcugacacacuuugcauuggcuaucacgccaauaacagcaccgauacaguugacaccgugcuggagaaaaaugugacagucacccauuccgugaaccuccuggaagauaagcacaaugggaaacuuuguaagcugagaggaguugcgccccuccaucugggcaaaugcaacaucgcuggguggauucugggaaauccugagugugaaucucucagcacggccuccucuuggagcuacaucguggagaccuccucuagcgacaacggcacaugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcuaagagcuuuuauaaaaaucugaucuggcucguuaaaaagggcaacucuuacccuaaacuguccaagagcuauauuaaugacaaggggaaagaagugcuuguccuguggggaauccaccaccccuccaccucugccgaucaacagagccucuaccagaacgcggacgccuacguguucgugggcacguccagauauagcaagaaauuuaagccugagauugcuauccggccgaaaguccgcgagcaggaagggagaaugaauuacuauuggacacugguugagcccggagauaagauuaccuucgaagccacaggcaaccugguggugccucgguacgcuuuugccauggagcgcaacgcggggucuggaaucauuaucuccgacacccccguccaugauugcaauaccacaugucaaacgccuaaaggcgccaucaacaccagccuccccuuccagaauauucacucuaucacaauuggcaagugcccgaaguaugugaaaagcaccaagcugagacuugcuacagggcugcggaacguuccuuccauccagucucgcggacucuuuggcgccauugcuggguucaucgaaggaggcuggaccgggaugguggacggaugguacggcuaucaucaccagaaugagcaaggcagcggguacgccgccgaccugaaauccacgcagaacgcuaucgaugagauuacaaauaaggucaacagcgugaucgagaaaaugaauacccaguuuaccgcgguuggaaaggaguucaaccaccuugaaaagagaauugagaaucugaacaaaaagguggacgauggcuuccucgacaucuggacauacaaugccgaacugcugguccuccuggagaacgagcggacccuugauuaucaugacucuaaugugaaaaaccuguacgaaaagguccgcucccagcucaaaaacaaugcuaaggagauugggaacggauguuuugaguucuaucacaagugcgauaauacauguauggaaagcgugaaaaacggcacguacgacuaucccaaguacucugaagaggccaaacugaagagagaggaaaucgaugggguuaaacuugaguccacccggaucuaucaaauucuggccaucuacagcacaguggcuuccucucucguccuggugguuagccugggcgccauuuccuuuuggaugugcucuaauggaagccuccagugccgcaucuguauuuga

SEQ ID NO: 188683 - RNA, 1701 nt, Artificial Sequence
  derived and/or modified sequence opt5 from hemagglutinin__InfluenzaA__ADM26270
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgagcaggaagggagaaugaauuacuauuggacgcugguugagcccggagauaagauuacauucgaagcuaccggcaaccugguggugccucgguacgccuuugcgauggagcgcaacgccgggucuggaaucauuaucuccgacacacccguccaugauugcaauaccaccugucaaacaccuaaaggcgcuaucaacacgagccuccccuuccagaauauucacucuaucaccauuggcagaugcccgaaguaugugaaaagcacaaaacugcggcuugccaccgggcugcgcaacguuccuuccauccagucuagaggacucuuuggcgcuauugccggguucaucgaaggaggcuggacagggaugguggacggaugguacggcuaucaucaccagaaugagcaaggcagcggguacgccgcugaccugaaguccacccagaacgcgaucgaugagauuacgaauaaagucaacagcgugaucgaaaagaugaauacacaguuuaccgccguuggaaaagaguucaaccaccuugaaaagcggauugagaaucugaacaagaaaguggacgauggcuuccucgacaucuggaccuacaaugcugaacugcugguccuccuggagaacgagcgcacacuugaucaucacgacucuaaugugaagaaccuguaugaaaaagucagaucccagcucaagaacaaugccaaagagauugggaacggauguuuugaguucuaccauaagugcgauaauaccuguauggagagcgugaagaacggcacauaugacuaccccaaauauucugaagaggccaagcugaaucgggaggaaaucgaugggguuaaacuugaguccacgcgcaucuaccaaauucuggcuaucuauagcaccguggccuccucucucguccuggugguuagccugggcgcgauuuccuuuuggaugugcucuaacggaagccuccagugcagaaucuguauuuga

SEQ ID NO: 188684 - RNA, 1701 nt, Artificial Sequence; identical to SEQ ID NO: 187722
  derived and/or modified sequence opt5 from hemagglutinin__InfluenzaA__ADM26271

SEQ ID NO: 188685 - RNA, 1701 nt, Artificial Sequence
  derived and/or modified sequence opt5 from hemagglutinin__InfluenzaA__ADM26272
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgagcaggaagggagaaugaauuacuauuggacgcugguugagcccggagauaagauuacauucgaagcuaccggcaaccugguggugccucgguacgccuuugcgauggagcgcaacgccgggucuggaaucauuaucuccgacacacccguccaugauugcaauaccaccugucaaacaccuaaaggcgcuaucaacacgagccuccccuuccagaauauucacucuaucaccauuggcagaugcccgaaguaugugaaaagcacaaaacugcggcuugccaccgggcugcgcaacguuccuuccauccagucuagaggacucuuuggcgcuauugccggguucaucgaaggaggcuggacagggaugguggacggaugguacggcuaucaucaccagaaugagcaaggcagcggguacgccgcugaccugaaguccacccagaacgcgaucgaugagauuacgaauaaagucaacagcgugaucgaaaagaugaauacacaguuuaccgccguuggaaaagaguucaaccaccuugaaaagcggauugagaaucugaacaagaaaguggacgauggcuuccucgacaucuggaccuacaaugcugaacugcugguccuccuggagaacgagcgcacacuugauuaucaugacucuaaugugaagaaccuguacgaaaaagucagaucccagcucaagaacaaugccaaagagauugggaacggauguuuugaguucuaucacaagugcgauaauaccuguauggagagcgugaagaacggcacauacgacuaucccaaauacucugaagaggccaagcugaaucgggaggaaaucgaugggguuaaacuugaguccacgcgcaucuaucaaauucuggcuaucuacagcaccguggccuccucucucguccuggugguuagccugggcgcgauuuccuuuuggaugugcucuaacggaagccuccagugcagaaucuguauuuga

SEQ ID NO: 188686 - RNA, 1701 nt, Artificial Sequence
  derived and/or modified sequence opt5 from hemagglutinin__InfluenzaA__ADM26274
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgagcaggaagggagaaugaauuacuauuggacgcugguugagcccggagauaagauuacauucgaagcuaccggcaaccugguggugccucgguacgccuuugcgauggagcgcaacgccgggucuggaaucauuaucuccgacacacccguccaugauugcaauaccaccugucaaacaccuaaaggcgcuaucaacacgagccuccccuuccagaauauucacucuaucaccauuggcaagugcccgaaguaugugaaaagcacaaagcugagacuugccaccgggcugcggaacguuccuuccauccagucucgcggacucuuuggcgcuauugccggguucaucgaaggaggcuggacagggaugguggacggaugguacggcuaucaucaccagaaugagcaaggcagcggguacgccgcugaccugaaauccacccagaacgcgaucgaugagauuacgaauaaggucaacagcgugaucgagaaaaugaauacacaguuuaccgccguuggaaaggaguucaaccaccuugaaaagagaauugagaaucugaacaaaaagguggacgauggcuuccucgacaucuggaccuacaaugcugaacugcugguccuccuggagaacgagcggacacuugauuaucaugacucuaaugugaaagaucuguacgaaaagguccgcucccagcucaaaaacaacgccaaggagauugggaauggauguuuugaguucuaucacaagugcgacaacaccuguauggaaagcgugaaaaauggcacauacgauuaucccaaguacucugaagaggccaaacugaacagagaggaaaucgacgggguuaaacuugaguccacgcggaucuaucaaauucuggcuaucuacagcaccguggccuccucucucguccuggugguuagccugggcgcgauuuccuuuuggaugugcucuaauggaagccuccagugccgcaucuguauuuga

SEQ ID NO: 188687 - RNA, 1701 nt, Artificial Sequence; identical to SEQ ID NO: 187722
  derived and/or modified sequence opt5 from hemagglutinin__InfluenzaA__ADM26276

SEQ ID NO: 188688 - RNA, 1701 nt, Artificial Sequence
  derived and/or modified sequence opt5 from hemagglutinin__InfluenzaA__ADM26277
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgagcaggaagggagaaugaauuacuauuggacgcugguugagcccggagauaagauuacauucgaagcuaccggcaaccugguggugccucgguacgccuuugcgauggagcgcaacgccgggucuggaaucauuaucuccgacacacccguccaugauugcaauaccaccugucaaacaccuaaaggcgcuaucaacacgagccuccccuuccagaauauucacucuaucaccauuggcaagugcccgaaguaugugaaaagcacaaagcugagacuugccaccgggcugcggaacguuccuuccauccagucucgcggacucuuuggcgcuauugccggguucaucgaaggaggcuggacagggaugguggacggaugguacggcuaucaucaccagaaugagcaaggcagcggguacgccgcugaccugaaauccacccagaacgcgaucgaugagauuacgaauaaggucaacagcgugaucgagaaaaugaauacacaguuuaccgccguuggaaaggaguucaaccaccuugaaaagagaauugagaaucugaacaaaaagguggacgauggcuuccucgacaucuggaccuacaaugcugaacugcugguccuccuggagaacgagcggacacuugauuaucaugacucuaaugugaaaaaccuguacgaaaagguccgcucccagcucaaaaacaaugccaaggagauugggaacggauguuuugaguucuaucacaagugcgauaauaccuguauggaaagcgugaaaaacggcacauacgacuaucccaaguacucugaagaggccaaacugaauagagaggaaaucgaugggguuaaacuugaguccacgcggaucuaucaaauucuggcuaucuacagcaccguggccuccucucucguccugauugugagccugggcgcgaucuccuuuuggaugugcucuaacggaagccuccagugccgcauuuguaucuga

SEQ ID NO: 188689 - RNA, 1701 nt, Artificial Sequence
  derived and/or modified sequence opt5 from hemagglutinin__InfluenzaA__ADM26278
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaaaaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguccgugggcaccagcagauauucuaagaaauucaagccugagauugccauccggccgaaaguccgcgagcaggaagggagaaugaauuacuauuggacgcugguugagcccggagauaagauuacauuugaagcuaccggcaaccugguggugccucgguucgccuuugcgauggagcgcaacgccggguccggaaucauuaucagcgacacacccguccaugauugcaauaccaccugucaaacaccuaaaggcgcuaucaacacgucucuccccuuccagaauauucacagcaucaccauuggcaagugcccgaaguacgugaaauccacaaagcugagacuugccaccgggcugcggaacguuccuucuauccagagccgcggacucuuuggcgcuauugccggguucaucgaaggaggcuggacagggaugguggacggaugguauggcuaccaucaccagaaugagcaaggcuccggguaugccgcugaccugaaaagcacccagaacgcgaucgaugagauuacgaauaaggucaacucugugaucgagaaaaugaauacacaguuuaccgccguuggaaaggaguucaaccaccuugaaaagagaauugagaaucugaacaaaaagguggacgauggcuuccucgacaucuggaccuacaaugcugaacugcugguccuccuggagaacgagcggacacuugauuaccaugacuccaaugugaaaaaccuguaugaaaagguccgcagccagcucaaaaacaaugccaaggagauugggaacggauguuuugaguucuaccacaagugcgauaauaccuguauggaaucugugaaaaacggcacauaugacuaccccaaguauuccgaagaggccaaacugaagagagaggaaaucgaugggguuaaacuugagagcacgcggaucuaccaaauucuggcuaucuauuccaccguggccucuagccucguccuggugguuucccugggcgcgauuucuuuuuggaugugcagcaauggaucccuccagugccgcaucuguauuuga

SEQ ID NO: 188690 - RNA, 1701 nt, Artificial Sequence
  derived and/or modified sequence opt5 from hemagglutinin__InfluenzaA__ADM26279
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgggcaggagggaagaaugaauuacuauuggacgcugguugaacccggcgauaagauuacauucgaggcuaccgggaaccugguggugccucgguacgccuuugcgauggaacgcaacgccggaucuggcaucauuaucuccgacacacccguccaugauugcaauaccaccugucaaacaccuaaaggcgcuaucaacacgagccuccccuuccagaauauucacucuaucaccauugggaagugcccgaaguaugugaaaagcacaaagcugagacuugccaccggacugcggaacguuccuuccauccagucucgcggccucuuuggggcuauugccggauucaucgagggcggguggacaggaaugguggacggcugguacggcuaucaucaccagaaugaacaagggagcggauacgccgcugaccugaaauccacccagaacgcgaucgaugagauuacgaauaaggucaacagcgugaucgagaaaaugaauacacaguuuaccgccguuggcaaggaguucaaccaccuugagaagagaauugaaaaucugaacaaaaagguggacgauggguuccucgacaucuggaccuacaaugcugagcugcugguccuccuggaaaacgagcggacacuugauuaucaugacucuaaugugaaaaaccuguacgagaagguccgcucccagcucaaaaacaaugccaaggaaauuggaaacggcuguuuugaguucuaucacaagugcgauaauaccuguauggaaagcgugaaaaacgggacauacgacuaucccaaguacucugaggaagccaaacugaauagagaggagaucgauggcguuaaacuugaauccacgcggaucuaucaaauucuggcuaucuacagcaccguggccuccucucucguccuggugguuagccugggagcgauuuccuuuuggaugugcucuaacggcagccuccagugccgcaucuguauuuga

SEQ ID NO: 188691 - RNA, 1701 nt, Artificial Sequence; identical to SEQ ID NO: 187722
  derived and/or modified sequence opt5 from hemagglutinin__InfluenzaA__ADM26280

SEQ ID NO: 188692 - RNA, 1701 nt, Artificial Sequence
  derived and/or modified sequence opt5 from hemagglutinin__InfluenzaA__ADM26281
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagucuauucacccgaucacgauuggcaagugcccuaaguaugugaaaagcaccaagcugagacuugcuacagggcugcggaauguucccuccauccagucucgcggacucuuuggcgccauugccggguucaucgagggaggcuggaccgggaugguggacggaugguacggcuaucaucaccagaacgaacaaggcagcggguacgcugcggaucugaaauccacacagaaugccaucgacaagauuaccaacaaagucaauagcgugaucgagaagaugaacacgcaguuuacagcuguuggaaaggaguucaaucaccuugaaagacggauugagaaccugaauaaaaagguggaugacggcuuccucgauaucuggaccuacaacgccgaacugcugguccuccuggagaaugaacgcacccuugacuaucaugauucuaacgugaaaaaucuguacgagaaggucagaucccagcucaaaaacaacgccaaggagauugggaauggauguuuugaguucuaucacaagugcgacaacacauguauggagagcgugaaaaauggcaccuacgauuauccuaaguacucugaagaggcuaaacugaaccgggaagagaucgacgggguuaaacuugaguccacacgcguguaucaaauccuggccauuuacagcacggucgcguccucucucgugcugguugugagccugggcgcuaucuccuuuuggaugugcucuaauggaagccuccagugcagaauuuguaucuga

SEQ ID NO: 188693 - RNA, 1701 nt, Artificial Sequence
  derived and/or modified sequence opt5 from hemagglutinin__InfluenzaA__ADM26282
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaaaaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgagcaggaagggagaaugaauuacuauuggacgcugguugagcccggagauaagauuacauucgaagcuaccggcaaccugguggugccucgguacgccuuugcgauggagcgcaacgccgggucuggaaucauuaucuccgacacacccguccaugauugcaauaccaccugucaaacaccuaaaggcgcuaucaacacgagccuccccuuccagaauauucacucuaucaccauuggcaagugcccgaaguaugugaaaagcacaaagcugagacuugccaccgggcugcggaacguuccuuccauccagucucgcggacucuuuggcgcuauugccggguucaucgaaggaggcuggacagggaugguggacggaugguacggcuaucaucaccagaaugagcaaggcagcggguacgccgcugaccugaaauccacccagaacgcgaucgaugagauuacgaauaaggucaacagcgugaucgagaaaaugaauacacaguuuaccgccguuggaaaggaguucaaccaccuugaaagacggauugagaaucugaacaagaaaguggacgauggcuuccucgacaucuggaccuacaaugcugaacugcugguccuccuggagaacgagcgcacacuugauuaucaugacucuaaugugaagaaccuguacgaaaaagucagaucccagcucaagaacaaugccaaagagauugggaacggauguuuugaguucuaucacaagugcgauaauaccuguauggaaagcgugaagaacggcacauacgacuaucccaaauacucugaagaggccaagcugaaucgggaggaaaucgaugggguuaaacuugaguccacgcgcaucuaucaaauucuggcuaucuacagcaccguggccuccucucucguccuggugguuagccugggcgcgauuuccuuuuggaugugcucuaacggaagccuccagugcagaaucuguauuuga

SEQ ID NO: 188694 - RNA, 1701 nt, Artificial Sequence
  derived and/or modified sequence opt5 from hemagglutinin__InfluenzaA__ADM26283
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaaaaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgagcaggaagggagaaugaauuacuauuggacgcugguugagcccggagauaagauuacauucgaagcuaccggcaaccugguggugccucgguacgccuuugcgauggagcgcaacgccgggucuggaaucauuaucuccgacacacccguccaugauugcaauaccaccugucaaacaccuaaaggcgcuaucaacacgagccuccccuuccagaauauucacucuaucaccauuggcaagugcccgaaguaugugaaaagcacaaagcugagacuugccaccgggcugcggaacguuccuuccauccagucucgcggacucuuuggcgcuauugccggguucaucgaaggaggcuggacagggaugguggacggaugguacggcuaucaucaccagaaugagcaaggcagcggguacgccgcugaccugaaauccacccagaacgcgaucgaugagauuacgaauaaggucaacagcgugaucgagaaaaugaauacacaguuuaccgccguuggaaaggaguucaaccaccuugaaaagagaauugagaaucugaacaaaaagguggacgauggcuuccucgacaucuggaccuacaaugcugaacugcugguccuccuggagaacgagcggacacuugauuaucaugacucuaaugugaaaaaccuguacgaaaagguccgcucccagcucaaaaacaaugccaaggagauugggaacggauguuuugaguucuaucacaagugcgauaauaccuguauggaaagcgugaaaaacggcacauacgacuaucccaaguacucugaagaggccaaacugaauagagagaagaucgaugggguuaaacuugaauccacgcggaucuaucaaauucuggcuaucuacagcaccguggccuccucucucguccuggugguuagccugggcgcgauuuccuuuuggaugugcucuaacggaagccuccagugccgcaucuguauuuga

SEQ ID NO: 188695 - RNA, 1701 nt, Artificial Sequence; identical to SEQ ID NO: 187722
  derived and/or modified sequence opt5 from hemagglutinin__InfluenzaA__ADM26284

SEQ ID NO: 188696 - RNA, 1701 nt, Artificial Sequence; identical to SEQ ID NO: 187722
  derived and/or modified sequence opt5 from hemagglutinin__InfluenzaA__ADM26285

SEQ ID NO: 188697 - RNA, 1701 nt, Artificial Sequence
  derived and/or modified sequence opt5 from hemagglutinin__InfluenzaA__ADM26784
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcaugcgcagaucuaacaauuccuuuuucagccggcugaacuggcucacacaucugaaguuuaaguauccugcccuuaaugucaccaugcccaacaacgagcaguucgacaaacuguacaucuggggcgugcaccauccugggacggauaaugaccagauuuuucucuaugcgcaagccucuggacgcaucacaguuuccaccaagagaagccagcagacagugauuccgaacaucggcucccggccccgcgucagaaauauuccuucucggaucagcaucuacuggaccauugugaaacccggggauauccugcugauuaacuccaccggaaaucucaucgcuccucgcggcuacuucaagauuagaagcgggaaaucuuccaucaugcggagcgacgcccccaucggaaaguguaacucugaaugcauuacaccgaauggcagcaucccuaacgacaagcccuuucagaaugugaaccgcauuacguauggcgcuuguccuagauacgucaaacaaaauacccugaaacuugccacagggaugcggaacguucccgagaagcagacccgcggaaucuucggcgcgauugccggguuuaucgaaaauggaugggagggcaugguggaugggugguauggauucagacaccagaacuccgagggccggggccaagcugccgaccugaagucuacacaggcugccaucgaucagauuaaugggaaacucaacagacugaucggaaagaccaacgaaaaauuccaccagauugagaaggaauuuagcgagguggaaggccgcauccaagaccuugagaaguacgucgaggauacgaaaauugaccugugguccuauaaugccgaacuccugguggcucuggagaaccagcauacaaucgaucucaccgacagcgaaaugaauaagcuguucgagaaaaccaagaaacagcuucgggaaaacgcggaggauauggggaauggaugcuuuaagauuuaccacaagugugacaacgccugcaucggcucuaucagaaaugggacauaugaucaugacguuuaccgcgacgaggcucugaacaaucgguuccagauuaaaggcguggaacucaaguccggauacaaagauuggauccuguggauuagcuuugccaucucuugcuuccuucugugugucgcccuccugggcuuuauuaugugggcuugccaaaaggggaacaucagauguaauaucugcauuuga

SEQ ID NO: 188698 - RNA, 1701 nt, Artificial Sequence; identical to SEQ ID NO: 185458
  derived and/or modified sequence opt5 from hemagglutinin__InfluenzaA__ADM26795

SEQ ID NO: 188699 - RNA, 1701 nt, Artificial Sequence
  derived and/or modified sequence opt5 from hemagglutinin__InfluenzaA__ADM26817
augaagaccacaaucgcccugagccacauucucugccugguguucgcucagaaacuucccggcaacgacaauuccacggccacccugugucucgggcaucacgcggucccuaacggaacaaucguuaagaccauuacaaaugaucaaaucgaggugaccaacgcuacagaacuggugcagucuagcuccgccggcgagauuugcgacucuccgcaucagauccuugauggggaaaauuguacccugaucgacgcccuccugggagauccccagugcgacggcuuucaaaacaaaaagugggaucuguucgucgagagacggcgcgcuuacagcaauuguuauccuuacgacgugcccgauuaugccucccucagaucucugguugcuagcuccgggacgcuugaauuuaacaaugagagcuucaacuggaccggagugacacagaauggcaccucuuccgccugcauucggcgcagcaacaauagcuuuuucuccagacugaacuggcucacacaccugaauuuuaaauacccugcgcuuaacgucaccaugcccaacaaugagcaguucgacaagcuguauaucuggggcgugcaucacccugggacggauaaggaccagauuuuucucuacgcccaagcuagcggacggaucacaguuucuaccaaacgcucccagcaggccgugauuccgaacaucggcagcagaccccggguccgcaauauuccuuccagaaucucuaucuauuggacaauugugaagcccggggauauccugcugauuaacagcaccggaaaucucaucgcuccucggggcuacuucaaaauucgcuccgggaagucuucuaucaugagauccgacgcccccaucggaaaauguaacagcgaaugcauuaccccgaauggcucuaucccuaacgacaagcccuuucagaaugugaaccggauuacauacggcgcguguccucgcuaugucaagcaaagcacgcugaaacuugccaccgggaugagaaauguucccgagaagcagacacggggaaucuucggcgcuauugccggguuuaucgaaaacggaugggagggcaugguggaugggugguacggauucagacaccaaaauuccgagggccgcggccaggcugccgaccugaaaucuacccaggccgcuaucgaucagauuaacgggaagcucaaucggcugaucggaaaaacaaacgaaaaguuccaucagauugagaaagaauuuagcgagguggaaggcagaauccaagaccuugagaaguaugucgaggauaccaagauugaccugugguccuacaacgcggaacuccugguggcccuggagaaucagcacacgaucgaucucacagacagcgaaaugaacaaacuguucgagaagaccaaaaagcagcuucgcgaaaaugcugaggauauggggaacggaugcuuuaaaauuuaucauaagugugacaaugccugcaucggcucuauccggaacgggaccuacgaucacgacguuuauagagacgaggcccugaauaaccgcuuccagauuaagggcguggaacucaaauccggauacaaggauuggauccuguggauuagcuuugcuaucucuugcuuccuucugugugucgcccuccugggcuuuauuaugugggcgugccaaaaagggaauauccgguguaacaucugcauuuga

SEQ ID NO: 188700 - RNA, 1704 nt, Artificial Sequence
  derived and/or modified sequence opt5 from hemagglutinin__InfluenzaA__ADM31424
auggagaagaucgugcugcuguucaccacaauuagccuggucaaauccgaccacaucugcauuggcuaccaugccaacaauucuacggaacagguugauaccaucauggagaagaacgugacagugacccacgcucaagacauucuugagaaaacacauaaugggaagcugugugaucucaacggagucaaaccccugauccuuaaggacugcagcguggccggcuggcugcucgggaauccucugugugaugaauuuaucaacguuccggaaugguccuauauuguggagaaggcgaaucccgcuaacgaccugugcuacccuggaaauuucaacgauuaugaggaacucaaacaccuccuuucuagaaucaaucauuuugagaagauucagaucauucccaaagacagcugguccgaucacgaagccucucugggcgucagcgccgcuuguuccuaccaggggaacagcucuuucuuucggaaugugguuuggcucaucaagaaagacaacgccuauccuaccauuaagaaggauuacaauaacacaaaccaggaggaccugcuugugcuguggggaauccaccaucccaaugaugaggcugaacaaacccgccucuaucagaacccuacgaccuacaucuccauuggcacaagcacccugaaucagagacuggucccgaaaaucgccacacggucuaagauuaacggccaguccgggcgcaucgacuucuuuuggaccauucucaaacccaaugacgcgauccacuucgagagcaacggaaauuuuaucgccccugaauacgcuuauaagauugugaaaaagggcgauucuacgaucaugaaauccgagguggaauacgggaacugcaauacaagaugucaaacccccauuggagccaucaacagcuccaugccuuuccauaauauucacccccugacaaucggcgagugcccgaaguaugucaagucuaacaaacuuguucuggcuaccgggcuccggaauagcccucagcgcgagagacggcgcaagagaggacuguuuggcgccaucgcgggcuucauugaagggggauggcagggcaugguggacgggugguacggauaucaccauuccaacgagcagggcagcggguacgccgcugauaaagaaucuacccaaaaggccaucgacggagugacaaauaaagucaacuccauuaucgauaagaugaacacgcaguuugaggcugugggccgggaguucaauaaccuugaacgcagaauugagaaucugaacaagaaaauggaagacggcuuccucgauguuuggaccuauaaugccgagcugcuggugcucauggaaaacgagcggacacuggacuuucacgauagcaaugucaagaaccuuuacgacaaagugcgccugcagcucaaggauaaugccaaagaacuggggaacggauguuucgaguuuuaccauaagugcaauaacgaguguauggaaucuguuagaaauggcaccuaugacuacccccaauauagcgaggaagcucggcuuaagagagaggagaucuccggggugaaacuggaaucuauuggaaucuaccagauccucagcauuuauuccacagucgcgagcucucuggugcuggccaucaugauggcuggccucucccuguggaugugcagcaacgggucucuucagugccgcauuuguaucuga

SEQ ID NO: 188701 - RNA, 1701 nt, Artificial Sequence; identical to SEQ ID NO: 188294
  derived and/or modified sequence opt5 from hemagglutinin__InfluenzaA__ADM31478

SEQ ID NO: 188702 - RNA, 1701 nt, Artificial Sequence
  derived and/or modified sequence opt5 from hemagglutinin__InfluenzaA__ADM31488
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggauccagcaaguauucuaaaaaguuuaaaccugagaucgcuauuagaccgaagguccgggaucaggaggggcgcaugaauuacuauuggacacucguugaacccggagacaaaaucaccuucgaggccacgggcaaccugguggugccuagauacgcguuugccauggaacggaacgcuggguccggaauuaucaucagcgauacacccguccaugacugcaauaccacaugucaaaccccuaagggcgccauuaacaccucucugcccuuccagaauauccacccgauuacaaucggcaagugcccuaaauauguuaagagcacgaaacuccgccuggcuaccgggcuuagaaacgugcccuccauucagucucggggacuguuuggcgccaucgccggguucaucgagggaggcuggacagggaugguggacggaugguacggcuaucaucaccagaaugaacaaggcagcggguacgcugcggaucucaaguccacccagaacgccauugacgagaucacaaauaaagucaacagcgugauugagaagaugaauacccaguuuacggcuguuggaaaggaguucaaccaccuggagaaacgcaucgaaaaucuuaacaagaaaguggaugacggcuuccuggauauuuggacauacaaugccgagcuccugguccugcucgaaaacgagagaacccuggacuaucaugauucuaaugugaagaaccuuuacgagaaaguccggucccagcugaagaacaaugccaaggaaguggggaacggauguuuugaguucuaucacaaaugcgacaauaccuguauggaaagcguuaagaacggcacauacgauuauccuaaauacucugaggaagcuaagcucaaucgcgaggagaucgacggggugaaacuggaauccaccagaaucuaucaaauucuugccaucuacagcacagcggcuuccucucugguccucgugguuagccugggcgccauuuccuuuuggaugugcucuaacggaagccugcagugccggaucuguauuuga

SEQ ID NO: 188703 - RNA, 1701 nt, Artificial Sequence
  derived and/or modified sequence opt5 from hemagglutinin__InfluenzaA__ADM31498
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguuaagcccggagacaaaauuacguucgaagccacaggcaaccugguggugccucgguacgcguuugccauggagcgcaacgcugggucuggaaucauuaucuccgauacccccguccaugacugcaauacaaccugucaaaccccuaagggcgccaucaacacaagccuccccuuccagaauauucacccgaucacgauuggcaagugcccuaaauaugugaagucuaccaaacugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaucugaaaagcacacagcacgccaucgacgaaauuaccaacaaagucaauuccgugaucgagaagaugaacacgcaguuuacagcuguuggaaaggaguucaaucaucuugaaaagagaauugagaaccugaauaagaaaguggaugacggcuuccucgauaucuggaccuacaacgccgaacugcugguccuccuggagaaugaacggacccuugacuaucacgauagcaacgugaagaaucuguacgagaaaguccgcucucagcucaagaacaacgccaaggagauugggaauggauguuuugaguucuaucauaaaugcgacaacacauguauggaguccgugaagaauggcaccuacgauuauccuaaauacagcgaagaggcuaagcugaacagagaagagaucgacgggguuaaacuugagucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 188704 - RNA, 1701 nt, Artificial Sequence
  derived and/or modified sequence opt5 from hemagglutinin__InfluenzaA__ADM31508
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagaagcuggccuaaucacgauucuaacaagggagugacagccgcuuguccccaugccggcgcgaaauccuuuuauaagagccugaucuggcucguuaaaaagggcaauucuuacccuaaacuguccaagagcuauauuaacgacaaggggaaagaagugcuuguccuguggggaauccaccaccccuccaccucugccgaucaacagagccucuaccagaaugcugacgccuacguguucgugggcacaucccgguauagcaagaaauuuaagccugagauugcuauccgcccgaaagucagagaucaggaggggcggaugaacuacuauuggacccugguugaacccggagacaagauuacguucgaggccacaggcaaucugguggugccucgcuacgcguuugccauggaaagaaacgcugggucuggaaucauuaucuccgauacccccguccaugacugcaacacaaccugucaaaccccuaaaggcgccaucaauacaagccuccccuuccagaacauucacccgaucacgauuggcaagugcccuaaguaugugaaaucuaccaagcugcggcuugcuacagggcugcgcaauguucccagcauccaguccagaggacucuuuggcgccauugccggguucaucgagggaggcuggaccgggaugguggacggaugguacggcuaucaucaccagaacgaacaaggcucuggguacgcugcggaucugaaaagcacacagcacgccaucgacgagauuaccaauaaggucaacuccgugaucgagaaaaugaauacgcaguuuacagcuguuggaaaggaguucaaccaucuugagaagcggauugaaaaucugaacaaaaagguggaugacggcuuccucgauaucuggaccuacaaugccgagcugcugguccuccuggaaaacgagcgcacccuugacuaucacgauagcaaugugaaaaaccuguacgagaaggucagaucucagcucaaaaauaacgccaaggaaauugggaacggauguuuugaguucuaucauaagugcgacaauacauguauggaauccgugaaaaacggcaccuacgauuauccuaaguacagcgaggaagcuaaacugaaucgggaggagaucgacgggguuaaacuugaaucuacacgcaucuaucaaauucuggccaucuacuccacgguggcgagcucccucguccuggugguuucucugggcgcuauuagcuuuuggaugugcuccaacggaucucuccagugcagaaucuguauuuga

SEQ ID NO: 188705 - RNA, 1701 nt, Artificial Sequence
  derived and/or modified sequence opt5 from hemagglutinin__InfluenzaA__ADM31518
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuaugugaaugacaaggggaaagaaguccuugugcuguggggcauucaccaccccuccaccucugccgaucaacagagccucuaccagaacgcugacgccuacguguucgucggaacauccagauauagcaagaaauuuaagccugagaucgcuauucggccgaaaguucgcgaucaggaggggagaaugaauuacuauuggacccugguggaacccggagacaagaucacguucgaggccacaggcaaccugguggucccucgguacgcguuugccauggaacgcaacgcugggucuggaauuaucauuuccgauacccccgugcaugacugcaauacaaccugucaaaccccuaaaggcgccaucaacacaagccuccccuuccagaauauccacccgauuacgaucggcaagugcccuaaguauguuaaaucuaccaagcugagacuugcuacagggcugcggaacauucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 188706 - RNA, 1701 nt, Artificial Sequence
  derived and/or modified sequence opt5 from hemagglutinin__InfluenzaA__ADM31528
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagauguuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauaucaaugacaaggggaaagaagugcuuguccuguggggcauucaccaccccuccaccucugccgaucaacagagccucuaccagaacgcugacgccuacguguucgugggaacauccagauauagcaagaaauuuaagccugagaucgcuauucggccgaaaguccgcgaucaggaggggagaaugaauuacuauuggacccugguugaacccggagacaagaucacguucgaggccacaggcaaccugguggugccucgguacgcguuugccauggaacgcaacgcugggucuggaauuaucauuuccgauacccccguccaugacugcaauacaaccugucaaaccccuaaaggcgccaucaacacaagccuccccuuccagaauauccacccgauuacgaucggcaagugcccuaaguaugugaaaucuaccaagcugagacuugcuacagggcugcggaacguucccagcauucagucccgcggacucuuuggcgccaucgccggguucauugagggaggcuggaccgggaugguggacggaugguacggcuaucaucaccagaaugaacaaggcucuggguacgcugcggaucugaaaagcacacagaacgccaucgacaagaucaccaauaaagucaacuccgugauugagaagaugaauacgcaguuuacagcuguuggaaaggaguucaaccaccuugagaaaagaaucgagaaucugaacaagaaaguggaugacggcuuccucgauauuuggaccuacaaugccgaacugcugguccuccuggagaacgaacggacccuugacuaucaugauagcaaugugaagaaccuguacgagaaaguccgcucucagcucaagaacaaugccaaggagguggggaacggauguuuugaguucuaucacaaaugcgacaauacauguauggaauccguuaagaacggcaccuacgauuauccuaaauacagcgaagaggcuaagcugaauagagaagagaucgacggggugaaacuugagucuacacggauuuaucaaauccuggccaucuacuccacggucgcgagcucccucgugcugguugugucucugggcgcuauuagcuuuuggaugugcuccaacggaucucuccagugccgcaucuguauuuga

SEQ ID NO: 188707 - RNA, 1701 nt, Artificial Sequence
  derived and/or modified sequence opt5 from hemagglutinin__InfluenzaA__ADM31538
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacgacgggaaacuuuguaagcugagaggaguugcuccccuccaucugggcaaaugcaauaucgccggguggauucugggaaacccugagugugaaucucucagcacagccuccucuuggagcuacaucguggagaccuccucuagcgauaauggcacgugcuauccgggggacuuuauugauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaauccuuuuauaagaaccugaucuggcucguuaaaaagggcaauucuuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaucugguggugccucgguacgcguuugccauggaacgcaacgcugggucuggaaucauuaucuccgacacccccguccaugacugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauauccccagcauucagucccgcggacucuuuggcgccaucgccggguucaucgagggaggcuggaccgggaugguugauggaugguacggcuaucaucaccagaacgaacaaggcucuggguacgcugcggaccugaaaagcacacagaaugccauugauaagaucaccaacaaagugaauagcgucauugagaagaugaacacgcaguuuacagcugugggaaaggaguucaaucaccuugagaaaagaaucgagaaccugaauaagaaaguugacgauggcuuccucgacauuuggaccuacaacgccgaacugcuggugcuccuggagaaugaacggacccuugauuaucaugacagcaacgucaagaaucuguacgagaaagugcgcucucagcucaagaacaacgccaaggagaucgggaauggauguuuugaguucuaucacaaaugcgauaacacauguauggaauccgucaagaauggcaccuacgacuauccuaaauacagcgaagaggcuaagcugaacagagaagagaucgauggggugaaacuugagucuacacggauuuaucaaauccuggccauuuacuccacgguugcgagcucccucgugcuggucgugucucugggcgcuaucagcuuuuggaugugcuccaauggaucucuccagugccgcauuuguaucuga

SEQ ID NO: 188708 - RNA, 1701 nt, Artificial Sequence
  derived and/or modified sequence opt5 from hemagglutinin__InfluenzaA__ADM31548
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugaggucgcuauucggccgaaaguucgcgaucaggaggggagaaugaauuacuauuggacccugguggaacccggagacaagaucacguucgaggccacaggcaaccugguggucccucgguacgcguuugccauggaacgcaacgcugggucuggaauuaucauuuccgauacccccgugcaugacugcaauacaaccugucaaaccccuaaaggcgccaucaacacaagccuccccuuccagaauauccacccgauuacgaucggcaagugcccuaaguauguuaaaucuaccaagcugagacuugcuacagggcugcggaacauucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 188709 - RNA, 1701 nt, Artificial Sequence
  derived and/or modified sequence opt5 from hemagglutinin__InfluenzaA__ADM31558
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacauccccagcauucagucccgcggacucuuuggcgccaucgccggguucaucgagggaggcuggaccgggaugguugacggaugguacggcuaucaucaccagaaugaacaaggcucuggguacgcugcggaucugaaaagcacacagaacgccauugacaagaucaccaauaaagugaacuccgucauugagaagaugaauacgcaguuuacagcugugggaaaggaguucaaccaccuugagaaaagaaucgagaaucugaacaagaaaguugaugacggcuuccucgauauuuggaccuacaaugccgaacugcuggugcuccuggagaacgaacggacccuugacuaucaugauagcaaugucaagaaccuguacgagaaagugcgcucucagcucaagaacaaugccaaggagaucagaaacggguguuuugaguucuaucacaaaugcgacaauacauguauggaauccgucaagaacggaaccuacgauuauccuaaauacagcgaagaggcuaagcugaaucgggaagagaucgacggcgugaaacuugagucuacacgcauuuaucaaauccuggccauuuacuccacgguugcgagcucccucgugcuggucgugucucugggggcuaucagcuuuuggaugugcuccaacggcucucuccagugcagaauuuguaucuga

SEQ ID NO: 188710 - RNA, 1701 nt, Artificial Sequence; identical to SEQ ID NO: 187290
  derived and/or modified sequence opt5 from hemagglutinin__InfluenzaA__ADM31568

SEQ ID NO: 188711 - RNA, 1701 nt, Artificial Sequence; identical to SEQ ID NO: 185693
  derived and/or modified sequence opt5 from hemagglutinin__InfluenzaA__ADM31578

SEQ ID NO: 188712 - RNA, 1701 nt, Artificial Sequence
  derived and/or modified sequence opt5 from hemagglutinin__InfluenzaA__ADM31588
augaaggccauccuggugguccuccuguacaccuucgcuacagccaacgcggacacgcuuugcauuggcuaucacgcuaauaacagcaccgauacaguugacaccauccuggagaagaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagauguuccccaagaccagcucuuggccuaaucacgauuccaacaagggagucacagccgcuuguccccaugccggcgcgaaaucuuuuuauaagaaucugaucuggcucgugaaaaagggcaacagcuacccuaaacugaauaaguccuauauuaacgacaaggggaaagaaguucuugugcuguggggaauccaccaccccagcaccuccgccgaucaacagucucucuaccagaaugcugacgccuacgucuucgugggcacaagcagauauuccaagaaauuuaagaccgagauugcuauccggccuaaagugcgcgaucaggaggggagaaugaacuacuauuggacgcuggucgaaccgggagacaagauuacauucgaggccaccggcaaccugguugugccccgguacgcguuugccauggaacgcaaugcugggagcggaaucauuaucucugauacaccugugcaugacugcaacaccaccugucaaacacccaaaggcgccaucaauacgucccucccuuuccagaacauucaccccaucaccauuggcaagugcccgaaguaugucaaaagcacaaagcugagacuugcuaccgggcugcggaaugugccuucuauccagagccgcggacucuuuggcgccauugccggguucaucgagggaggcuggacagggaugguugacggaugguacggcuaucaucaccagaacgaacaaggcuccggguacgcugcggaucugaaaucuacccagaaugccaucgacgagauuacgaacaaggugaauagcgucaucgagaaaaugaacacacaguuuaccgcugugggaaaggaguucaaucaccuugagaagagaauugaaaaccugaauaaaaagguugaugacggcuuccucgauaucuggaccuacaacgccgagcugcuggugcuccuggaaaaugagcggacacuugacuaucaugauuccaacgucaaaaaccuguacgagaaggugcgcagccagcucaaaaauaacgccaaggaagucgggaauggauguuuugaguucuaucacaagugcgacaacaccuguauggaaucugugaaaaauggcacauacgauuaucccaaguacuccgaggaagcuaaacugaacagagaggagauugacgggguuaaacuugaaagcacgcggaucuaucaaauccuggccauuuacucuaccguggcguccagccucguccuggugguuucccugggcgcuaucucuuuuuggaugugcagcaauggaucccuccagugccgcauuuguaucuga

SEQ ID NO: 188713 - RNA, 1701 nt, Artificial Sequence
  derived and/or modified sequence opt5 from hemagglutinin__InfluenzaA__ADM31598
augaacgccauccuggugguccuccuguacaccuucgcuacagccaaugcggacacgcuuugcauuggcuaucacgcuaacaauagcaccgauacaguugacacccugcucgagaagaacgugacagugacccauuccgucaaucugcuugaagauaaacacaacgggaagcuguguaaacucagaggaguggcgccccugcaucugggcaagugcgacaucgccggguggauucucggaaauccugagugugaaucucugagcacagcuuccucuuggagcuacaucguugagaccuccucuagcgauaacggcacgugcuauccgggggacuuuauugauuacgaagaacuucgggagcagcuguccagcgugucuuccuucgaacgcuuugagaucuuccccaaaaccagcucuuggccugaccacgauuccaauaagggagucacagccgcuuguccccaugccggcgccaagagcuuuuauaaaaaccucaucuggcuggugaagaaaggcaauucuuacccuaaacuuuccaagagcuauauuaacgacaaggggaaggaaguucuggugcucuggggaauccaccaccccuccaccucugccgaucaacagagccuguaccagaaugcugacgccuacgucuucgugggcacauccagauauagcaaaaaguuuaaaccugagauugcuauccggccgaaggugcgcgaucaggaggggagaaugaacuaccauuggacccuggucgaacccggagacaaaauuacguucgaggccacaggcaaucucguugugccucgguaugcguuugccauggaacgcaacgcugggucuggaaucauuaucuccgacgcccccgugcacgauugcaacaccacaugucaaaccccuaagggcgcuaucaauaccagccugcccuuccagaacauucauccgaucacaauuggcaaaugcccuaaguacgucaagucuacgaaacuuagacuggccaccgggcuccggaaugugcccagcauccagucccgcggacuguuuggcgccauugcuggguucaucgagggaggcuggacagggaugguugacggaugguauggcuaccaccaccagaacgaacaaggcucuggguaugcggccgaucuuaagagcacccagaaugcuaucgacgagauuacaaacaaaaucaauuccgugauugagaagaugaacacccaguuuacggccgucggaaaagaguucaaucaucuggagaagagaaucgaaaaccucaauaagaaaguggaugacggcuuccuggauauuuggacauacaacgccgagcugcucguucugcuugaaaaugagcggacccuggacuaccacgauagcaacgugaagaaucucuaugagaaaguccgcucucagcugaagaacaacgcuaaagaaaucgggaauggauguuuugaguucuaccauaagugcgacaacaccuguauggaauccgugaagaauggcacauaugauuacccuaaauauagcgaggaagccaaacuuaacagagaggagaucgacggggucaagcuggaaucuacccggauuuaccaaauccucgcgauuuauuccacaguggcuagcucccugguucugguggucucucucggcgccaucagcuuuuggaugugcuccaauggaucucugcagugccgcauuuguaucuga

SEQ ID NO: 188714 - RNA, 1701 nt, Artificial Sequence
  derived and/or modified sequence opt5 from hemagglutinin__InfluenzaA__ADM31608
augaaggccauccuggugguccuccuguacaccuucgcuacaguuaacgccgacacgcuuugcauuggcuaucacgcgaauaacagcaccgauacaguggacaccgugcuggagaaaaaugucacagugacccauuccguuaaccuccuggaagauaagcacaaugggaaacuuuguaagcugagaggaguggcuccccuccaucugggcaaaugcaacaucgccggguggauucugggaaauccugagugugaaucucucagcacagccuccucuuggagcuacaucgucgagaccuccucuagcgacaacggcacgugcuauccgggggauuuuauugacuacgaagaacugcgggagcagcuuuccagcgugucuuccuucgaacgcuuugagaucuuccccaagaccagcucuuggccuaaucacgauuccaacaagggaguuacagcugccuguccccaugcuggcgccaagagcuuuuauaaaaaucugaucuggcucgugaaaaagggcaacucuuacccuaaacuguccaagagcuauauuaaugacaaggggaaagaaguccuugugcuguggggaauccaccaccccuccaccucugcggaucaacagagccucuaccagaacgccgacgcuuacguguucgucggcacauccagauauagcaagaaauuuaagccugagauugccauccggccgaaaguucgcgaucaggaggggagaaugaauuacuauuggacccugguggaacccggagacaagauuacguucgaggcuacaggcaaccugguggucccucgguacgccuuugcgauggaacgcaacgccgggucuggaaucauuaucuccgauacccccgugcaugacugcaauacaaccugucaaaccccuaaaggcgcuaucaacacaagccuccccuuccagaauauucacccgaucacgauuggcaagugcccuaaguauguuaaaucuaccaagcugagacuugccacagggcugcggaacgugcccagcauccagucccgcggacucuuuggcgcuauugccggguucaucgagggaggcuggaccgggauggucgacggaugguacggcuaucaucaccagaaugaacaaggcucuggguacgccgcugaucugaaaagcacacagaacgcgaucgacaagauuaccaauaaagugaacuccguuaucgagaagaugaauacgcaguuuacagccgugggaaaggaguucaaccaccuugagaaaagaauugagaaucugaacaagaaagucgaugacggcuuccucgauaucuggaccuacaaugcugaacugcuggugcuccuggagaacgaacggacccuugacuaucaugauagcaaugucaagaaccuguacgagaaagugcgcucucagcucaagaacaaugccaaggagauugggaacggauguuuugaguucuaucacaaaugcgacaauacauguauggaauccguuaagaacggcaccuacgauuauccuaaauacagcgaagaggccaagcugaauagagaagagaucgacggggugaaacuugagucuacacggaucuaucaaauucuggcuaucuacuccacggucgccagcucccucgugcugguugugucucugggcgcgauuagcuuuuggaugugcuccaacggaucucuccagugccgcaucuguauuuga

SEQ ID NO: 188715 - RNA, 1701 nt, Artificial Sequence; identical to SEQ ID NO: 187245
  derived and/or modified sequence opt5 from hemagglutinin__InfluenzaA__ADM31618

SEQ ID NO: 188716 - RNA, 1701 nt, Artificial Sequence; identical to SEQ ID NO: 186857
  derived and/or modified sequence opt5 from hemagglutinin__InfluenzaA__ADM31628

SEQ ID NO: 188717 - RNA, 1701 nt, Artificial Sequence; identical to SEQ ID NO: 188596
  derived and/or modified sequence opt5 from hemagglutinin__InfluenzaA__ADM31638

SEQ ID NO: 188718 - RNA, 1701 nt, Artificial Sequence; identical to SEQ ID NO: 187113
  derived and/or modified sequence opt5 from hemagglutinin__InfluenzaA__ADM31648

SEQ ID NO: 188719 - RNA, 1701 nt, Artificial Sequence; identical to SEQ ID NO: 187860
  derived and/or modified sequence opt5 from hemagglutinin__InfluenzaA__ADM31658

SEQ ID NO: 188720 - RNA, 1701 nt, Artificial Sequence; identical to SEQ ID NO: 187113
  derived and/or modified sequence opt5 from hemagglutinin__InfluenzaA__ADM31668

SEQ ID NO: 188721 - RNA, 1701 nt, Artificial Sequence; identical to SEQ ID NO: 185693
  derived and/or modified sequence opt5 from hemagglutinin__InfluenzaA__ADM31688

SEQ ID NO: 188722 - RNA, 1701 nt, Artificial Sequence
  derived and/or modified sequence opt5 from hemagglutinin__InfluenzaA__ADM31698
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacauccccagcauucagucccgcggacucuuuggcgccaucgccggguucaucgagggaggcuggaccgggaugguugacggaugguacggcuaucaucaccagaaugaacaaggcucuggguacgcugcggaucugaaaagcacacagaacgccauugacaagaucaccaauaaagugaacuccgucauugagaagaugaauacgcaguuuacagcugugggaaaggaguucaaccaccuugagaaaagaaucgagaaucugaacaagaaaguugaugacggcuuccucgauauuuggaccuacaaugccgaacugcuggugcuccuggagaacgaacggacccuugacuaucaugauagcaaugucaagaaccuguacgagaaagugcgcucucagcucaagaacaaugccaaggagaucgggaacggauguuuugaguucuaucacaaaugcgacaauacauguauggaauccgucaagaacggcaccuacgauuauccuaaauacagcgaagaggcuaagcugaauagagaagagaucgacggggugaaacuugagucuacacggauuuaucaaauccuggccauuuacuccacgguugcgagcucccucauccugguggucucucugggcgcuauuagcuuuuggaugugcuccaacggaucucuccagugccgcaucuguauuuga

SEQ ID NO: 188723 - RNA, 1701 nt, Artificial Sequence; identical to SEQ ID NO: 188598
  derived and/or modified sequence opt5 from hemagglutinin__InfluenzaA__ADM31708

SEQ ID NO: 188724 - RNA, 1701 nt, Artificial Sequence
  derived and/or modified sequence opt5 from hemagglutinin__InfluenzaA__ADM31718
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacacauacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacaagauuacgaauaaagucaacuccgugaucgagaagaugaauacacaguuuaccgccguuggaaaggaguucaaccaccuugagaaaagaauugagaaucugaacaagaaaguggaugacggcuuccucgauaucuggaccuacaaugcugaacugcugguccuccuggagaacgaacggacacuugacuaucaugauagcaaugugaagaaccuguacgagaaaguccgcucucagcucaagaacaaugccaaggagauugggaacggauguuuugaguucuaucacaaaugcgacaauaccuguauggaauccgugaagaacggcacauacgauuauccuaaauacagcgaagaggccaagcugaauagagaagagaucgacgggguuaaacuugagucuacgcggaucuaucaaauucuggcuaucuacuccaccguggccagcucccucguccuggugguuucucugggcgcgauuagcuuuuggaugugcuccaacggaucucuccagugccgcaucuguauuuga

SEQ ID NO: 188725 - RNA, 1701 nt, Artificial Sequence
  derived and/or modified sequence opt5 from hemagglutinin__InfluenzaA__ADM31728
augaaggccauccugauugugcuccuguacaccuucgcuacagccaacgcggacacgcuuugcaucggcuaucacgcuaauaacagcaccgauacagucgacaccguucuggagaagaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcggcaacgggacgugcuauccgggagacuuuaucgauuacgaagaacugcgggagcagcuuuccagcgugucuuccuucgaacgcuuugagaucuuccccaagaccagcucuuggccuaaucacgacuccaacaagggcgucacagccgcuuguccccaugccggcgcgaaaucuuuuuauaagaaucugauuuggcucgugaaaaaggggaacagcuacccuaaacuguccaagagcuauaucaaugauaagggaaaagaaguucuugugcuguggggcauucaccaccccuccaccucugccgaccaacagagccucuaccagaacgcugaugccuacgucuucguggggacauccagauauagcaagaaauuuaagccugagaucgcuauucggccgaaagugcgcgaccaggagggaagaaugaauuacuauuggacccuggucgaacccggcgauaagaucacguucgaggccacagggaaccugguugugccucgguacgcguuugccauggaacgcaacgcuggaucuggcauuaucaccuccgacacacccgugcaugauugcaauaccaccugucaaacaccuaaaggcgccaucaacacgagccuccccuuccagaauauucacccgaucaccauugggaagugcccuaaguaugucaaaucuacaaagcugagacuugcuaccggacugcggaacgugcccagcauccagucccgcggccucuuuggggccauugccggauucaucgagggcggguggacaggaaugguugacggcugguacggcuaucaucaccagaaugaacaagggucuggauacgcugcggaccugaaaagcacccagaacgccaucgaugagauuacgaauaaggugaacuccgucaucgagaaaaugaauacacaguuuaccgcugugggcaaggaguucaaccaccuugagaagagaauugaaaaucugaacaaaaagguugacgauggguuccucgacaucuggaccuacaaugccgagcugcuggugcuccuggaaaacgagcggacacuugauuaucaugacagcaaugucaaaaaccuguacgagaaggugcgcucucagcucaaaaacaaugccaaggaaauuggaaacggcuguuuugaguucuaucacaagugcgauaauaccuguauggaauccgucaaaaacgggacauacgacuauccuaaguacagcgaggaagcuaaacugaauagagaggagaucgauggcgugaaacuugaaucuacgcggaucuaucaaauucuggccaucuacuccaccguugcgagcucccucgugcuggucgugucucugggagcuauuagcuuuuggaugugcuccaacggcucucuccagugccgcaucuguauuuga

SEQ ID NO: 188726 - RNA, 1701 nt, Artificial Sequence
  derived and/or modified sequence opt5 from hemagglutinin__InfluenzaA__ADM31738
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgcggagcuuuuauaaaaaucuuauuuggcugguuaagaaaggcaacucuuacccuaagcucuccaaaagcuauaucaaugacaaggggaaggaagugcugguccuuuggggcauucaccaccccuccaccucugccgaucaacagagccuguaccagaacgcugacgccuacguguucgugggaacauccagauauagcaaaaaguuuaaaccugagaucgcuauucgcccgaaggucagagaucaggaggggcggaugaauuacuauuggacccucguugaacccggagacaaaaucacguucgaggccacaggcaaccugguggugccucgcuacgcguuugccauggaaagaaacgcugggucuggaauuaucaucuccgauacccccguccaugacugcaauacaaccugucaaaccccuaagggcgccauuaacacaagccugcccuuccagaauauccacccgauuacgaucggcaaaugcccuaaguaugugaagucuaccaaacuccggcuggcuacagggcuucgcaacguucccagcauucaguccagaggacuguuuggcgccaucgccggguucaucgagggaggcuggaccgggaugguggacggaugguacggcuaucaucaccagaaugaacaaggcucuggguacgcugcggaucucaagagcacacagaacgccauugacgagaucaccaauaaagucaacuccgugauugagaagaugaauacgcaguuuacagcuguuggaaaagaguucaaccaccuggagaagcggaucgaaaaucuuaacaagaaaguggaugacggcuuccuggauauuuggaccuacaaugccgagcuccugguccugcucgaaaacgagcgcacccuggacuaucaugauagcaaugugaagaaccuuuacgagaaagucagaucucagcugaagaacaaugccaaagaaaucgggaacggauguuuugaguucuaucacaagugcgacaauacauguauggaauccgugaagaacggcaccuacgauuauccuaaauacagcgaggaagcuaagcucaaucgggaggagaucgacgggguuaaacuggaaucuacacgcauuuaucaaauccuugccauuuacuccacgguggcgagcucccugguccucgugguuucucugggcgcuaucagcuuuuggaugugcuccaacggaucucugcagugcagaauuuguaucuga

SEQ ID NO: 188727 - RNA, 1701 nt, Artificial Sequence; identical to SEQ ID NO: 187342
  derived and/or modified sequence opt5 from hemagglutinin__InfluenzaA__ADM31748

SEQ ID NO: 188728 - RNA, 1701 nt, Artificial Sequence
  derived and/or modified sequence opt5 from hemagglutinin__InfluenzaA__ADM31758
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaaucgcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccaagagcuauaucaaugacaaggggaaagaaguucuugugcuguggggcauucaccaccccuccaccucugccgaucaacagagccucuaccagaacgcugacgccuacgucuucgugggaacauccagauauagcaagaaauuuaagccugagaucgcuauucggccgaaagugcgcgaucaggaggggagaaugaauuacuauuggacccugaucgaccccggagauaagauuacguucgaagccacaggcaaccuggucguuccucgguacgcguuugccauggagcgcaacgcugggucuggaaucaucauuuccgacacccccgugcaugacugcaauacaaccugucaaaccccuaaaggcgccaucaacacaagccuccccuuccagaauauucacccgaucacgauuggcaagugcccuaaguaugugaaaucuaccaagcugagaauggcuacagggcuucggaacguccccagcauccagucccgcggacuguuuggcgccaucgccggguucauugaaggaggcuggaccgggaugguggauggaugguacggcuaucaucaccagaaugagcaaggcucuggguacgcugcggaccucaaaagcacacagaacgccaucgaugaaauuaccaauaagguuaacuccgugaucgagaaaaugaauacgcaguuuacagcugucggaaaggaguucaaccaccuggaaaagagaauugagaaucuuaacaaaaagguggacgauggcuuccuggacaucuggaccuacaaugccgaacuccugguucugcucgagaacgaacggacccuggauuaucaugacagcaaugugaaaaaccuuuacgagaagguccgcucucagcugaaaaacaaugccaaggagaucgggaacggauguuuugaguucuaucacaagugcgauaauacauguauggaguccgugaaaaacggcaccuacgacuauccuaaguacagcgaagaggcuaaacucaauagagaagagauugauggggucaagcuggagucuacacggaucuaucaaauucuugccaucuacuccacgguggcgagcucccugguucucguggucucucugggcgcuauuagcuuuuggaugugcuccaacggaucucugcagugccgcaucuguauuuga

SEQ ID NO: 188729 - RNA, 1701 nt, Artificial Sequence; identical to SEQ ID NO: 186053
  derived and/or modified sequence opt5 from hemagglutinin__InfluenzaA__ADM31768

SEQ ID NO: 188730 - RNA, 1701 nt, Artificial Sequence; identical to SEQ ID NO: 185693
  derived and/or modified sequence opt5 from hemagglutinin__InfluenzaA__ADM31778

SEQ ID NO: 188731 - RNA, 1701 nt, Artificial Sequence; identical to SEQ ID NO: 187860
  derived and/or modified sequence opt5 from hemagglutinin__InfluenzaA__ADM31798

SEQ ID NO: 188732 - RNA, 1701 nt, Artificial Sequence
  derived and/or modified sequence opt5 from hemagglutinin__InfluenzaA__ADM31808
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcggcaacgggacgugcuauccgggagacuuuauugauuacgaagaacugcgggagcagcuuuccagcgucucuuccuucgaacgcuuugagaucuuccccaagaccagcucuuggccuaaucacgacuccaacaagggcgugacagccgcuuguccccaugccggcgcgaaaucuuuuuauaagaaucugcucuggcugguuaaaaaggggaacagcuacccuaaacuuuccaagagcuauaucaaugauaagggaaaagaagugcugguccucuggggcauucaccaccccuccaccucugccgaccaacagagccuguaccagaacgcugaugccuacguguucguggggacauccagauauagcaagaaauuuaagccugagaucgcuauucggccgaaaguccgcgaccaggagggaagaaugaauuacuauuggacccugguuggccccggggauaagaucacguucgaagccacaggaaaccucguggugccucgguacgcguuugccauggagcgcaacgcuggcucuggcauuaucauuuccgacacccccguccaugauugcaauacaaccugucaaaccccuaaaggggccaucaacacaagccugcccuuccagaauauccacccgauuacgaucggaaagugcccuaaguaugugaaaucuaccaaacuuagacuggcuacaggccuccggaacguucccagcauucagucccgcgggcuguuuggagccaucgccggcuucauugaagggggauggaccggcaugguggacggcugguacggguaucaucaccagaaugagcaaggaucuggcuacgcugcggaccuuaagagcacacagaacgccaucgaugaaaucaccaauaaggucaacuccgugauugagaaaaugaauacgcaguuuacagcuguugggaaggaguucaaccaccuggaaaagagaaucgagaaucucaacaaaaagguggacgauggauuccuggacauuuggaccuacaaugccgaacugcucguccugcuugagaacgaacggacccuggauuaucaugacagcaaugugaaaaaccucuacgagaagguccgcucucagcugaaaaacaaugccaaggagaucggcaacggguguuuugaguucuaucacaagugcgauaauacauguauggaguccgugaaaaacggcaccuacgacuauccuaaguacagcgaagaggcuaaacuuaauagagaagagauugauggaguuaagcuggagucuacacggaucuaucaaauccucgccauuuacuccacgguggcgagcucccugguccuggugguuucucucggcgcuaucagcuuuuggaugugcuccaacgggucucugcagugccgcauuuguaucuga

SEQ ID NO: 188733 - RNA, 1701 nt, Artificial Sequence; identical to SEQ ID NO: 187860
  derived and/or modified sequence opt5 from hemagglutinin__InfluenzaA__ADM31818

SEQ ID NO: 188734 - RNA, 1701 nt, Artificial Sequence
  derived and/or modified sequence opt5 from hemagglutinin__InfluenzaA__ADM31828
augaaggccauccuggugguccuccuguacaccuucgcuacagccaacgcggacacgcuuugcauuggcuaucacgcuaauaacagcaccgauacaguugacaccgugcuggagagaaaugugacagucacccauuccgugaaccuccuggaagauaagcacaaugggaaacuuuguaaacugcggggaguugcgccccuccaucugggcaagugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgcgagcagcuuuccagcgucucuuccuucgaaagauuugagaucuuccccaaaaccagcucuuggccuaaucacgauuccaacaagggagugacagccgcuuguccccaugccggcgccaagagcuuuuauaaaaaucugaucuggcucguuaagaaaggcaagucuuacccuaaacuguccaagagcuauauuaacgacaaggggaaagaagugcuuguccuguggggaauccaccaccccuccaccucugccgaucaacagagccucuaccagaaugcugacgccuacguguucgugggcacaucccgguauagcaagaaauuuaagccugagauugcuauccgcccgaaagucagagagcaggaagggcggaugaacuacuauuggacccugguugagcccggagauaagauuacguucgaagccacaggcaaucugguggugccucgcuacgcguuugccauggagagaaacgcugggucuggaaucauuaucuccgacacccccguccaugauugcaacacaaccugucaaaccccuaaaggcgccaucaauacaagccuccccuuccagaacauucacccgaucacgauuggcaagugcccuaaguaugugaaaucuaccaagcugcggcuugcuacagggcugcgcaauguucccagcauccaguccagaggacucuuuggcgccauugccggguucaucgaaggaggcuggaccgggaugguggacggaugguacggcuaucaucaccagaacgagcaaggcucuggguacgcugcggaccugaaaagcacacagaaugccaucgaugagauuaccaacaaggucaauuccgugaucgaaaagaugaacacgcaguuuacagcuguuggaaaggaguucaaucaccuugaaaagcggauugagaaccugaauaaaaagguggacgauggcuuccucgacaucuggaccuacaacgccgaacugcugguccuccuggagaaugagcgcacccuugauuaucaugacagcaacgugaaaaaucuguacgaaaaggucagaucucagcucaaaaacaacgccaaggagauugggaauggauguuuugaguucuaucacaagugcgauaacacauguauggaguccgugaaaaauggcaccuacgacuauccuaaguacagcgaagaggcuaaacugaaccgggaggaaaucgaugggguuaaacuugagucuacacgcaucuaucaaauucuggccaucuacuccacgguggcgagcucccucguccugcuggugucucucggcgcuauuagcuuuuggaugugcuccaauggaucucugcagugcagaaucuguauuuga

SEQ ID NO: 188735 - RNA, 1701 nt, Artificial Sequence; identical to SEQ ID NO: 188734
  derived and/or modified sequence opt5 from hemagglutinin__InfluenzaA__ADM31838

SEQ ID NO: 188736 - RNA, 1701 nt, Artificial Sequence; identical to SEQ ID NO: 185693
  derived and/or modified sequence opt5 from hemagglutinin__InfluenzaA__ADM31848

SEQ ID NO: 188737 - RNA, 1701 nt, Artificial Sequence
  derived and/or modified sequence opt5 from hemagglutinin__InfluenzaA__ADM31858
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguagccaugccggcgcgaaaucuuuuuauaagaaucugaucuggcucguuaaaaagggcaacuccuaccccaaacugaauaagagcuauauuaacgacaaggggaaagaagugcuuguccuguggggaauccaccacccuuccaccucugccgaucaacagagccucuaccagaaugcugacgccuacguguucgugggcacauccagauauagcaagaaauuuaagcccgagauugcuauccggccuaaaguccgcgagcaggaagggagaaugaacuacuauuggacccugguugagccgggagauaagauuacguucgaagccacaggcaaccugguggugccccgguacgcguuugccauggagcgcaaugcugggucuggaaucauuaucuccgacaccccuguccaugauugcaacacaaccugucaaacccccaaaggcgccaucaauacaagccucccuuuccagaacauucaccccaucacgauuggcaagugcccgaaguaugugaaaucuaccaagcugagacuugcuacagggcugcggaauguuccuagcauccagucccgcggacucuuuggcgccauugccggguucaucgaaggaggcuggaccgggaugguggacggaugguacggcuaucaucaccagaacgagcaaggcucuggguacgcugcggaccugaaaagcacacagaaugccaucgaugagauuaccaacaaggucaauuccgugaucgagaaaaugaacacgcaguuuacagcuguuggaaaggaguucaaucaccuugaaaagagaauugagaaccugaauaaaaagguggacgauggcuuccucgacaucuggaccuacaacgccgaacugcugguccuccuggagaaugagcggacccuugauuaucaugacagcaacgugaaaaaccuguacgaaaagguccgcucucagcucaaaaauaacgccaaggagauugggaauggauguuuugaguucuaucacaagugcgauaacacauguauggaauccgugaaaaauggcaccuacgacuaucccaaguacagcgaagaggcuaaacugaacagagaggaaaucgaugggguugagcuugaaucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 188738 - RNA, 1701 nt, Artificial Sequence
  derived and/or modified sequence opt5 from hemagglutinin__InfluenzaA__ADM31868
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaacuccugucuacagccagcuccuggucuuacaucguggagaccagcuccucugacaacggcacgugcuauccgggggauuuuauuaauuacgaggaacuucgggagcagcugagcuccgucagcucuuucgaacgcuuugagaucuuccccaagaccuccagcuggccuaaccacgacucuaauaagggagugacagccgcuuguccccaugccggcgcgaaauccuuuuauaagaaccucaucuggcugguuaaaaagggcaauagcuacccuaaacuuucuaaguccuauauuaacgauaaggggaaagaagugcugguccucuggggagugcaccaccccagcaccuccgccgaccaacagucucuguaccagaaugcugaugccuacguguucgucggcacaagcagauauuccaagaaauuuaagccugagaucgcuauucggccgaaaguucgcgaccaggaggggagaaugaacuacuauuggacccugguggaacccggagauaagaucacguucgaggccacaggcaaccucguggucccucgguacgcguuuagcauggaacgcaaugccgggucuggaauuaucauuuccgacacccccgugcaugauugcaacacaaccugucaaaccccuaaaggcgcuaucaauacaagccugcccuuccagaacauccacccgauuacgaucggcaagugcccuaaguauguuaaaucuaccaaacuuagacuggccacagggcuccggaaugugcccagcauucagucccgcggacuguuuggcgcuaucgccggguucauugagggaggcuggaccgggauggucgacggaugguacggcuaucaucaccagaacgaacaaggcucuggguacgccgcugaccuuaaaagcacacagaaugcgaucgauaagaucaccaacaaaguuaauuccgugauugagaagaugaacacgcaguuuacagccgugggaaaggaguucaaucaccuggaaaagagaaucgagaaccucaauaagaaagucgacgauggcuuccuggacauuuggaccuacaacgcugaacugcucgugcugcuugagaaugaacggacccuggauuaucaugacagcaacgucaagaaccucuacgagaaagugcgcucucagcugaagaauaacgccaaggagaucgggaauggauguuuugaguucuaucacaaaugcgauaacacauguauggaauccguuaagaauggcaccuacgacuauccuaaauacagcgaagaggccaaacuuaacagagaaaagauugauggggugaagcuggagucuacacggaucuaucaaauccucgcuauuuacuccacggucgccagcucccuggugcugguugugucucucggcgcgaucagcuuuuggaugugcuccaauggaucucugcagugccgcauuuguaucuga

SEQ ID NO: 188739 - RNA, 1701 nt, Artificial Sequence
  derived and/or modified sequence opt5 from hemagglutinin__InfluenzaA__ADM31878
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaaaugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaaggccagcucuuggccuaaucacgauuccaacaagggagugaccgcugccuguccccaugcgggcgccaagagcuuuuauaagaaucuuauuuggcugguuaaaaagggcaacucuuacccuaaacucuccaagagcuauaucaaugacaaggggaaagaagugcugguccuuuggggcauucaccaccccuccacaucugcugaucaacagagccuguaccagaacgccgacgcuuacguguucgugggaaccuccagauauagcaagaaauuuaagccugagaucgccauucggccgaaaguccgcgaucaggaggggagaaugaauuacuauuggacacucguugaacccggagacaagaucaccuucgaggcgacgggcaaccugguggugccucgguacgccuuugcuauggaacgcaacgccgggucuggaauuaucaucuccgauacacccguccaugacugcaauaccacaugucaaaccccuaaaggcgcuauuaacaccagccugcccuuccagaauauccacccgauuacaaucggcaagugcccuaaguaugugaaaucuacgaagcucagacuggccaccgggcuucggaacguucccagcauucagucccgcggacuguuuggcgccaucgcuggguucaucgagggaggcuggacagggaugguggacggaugguacggcuaucaucaccagaaugaacaaggcucuggguacgcggccgaucucaaaagcacccagaacgcuauugacgagaucacaaauaaggucaacuccgugauugagaaaaugaauacccaguuuacggccguuggaaaggaguucaaccaccuggagaagagaaucgaaaaucuuaacaaaaagguggaugacggcuuccuggauauuuggacauacaaugccgagcuccugguccugcucgaaaacgagcggacccuggacuaucaugauagcaaugugaaaaaccuuuacgagaagguccgcucucagcugaaaaacaaugcuaaggaaaucgggaacggauguuuugaguucuaucacaagugcgacaauaccuguauggaauccgugaaaaacggcacauacgauuauccuaaguacagcgaggaagccaaacucaauagagaggagaucgacgggguuaagcuggaaucuacccggauuuaucaaauccuugcgauuuacuccacaguggcuagcucccugguccucgugguuucucugggcgccaucagcuuuuggaugugcuccaacggaucucugcagugccgcauuuguaucuga

SEQ ID NO: 188740 - RNA, 1701 nt, Artificial Sequence; identical to SEQ ID NO: 187342
  derived and/or modified sequence opt5 from hemagglutinin__InfluenzaA__ADM31888

SEQ ID NO: 188741 - RNA, 1701 nt, Artificial Sequence; identical to SEQ ID NO: 185873
  derived and/or modified sequence opt5 from hemagglutinin__InfluenzaA__ADM31898

SEQ ID NO: 188742 - RNA, 1701 nt, Artificial Sequence
  derived and/or modified sequence opt5 from hemagglutinin__InfluenzaA__ADM31908
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgaccacgaagaacuccgggagcagcuguccagcgucucuuccuucgaacgcuuugagaucuuccccaagaccagcucuuggccuaaucaugauuccaacaagggagugacagccgcuuguccccacgccggcgcgaaaucuuuuuacaagaaucuuauuuggcugguuaaaaagggcaacagcuauccuaaacucuccaagagcuacaucaaugacaaggggaaagaagugcugguccuuuggggcauucaccaucccuccaccucugccgaucaacagagccuguaucagaacgcugacgccuacguguucgugggauccagcagauacucuaagaaauuuaagccugagaucgcuauucggccgaaaguccgcgaucaggaggggagaaugaauuauuacuggacacucguugaacccggagacaagaucaccuucgaggccacgggcaaccugguggugccucgguaugcguuugccauggaacgcaacgcuggguccggaauuaucaucagcgauacacccguccacgacugcaauaccacaugucaaaccccuaaaggcgccauuaacaccucucugcccuuccagaauauccauccgauuacaaucggcaagugcccuaaguacgugaaaagcacgaagcucagacuggcuaccgggcuucggaacguucccuccauucagucucgcggacuguuuggcgccaucgccggguucaucgagggaggcuggacagggaugguggacggaugguauggcuaccaccaccagaaugaacaaggcagcggguaugcugcggaucucaaauccacccagaacgccauugacgagaucacaaauaaggucaacagcgugauugagaaaaugaauacccaguuuacggcuguuggaaaggaguucaaccaucuggagaagagaaucgaaaaucuuaacaaaaagguggaugacggcuuccuggauauuuggacauacaaugccgagcuccugguccugcucgaaaacgagcggacccuggacuaccacgauucuaaugugaaaaaccuuuaugagaagguccgcucccagcugaaaaacaaugccaaggaaaucgggaacggauguuuugaguucuaccauaagugcgacaauaccuguauggaaagcgugaaaaacggcacauaugauuacccuaaguauucugaggaagcuaaacucaauagagaggagaucgacgggguuaagcuggaauccacccggauuuaccaaauccuugccauuuauagcacaguggcguccucucugguccucgugguuagccugggcgcuaucuccuuuuggaugugcucuaacggaagccugcagugccgcauuuguaucuga

SEQ ID NO: 188743 - RNA, 1701 nt, Artificial Sequence; identical to SEQ ID NO: 185873
  derived and/or modified sequence opt5 from hemagglutinin__InfluenzaA__ADM31918

SEQ ID NO: 188744 - RNA, 1701 nt, Artificial Sequence; identical to SEQ ID NO: 187465
  derived and/or modified sequence opt5 from hemagglutinin__InfluenzaA__ADM31928

SEQ ID NO: 188745 - RNA, 1701 nt, Artificial Sequence; identical to SEQ ID NO: 187465
  derived and/or modified sequence opt5 from hemagglutinin__InfluenzaA__ADM31948

SEQ ID NO: 188746 - RNA, 1701 nt, Artificial Sequence; identical to SEQ ID NO: 185693
  derived and/or modified sequence opt5 from hemagglutinin__InfluenzaA__ADM31958

SEQ ID NO: 188747 - RNA, 1701 nt, Artificial Sequence; identical to SEQ ID NO: 187465
  derived and/or modified sequence opt5 from hemagglutinin__InfluenzaA__ADM31968

SEQ ID NO: 188748 - RNA, 1701 nt, Artificial Sequence; identical to SEQ ID NO: 187281
  derived and/or modified sequence opt5 from hemagglutinin__InfluenzaA__ADM31978

SEQ ID NO: 188749 - RNA, 1701 nt, Artificial Sequence; identical to SEQ ID NO: 185873
  derived and/or modified sequence opt5 from hemagglutinin__InfluenzaA__ADM31998

SEQ ID NO: 188750 - RNA, 1701 nt, Artificial Sequence; identical to SEQ ID NO: 185873
  derived and/or modified sequence opt5 from hemagglutinin__InfluenzaA__ADM32008

SEQ ID NO: 188751 - RNA, 1701 nt, Artificial Sequence
  derived and/or modified sequence opt5 from hemagglutinin__InfluenzaA__ADM32018
augaaggccauccuggugguccuccuguacaccuucgcuauugccaacgcggacacacuuugcaucggcuaucacgcuaauaacagcacggauaccguugacacagugcuggagaagaaugugaccgucacacauuccgugaaccuccuggaagauaagcacaaugggaaacuuuguaagcugagaggaguugcuccccuccaucugggcaaaugcgacauugccggguggauccugggaaacccugagugugaaucucucagcaccgccuccucuuggagcuacauuguggagacauccucuagcgauaauggaaccugcuauccgggggacuuuaucgauuacgaagaacugcgggagcagcuuuccagcgucucuuccuucgaacgcuuugagaucuuccccaagacgagcucuuggccuaaccacgacuccaauaagggagugaccgccgcuuguccccaugccggcgcgaaaucuuuuuauaagaaccugauuuggcucguuaaaaagggcaauagcuacccuaaacuguccaagagcuauaucaacgauaaggggaaagaagugcuuguccuguggggcauucaccaccccuccacaucugccgaccaacagagccucuaccagaaugcugaugccuacguguucgugggcaccuccagauauagcaagaaauuuaagccugagaucgcuauucggccgaaaguccgcgaccaggaggggagaaugaacuacuauuggacacugguugaacccggagauaagaucaccuucgaggccacgggcaaucugguggugccucgguacgcguuugccauggaacgcaacgcugggucuggaauuaucaucuccgacacacccguccaugacugcaacaccacaugucaaaccccuaaaggcgccauuaauaccagccuccccuuccagaacauccacccgauuacaaucggcaagugcccuaaguaugugaaaucuacgaagcugagacuugcuaccgggcugcggaauguucccagcauucagucccgcggacucuuuggcgccaucgccggguucaucgagggaggcuggacagggaugguggauggaugguacggcuaucaucaccagaacgaacaaggcucuggguacgcugcggaccugaaaagcacccagaaugccauugaugagaucacaaacaaggucaauuccgugauugagaaaaugaacacccaguuuacggcuguuggaaaggaguucaaucaccuugagaagagaaucgaaaaccugaauaaaaagguggacgauggcuuccucgacauuuggacauacaacgccgagcugcugguccuccuggaaaaugagcggacccuugauuaucaugacagcaacgugaaaaaucuguacgagaagguccgcucucagcucaaaaacaacgccaaggaaaucgggaauggauguuuugaguucuaucacaagugcgauaacaccuguauggaauccgugaaaaauggcacauacgacuauccuaaguacagcgaggaagcuaaacugaacagagaggagaucgaugggguuaaacuugaaucuacccggauuuaucaaauccuggccauuuacuccacaguggcgagcucccucguccuggugguuucucugggcgcuaucagcuuuuggaugugcuccaauggaucucuccagugccgcauuuguaucuga

SEQ ID NO: 188752 - RNA, 1701 nt, Artificial Sequence
  derived and/or modified sequence opt5 from hemagglutinin__InfluenzaA__ADM32028
augaaggccauccuggugguccuccuguacaccuucgcuacagccaacgcggacacgcuuugcauuggcuaucacgcuaauaacagcaccgauacaguugacaccgugcuggagaagaaugugacagucacccauuccguggaucuccuggaagacaagcacaacgggaaacuuuguaagcugagaggaguugcuccccuccaucugggcaaaugcaauaucgccggguggauucugggaaacccugagugugaaucucucagcacagccuccucuuggagcuacaucguggagaccuccucuagcgauaauggcacgugcuauccgggggacuuuauugauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaauccuuuuauaagaaccugaucuggcucguuaaaaagggcaauucuuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaucugguggugccucgguacgcguuugccauggaacgcaacgcugggucuggaaucauuaucuccgacacccccguccaugacugcaacacaaccugucaaaccccuaaaggcgccaucaauacaagccuccccuuccagaacgugcacccgauuacgaucggcaagugcccuaaguauguuaaaucuaccaagcugagacuugcuacagggcugcggaaugugcccagcauucagucccgcggacucuuuggcgccaucgccggguucauugagggaggcuggaccgggauggucgauggaugguacggcuaucaucaccagaacgaacaaggcucuggguacgcugcggaccugaaaagcacacagaaugccaucgaugagaucaccaacaaggugaauagcguuauugagaaaaugaacacgcaguuuacagcugugggaaaggaguucaaucaccuugagaagagaaucgaaaaccugaauaaaaaggucgacgauggcuuccucgacauuuggaccuacaacgccgagcugcuggugcuccuggaaaaugagcggacccuugauuaucaugacagcaacgucaaaaaucuguacgagaaggugcgcucucagcucaaaaacaacgccaaggaaaucgggaauggauguuuugaguucuaucacaagugcgauaacacauguauggaauccguuaaaaauggcaccuacgacuauccuaaguacagcgaggaagcuaaacugaacagagaggagauugauggggugaaacuugaaucuacacggaucuaucaaauccuggccauuuacuccacggucgcgagcucccucgugcugguugugucucugggcgcuaucagcuuuuggaugugcuccaauggaucucuccagugccgcauuuguaucuga

SEQ ID NO: 188753 - RNA, 1701 nt, Artificial Sequence; identical to SEQ ID NO: 187465
  derived and/or modified sequence opt5 from hemagglutinin__InfluenzaA__ADM32038

SEQ ID NO: 188754 - RNA, 1701 nt, Artificial Sequence; identical to SEQ ID NO: 185873
  derived and/or modified sequence opt5 from hemagglutinin__InfluenzaA__ADM32048

SEQ ID NO: 188755 - RNA, 1701 nt, Artificial Sequence; identical to SEQ ID NO: 186857
  derived and/or modified sequence opt5 from hemagglutinin__InfluenzaA__ADM32058

SEQ ID NO: 188756 - RNA, 1701 nt, Artificial Sequence; identical to SEQ ID NO: 186857
  derived and/or modified sequence opt5 from hemagglutinin__InfluenzaA__ADM32068

SEQ ID NO: 188757 - RNA, 1701 nt, Artificial Sequence; identical to SEQ ID NO: 185693
  derived and/or modified sequence opt5 from hemagglutinin__InfluenzaA__ADM32078

SEQ ID NO: 188758 - RNA, 1701 nt, Artificial Sequence; identical to SEQ ID NO: 187281
  derived and/or modified sequence opt5 from hemagglutinin__InfluenzaA__ADM32088

SEQ ID NO: 188759 - RNA, 1701 nt, Artificial Sequence
  derived and/or modified sequence opt5 from hemagglutinin__InfluenzaA__ADM32098
augaaggccauccuggugguccuccuguacaccuucgcuauugccaacgcggacacacuuugcaucggcuaucacgcuaauaacagcacggauaccguugacacagugcuggagaagaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacauccucuagcgacaacggaaccugcuauccgggggauuuuaucgacuacgaagaacugcgggagcagcuuuccagcgucucuuccuucgaacgcuuugagaucuuccccaagacgagcucuuggccuaaucacgauuccaacaagggagugaccgccgcuuguccccaugccggcgcgaaaucuuuuuauaagaaucugauuuggcucguuaaaaagggcaacagcuacccuaaacuguccaagagcuauaucaaugacaaggggaaagaagugcuuguccuguggggcauucaccaccccuccacaucugccgaucaacagagccucuaccagaacgcugacgccuacguguucgugggcaccuccagauauagcaagaaauuuaagccugagaucgcuauucggccgaaaguccgcgaucaggaggggagaaugaauuacuauuggacacugguugaacccggagacaagaucaccuucgaggccacgggcaaccugguggugccucgguacgcguuugccauggaacgcaacgcugggucuggaauuaucaucuccgauacacccguccaugacugcaauaccacaugucaaaccccuaaaggcgccauuaacaccagccuccccuuccagaauauccacccgauuacaaucggcaagugcccuaaguaugugaaaucuacgaagcugagacuugcuaccgggcugcggaacguucccagcauucagucccgcggacucuuuggcgccaucgccggguucaucgagggaggcuggacagggaugguggacggaugguacggcuaucaucaccagaaugaacaaggcucuggguacgcugcggaucugaaaagcacccagaacgccauugacgagaucacaaauaaggucaacuccgugauugagaaaaugaauacccaguuuacggcuguuggaaaggaguucaaccaccuugagaagagaaucgaaaaucugaacaaaaagguggaugacggcuuccucgauauuuggacauacaaugccgagcugcugguccuccuggaaaacgagcggacccuugacuaucaugauagcaaugugaaaaaccuguacgagaagguccgcucucagcucaaaaacaaugccaaggaaaucgggaacggauguuuugaguucuaucacaagugcgacaauaccuguauggaauccgugaaaaacggcacauacgauuauccuaaguacagcgaggaagcuaaacugaauagagaggagaucgacgggguuaaacuugaaucuacccggauuuaucaaauccuggccauuuacuccacaguggcgagcucccucguccuggugguuucucugggcgcuaucagcuuuuggaugugcuccaacggaucucuccagugccgcauuuguaucuga

SEQ ID NO: 188760 - RNA, 1701 nt, Artificial Sequence; identical to SEQ ID NO: 185693
  derived and/or modified sequence opt5 from hemagglutinin__InfluenzaA__ADM32108

SEQ ID NO: 188761 - RNA, 1701 nt, Artificial Sequence; identical to SEQ ID NO: 187465
  derived and/or modified sequence opt5 from hemagglutinin__InfluenzaA__ADM32551

SEQ ID NO: 188762 - RNA, 1701 nt, Artificial Sequence; identical to SEQ ID NO: 185873
  derived and/or modified sequence opt5 from hemagglutinin__InfluenzaA__ADM32561

SEQ ID NO: 188763 - RNA, 1701 nt, Artificial Sequence; identical to SEQ ID NO: 185873
  derived and/or modified sequence opt5 from hemagglutinin__InfluenzaA__ADM32571

SEQ ID NO: 188764 - RNA, 1701 nt, Artificial Sequence; identical to SEQ ID NO: 185693
  derived and/or modified sequence opt5 from hemagglutinin__InfluenzaA__ADM32581

SEQ ID NO: 188765 - RNA, 1701 nt, Artificial Sequence; identical to SEQ ID NO: 187465
  derived and/or modified sequence opt5 from hemagglutinin__InfluenzaA__ADM32591

SEQ ID NO: 188766 - RNA, 1701 nt, Artificial Sequence; identical to SEQ ID NO: 185693
  derived and/or modified sequence opt5 from hemagglutinin__InfluenzaA__ADM32601

SEQ ID NO: 188767 - RNA, 1701 nt, Artificial Sequence; identical to SEQ ID NO: 185693
  derived and/or modified sequence opt5 from hemagglutinin__InfluenzaA__ADM32611

SEQ ID NO: 188768 - RNA, 1701 nt, Artificial Sequence; identical to SEQ ID NO: 186857
  derived and/or modified sequence opt5 from hemagglutinin__InfluenzaA__ADM32621

SEQ ID NO: 188769 - RNA, 1701 nt, Artificial Sequence
  derived and/or modified sequence opt5 from hemagglutinin__InfluenzaA__ADM32631
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaacauccucgaagauaagcacaaugggaaacuguguaaacuuaagggaguugcgccccugcaucucggcaagugcaacauugccggguggauccugggaaauccugagugugaaucucugagcacagcuuccucuuggagcuacauuguggagaccuccucuagcgacaacggcacgugcuauccgggggauuuuaucgacuacgaagaacucagagagcagcuguccagcgucucuuccuucgaacgguuugagaucuuccccaagaccagcucuuggccuaaucacgauuccaacaaaggagugacagccgcuuguccccaugccggcgccaagagcuuuuauaaaaaucuuauuuggcugguuaagaaaggcaaccucuacccuaagcugucuaaguccuauaucaaugacaaagggaaggaagugcuuguccuguggggcauucaccaccccagcaccuccgccgaucaacagucucucuaccagaacgcugacgccuacguguucgugggaagcuccaaauauagcaagaaauuuaagccugagaucgcuauucgcccgaaagucagagaucaggaggggcggaugaauuacuauuggacacugguugaacccggagacaagaucaccuucgaggccacgggcaaccugguggugccucgcuacgcguuugccauggaaagaaacgcugggucuggaauuaucaucuccgauacacccguccauaauugcaacaccacaugucaaaccccuaagggcgccauuaauaccagccuccccuuccagaacauccacccgauuacaaucggcaaaugcccuaaguaugugaaaucuacgaagcugcggcuugcuaccgggcugcgcaauguucccagcauucaguccagaggacucuuuggcgccaucgccggguucaucgagggaggcuggacagggaugguggacggaugguacggcuaucaucaccagaacgaacaaggcucuggguacgcugcggaccugaaaagcacccagaaugccauugaugagaucacaaacaaggucaauuccgugauugagaagaugaacacccaguuuacggcuguuggaaaagaguucaaucaccuugagaagcggaucgaaaaccugaauaaaaagguggacgauggcuuccucgacauuuggacauacaacgccgagcugcugguccuccuggaaaaugagcgcacccuugauuaucaugacagcaacgugaaaaaccuguacgagaaggucagaucucagcucaagaauaacgccaaagaaaucgggaauggauguuuugaguucuaucacaagugcgauaacaccuguauggaauccgugaaaaauggcacauacgacuauccuaaguacagcgaggaagcuaaacugaaccgggaggagaucgaugggguuaaacuugaaucuacccgcauuuaucaaauccuggccauuuacuccacaguggcgagcucccucguccuggugguuucucugggcgcuaucagcuuuuggaugugcuccaauggaucucuccagugcagaauuuguaucuga

SEQ ID NO: 188770 - RNA, 1701 nt, Artificial Sequence; identical to SEQ ID NO: 186857
  derived and/or modified sequence opt5 from hemagglutinin__InfluenzaA__ADM32641

SEQ ID NO: 188771 - RNA, 1701 nt, Artificial Sequence; identical to SEQ ID NO: 185693
  derived and/or modified sequence opt5 from hemagglutinin__InfluenzaA__ADM32651

SEQ ID NO: 188772 - RNA, 1701 nt, Artificial Sequence
  derived and/or modified sequence opt5 from hemagglutinin__InfluenzaA__ADM32661
augaaggccauccuggugguccuccuguacaccuucgcuauugccaacgcggacacacuuugcaucggcuaucacgcuaauaacagcacggauaccguugacacagugcuggagaagaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacauccucuagcgacaacgggaccugcuauccgggcgauuuuaaugacuacgaagaacugcgggagcagcuuuccagcgucucuuccuucgaacgcuuugagaucuuccccaagacgagcucuuggccuaaccacgauuccaauaagggagugaccgccgcuuguccccaugccggcgcgaaaucuuuuuauaagaaccugaucuggcucguuaaaaagggcaauagcuacccuaaacuguccaagagcuauauuaacgacaaggggaaagaagugcuuguccuguggggaauccaccaccccuccacaucugccgaucaacagagccucuaccagaaugcugacgccuacguguucgugggcaccuccagauauagcaagaaauuuaagccugagauugcuauccggccgaaaguccgcgaucaggaggggagaaugaacuacuauuggacacugguugaacccggagacaagauuaccuucgaggccacgggcaaccugguggugccucgguacgcguuugccauggaacgcaaugcugggucuggaaucauuaucuccgauacacccguccaugacugcaacaccacaugucaaaccccuaaaggcgccaucaauaccagccuccccuuccagaacauucacccgaucacaauuggcaagugcccuaaguaugugaaaucuacgaagcugagacuugcuaccgggcugcggaauguucccagcauccagucccgcggacucuuuggcgccauugccggguucaucgagggaggcuggacagggaugguggacggaugguacggcuaucaucaccagaacgaacaaggcucuggguacgcugcggaucugaaaagcacccagaaugccaucgacgagauuacaaacaaggucaauuccgugaucgagaaaaugaacacccaguuuacggcuguuggaaaggaguucaaucaccuugagaagagaauugaaaaccugaauaaaaagguggaugacggcuuccucgauaucuggacauacaacgccgagcugcugguccuccuggaaaaugagcggacccuugacuaucaugauagcaacgugaaaaaccuguacgagaagguccgcucucagcucaaaaauaacgccaaggaaauugggaauggauguuuugaguucuaucacaagugcgacaacaccuguauggaauccgugaaaaauggcacauacgauuauccuaaguacagcgaggaagcuaaacugaacagagaggagaucgacgggguuaaacuugaaucuacccggaucuaucaaauucuggccaucuacuccacaguggcgagcucccucguccuggugguuucucugggcgcuauuagcuuuuggaugugcuccaauggaucucuccagugccgcaucuguauuuga

SEQ ID NO: 188773 - RNA, 1701 nt, Artificial Sequence; identical to SEQ ID NO: 187281
  derived and/or modified sequence opt5 from hemagglutinin__InfluenzaA__ADM32671

SEQ ID NO: 188774 - RNA, 1701 nt, Artificial Sequence; identical to SEQ ID NO: 185693
  derived and/or modified sequence opt5 from hemagglutinin__InfluenzaA__ADM32681

SEQ ID NO: 188775 - RNA, 1701 nt, Artificial Sequence; identical to SEQ ID NO: 185873
  derived and/or modified sequence opt5 from hemagglutinin__InfluenzaA__ADM32691

SEQ ID NO: 188776 - RNA, 1701 nt, Artificial Sequence; identical to SEQ ID NO: 185693
  derived and/or modified sequence opt5 from hemagglutinin__InfluenzaA__ADM32701

SEQ ID NO: 188777 - RNA, 1701 nt, Artificial Sequence; identical to SEQ ID NO: 185873
  derived and/or modified sequence opt5 from hemagglutinin__InfluenzaA__ADM32711

SEQ ID NO: 188778 - RNA, 1701 nt, Artificial Sequence; identical to SEQ ID NO: 185873
  derived and/or modified sequence opt5 from hemagglutinin__InfluenzaA__ADM32721

SEQ ID NO: 188779 - RNA, 1701 nt, Artificial Sequence; identical to SEQ ID NO: 185873
  derived and/or modified sequence opt5 from hemagglutinin__InfluenzaA__ADM32741

SEQ ID NO: 188780 - RNA, 1701 nt, Artificial Sequence; identical to SEQ ID NO: 185873
  derived and/or modified sequence opt5 from hemagglutinin__InfluenzaA__ADM32751

SEQ ID NO: 188781 - RNA, 1701 nt, Artificial Sequence; identical to SEQ ID NO: 187281
  derived and/or modified sequence opt5 from hemagglutinin__InfluenzaA__ADM32761

SEQ ID NO: 188782 - RNA, 1701 nt, Artificial Sequence
  derived and/or modified sequence opt5 from hemagglutinin__InfluenzaA__ADM32771
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccgaaagcuauauuaaugacaaggggaaggaggugcuuguccuguggggaauccaccaccccuccaccucugccgaucaacagagccucuaccagaacgcugacgccuacguguucgugggcacauccagauauagcaaaaaguuuaaaccugagauugcuauccggccgaagguccgcgaucaggaagggagaaugaauuacuauuggacccugguugagcccggagacaaaauuacguucgaagccacaggcaaccugguggugccucgguacgcguuugccauggagcgcaacgcugggucuggaaucauuaucuccgauacccccguccaugacugcaauacaaccugucaaaccccuaagggcgccaucaacacaagccuccccuuccagaauauucacccgaucacgauuggcaaaugcccuaaguaugugaagucuaccaaacugagacuugcuacagggcugcggaacguucccagcauccaguccaagggacucuuuggcgccauugccggguucaucgaaggaggcuggaccgggaugguggacggaugguacggcuaucaucaccagaaugagcaaggcucuggguacgcugcggaucugaaaagcacacagaacgccaucgacgagauuaccaauaaggucaacuccgugaucgaaaagaugaauacgcaguuuacagcuguuggaaaggaguucaaccaccuugaaaagcgcauugagaaucugaacaaaaagguggaugacggcuuccucgauaucuggaccuacaaugccgaacugcugguccuccuggagaacgagagaacccuugacuaucaugauagcaaugugaaaaaccuguacgaaaagguccggucucagcucaaaaacaaugccaaggagauugggaacggauguuuugaguucuaucacaagugcgacaauacauguauggaguccgugaaaaacggcaccuacgauuauccuaaguacagcgaagaggcuaaacugaaucgcgaggaaaucgacgggguuaaacuugagucuacaagaaucuaucaaauucuggccaucuacuccacgguggcgagcucccucguccuggugguuucucugggcgcuauuagcuuuuggaugugcuccaacggaucucuccagugccggaucuguauuuga

SEQ ID NO: 188783 - RNA, 1701 nt, Artificial Sequence
  derived and/or modified sequence opt5 from hemagglutinin__InfluenzaA__ADM32781
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccguggaucuccuggaagacaagcacaacgggaaacuuuguaagcugagaggaguugcuccccuccaucugggcaaaugcaauaucgccggguggauucugggaaacccugagugugaaucucucagcacagccuccucuuggagcuacaucguggagaccuccucuagcgauaauggcacgugcuauccgggggacuuuauugauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaucugguggugccucgguacgcguuugccauggaacgcaacgcugggucuggaaucauuaucuccgacacccccguccaugacugcaacacaaccugucaaaccccuaaaggcgccaucaauacgagcuuccccuuucagaacauucacccgaucacaauuggcaagugcccuaaguaugugaaaucuaccaagcucagacuggcuacagggcuucggaauguucccagcauccagucccgcggacuguucggcgccauugccggguuuaucgagggaggcuggaccgggaugguggauggaugguacggcuaucaucaccagaacgaacaaggcucuggguacgcugcggaccucaaaagcacacagaaugccaucgaugagauuaccaacaaggucaauuccgugaucgagaaaaugaacacgcaguucacagcuguuggaaaggaguucaaucaccuggagaagagaauugaaaaccuuaauaaaaagguggacgauggcuuucuggacaucuggaccuacaacgccgagcuccugguccugcucgaaaaugagcggacccuggauuaucaugacagcaacgugaaaaaucuuuacgagaagguccgcucucagcugaaaaacaacgccaaggaaauugggaauggauguuucgaguuuuaucacaagugcgauaacacauguauggaauccgugaaaaauggcaccuacgacuauccuaaguacagcgaggaagcuaaacucaacagagaggagaucgaugggguuaagcuggaaucuacacggaucuaucaaauucuugccaucuacuccacgguggcgagcucccugguccucgugguuucucugggcgcuauuagcuucuggaugugcuccaauggaucucugcagugccgcaucuguauuuga

SEQ ID NO: 188784 - RNA, 1701 nt, Artificial Sequence; identical to SEQ ID NO: 185873
  derived and/or modified sequence opt5 from hemagglutinin__InfluenzaA__ADM32791

SEQ ID NO: 188785 - RNA, 1701 nt, Artificial Sequence
  derived and/or modified sequence opt5 from hemagglutinin__InfluenzaA__ADM32801
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaaaauaagcacaacgggaaacuguguaaacuuagaggaguugcuccccugcaucucggcaagugcaauauugccggguggauccugggaaacccugagugugaaucucugagcacagccuccucuuggagcuacauuguggagaccuccucuagcgauaauggcacgugcuauccgggggacuuuaucgauuacgaagaacuccgggagcagcuguccagcgucucuuccuucgaacgcuuugagaucuuccccaagaccagcucuuggccuaaccacgacuccaauaagggagugacagccgcuuguccccaugccggcgcgaaaucuuuuuauaagaaccuuauuuggcugguuaaaaagggcaauagcuacccuaaacucuccaagagcuauaucaacgauaaggggaaagaagugcugguccuuuggggcauucaccaccccuccaccucugccgaccaacagagccuguaccagaaugcugaugccuacguguucgugggauccagcagauauucuaagaaauuuaagccugagaucgcuauucggccgaaaguccgcgaccaggaggggagaaugaacuacuauuggacacucguugaacccggagauaagaucaccuucgaggccacgggcaaccugguggugccucgguacgcguuugccauggaacgcaaugcuggguccggaauuaucaucagcgacacacccguccaugauugcaacaccacaugucaaaccccuaaaggcgccauuaauaccucucugcccuuccagaacauccacccgauuacaaucggcaagugcccuaaguaugugaaaagcacgaagcucagacuggcuaccgggcuucggaauguucccuccauucagucucgcggacuguuuggcgccaucgccggguucaucgagggaggcuggacagggaugguggacggaugguacggcuaucaucaccagaacgaacaaggcagcggguacgcugcggaccucaaauccacccagaaugccauugaugagaucacaaacaaggucaauagcgugauugagaaaaugaacacccaguuuacggcuguuggaaaggaguucaaucaccuggagaagagaaucgaaaaccuuaauaaaaagguggacgauggcuuccuggacauuuggacauacaacgccgagcuccugguccugcucgaaaaugagcggacccuggauuaucaugacucuaacgugaaaaaccuuuacgagaagguccgcucccagcugaaaaauaacgccaaggaaaucgggaauggauguuuugaguucuaucacaagugcgauaacaccuguauggaaagcgugaaaaauggcacauacgacuauccuaaguacucugaggaagcuaaacucaacagagaggagaucgaugggguuaagcuggaauccacccggauuuaucaaauccuugccauuuacagcacaguggcguccucucugguccucgugguuagccugggcgcuaucuccuuuuggaugugcucuaauggaagccugcagugccgcauuuguaucuga

SEQ ID NO: 188786 - RNA, 1701 nt, Artificial Sequence
  derived and/or modified sequence opt5 from hemagglutinin__InfluenzaA__ADM32811
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccacaauauucauccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaccaccagaaugaacagggcucuggguacgcugcggaucugaaaagcacacaaaacgccaucgacgagauuaccaauaaggucaacuccgugaucgagaaaaugaauacgcaguuuacagcuguuggaaaggaguucaaccaucuugagaagagaauugaaaaucugaacaaaaagguggaugacggcuuccucgauaucuggaccuacaaugccgagcugcugguccuccuggaaaacgagcggacccuugacuaucacgauagcaaugugaaaaaccuguacgagaagguccgcucucagcucaaaaacaaugccaaggaaauugggaacggauguuuugaguucuaucauaagugcgacaauacauguauggaauccgugaaaaacggcaccuacgauuauccuaaguacagcgaggaagcuaaacugaauagagaggagaucgacgggguuaaacuugaaucuacacggaucuaucagauucuggccaucuacuccacgguggcgagcucccucguccuggugguuucucugggcgcuauuagcuuuuggaugugcuccaacggaucucuccaaugccgcaucuguauuuga

SEQ ID NO: 188787 - RNA, 1701 nt, Artificial Sequence; identical to SEQ ID NO: 185693
  derived and/or modified sequence opt5 from hemagglutinin__InfluenzaA__ADM32821

SEQ ID NO: 188788 - RNA, 1701 nt, Artificial Sequence; identical to SEQ ID NO: 187281
  derived and/or modified sequence opt5 from hemagglutinin__InfluenzaA__ADM32831

SEQ ID NO: 188789 - RNA, 1701 nt, Artificial Sequence; identical to SEQ ID NO: 185873
  derived and/or modified sequence opt5 from hemagglutinin__InfluenzaA__ADM32841

SEQ ID NO: 188790 - RNA, 1701 nt, Artificial Sequence; identical to SEQ ID NO: 187281
  derived and/or modified sequence opt5 from hemagglutinin__InfluenzaA__ADM32851

SEQ ID NO: 188791 - RNA, 1701 nt, Artificial Sequence; identical to SEQ ID NO: 185873
  derived and/or modified sequence opt5 from hemagglutinin__InfluenzaA__ADM32861

SEQ ID NO: 188792 - RNA, 1701 nt, Artificial Sequence; identical to SEQ ID NO: 186857
  derived and/or modified sequence opt5 from hemagglutinin__InfluenzaA__ADM32871

SEQ ID NO: 188793 - RNA, 1701 nt, Artificial Sequence; identical to SEQ ID NO: 187860
  derived and/or modified sequence opt5 from hemagglutinin__InfluenzaA__ADM32881

SEQ ID NO: 188794 - RNA, 1701 nt, Artificial Sequence
  derived and/or modified sequence opt5 from hemagglutinin__InfluenzaA__ADM32929
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacaagauuaccaauaaagucaacuccgugaucgagaagaugaauacgcaguuuacagcuguuggaaaggaguucaaccaccuugagaaaagaauugagaaucugaacaagaaaguggaugacggcuuccucgauaucuggaccuacaaugccgaacugcugguccuccuggagaacgaacggacccuugacuaucaugauagcaaugugaagaaccuguacgagaaaguccgcucucagcucaagaacaaugccaaggagauugggaacggauguuuugaguucuaucacaaaugcgacaauacauguauggaauccgugaagaacggcaccuacgauuauccuaaauacagcgaagaggcuaagcugaauagagaagagaucgacgggguuaaacuugagucuacacggaucuaucaaauucuggccaucuacuccacgguggcgagcucccucguccuggugguuucucugggcgcuauuagcuuuuggaugugcuccaacggaucucuccgcugcagaaucuguauuuga

SEQ ID NO: 188795 - RNA, 1701 nt, Artificial Sequence
  derived and/or modified sequence opt5 from hemagglutinin__InfluenzaA__ADM32939
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagagccucuaccagaacgcugacgccuacguguucgugggcuccagcagauauucuaaaaaguuuaaaccugagauugcuauccggccgaagguccgcgaucaggaagggagaaugaauuacuauuggacacugguugagcccggagacaaaauuaccuucgaagccacgggcaaccugguggugccucgguacgcguuugccauggagcgcaacgcuggguccggaaucauuaucagcgauacacccguccaugacugcaauaccacaugucaaaccccuaagggcgccaucaacaccucucuccccuuccacaauauucauccgaucacaauuggcaaaugcccuaaguauguuaagagcacgaaacugagacuugcuaccgggcugcggaacauccccuccauucagucucgcggacucuuuggcgccaucgccggguucaucgaaggaggcuggacagggaugguggacggaugguacggcuaucaccaccagaaugagcagggcagcggguacgcugcggaucugaaguccacccaaaacgccauugacgagaucacaaauaaagugaacagcgucauugaaaagaugaauacccaguuuacggcugugggaaaagaguucaaccaucuugaaaagagaaucgagaaucugaacaagaaaguugaugacggcuuccucgauauuuggacauacaaugccgaacugcuggugcuccuggagaacgagcggacccuugacuaucacgauucuaaugucaagaaccuguacgaaaaagugcgcucccagcucaagaacaaugccaaagagaucgggaacggauguuuugaguucuaucauaagugcgacaauaccuguauggaaagcgucaagaacggcacauacgauuauccuaaauacucugaagaggcuaagcugaauagagaggaaaucgacggggugaaacuugaguccacccggauuuaucagauccuggccauuuacagcacaguugcguccucucucgugcuggucgugagccugggcgcuaucuccuuuuggaugugcucuaacggaagccuccgcugcagaauuuguaucuga

SEQ ID NO: 188796 - RNA, 1701 nt, Artificial Sequence
  derived and/or modified sequence opt5 from hemagglutinin__InfluenzaA__ADM32949
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaauccuuuuauaagaaucugaucuggcucguuaaaaagggcaacucuuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaacggcgccaucaauacaagccuccccuuccagaacauucacccgaucacgauuggcaaaugcccuaaguaugugaagucuaccaaacugagacuugcuacagggcugcggaauauccccagcauucagucccgcggacucuuuggcgccaucgccggguucaucgagggaggcuggaccgggaugguugacggaugguacggcuaucaucaccagaacgaacaaggcucuggguacgcugcggaucuuaagagcacacagaaugccauugacgagaucaccaacaaagugaauagcgucauugagaagaugaacacgcaguuuacagcugugggaaaagaguucaaucaccuggagaagagaaucgaaaaccugaauaagaaaguugaugacggcuuccucgauauuuggaccuacaacgccgagcugcuggugcuccuggaaaaugagcggacccuugacuaucaugauagcaacgucaagaaccuguacgagaaagugcgcucucagcucaagaauaacgccaaagaaaucgggaauggauguuuugaguucuaucacaagugcgacaacacauguauggaauccgucaagaauggcaccuacgauuauccuaaauacagcgaggaagcuaagcugaacagagaggagaucgacggggugaaacuugaaucuacacggauuuaucaaauccuggccauuuacuccacgguugcgagcucccucgugcuggucgugucucugggcgcuaucagcuuuuggaugugcuccaauggaucucuccgcugcagaauuuguaucuga

SEQ ID NO: 188797 - RNA, 1701 nt, Artificial Sequence
  derived and/or modified sequence opt5 from hemagglutinin__InfluenzaA__ADM32958
augaaggccauccugguguuccuccuguacaccuuugcuacagccaacgcggacacgcuuugcauuggcuaucacgcuaauaacagcaccgauacagucgacaccguucuggagaagaaugugacagugacccauuccgucaacauccucgaagauaagcacaaugggaaacuguguaaacuuagaggaguggcuccccugcaucucggcaaaugcaacauugccggguggauccugggaaauccugagugugaaucucugagcacagccuccucuuggagcuacauuguugagaccuccucuagcgacaacggcacgugcuauccgggggauuucaucgacuacgaggaacuccgggagcagcuguccagcgugucuuccuuugaacgcuucgagaucuuucccaagaccagcucuuggccuaaucacgauuccaacaagggagucacagccgcuuguccccaugccggcgcgaaaucuuucuauaagaaucuuauuuggcuggugaaaaagggcaacagcuacccuaaacucuccaagagcuauaucaaugacaaggggaaagaaguucuggugcuuuggggcauucaccaccccuccaccucugccgaucaacagagccuguaccagaacgcugacgccuacgucuuuguggaguccagcagauauucuaagaaauucaagccugagaucgcuauucggccgaaagugcgcgaucaggaaggaagaaugaauuacuauuggacacucgucgagcccggggacaagaucaccuuugaagccacgggaaaccugguugugccucgguacgcguucgccauggagcgcaacgcuggcuccgggauuaucaucagcgauacacccgugcaugacugcaauaccacaugucaaaccccuaaaggagccauuaacaccucucugcccuuucagaauauccacccgauuacaaucggcaagugcccuaaguaugucaaaagcacgaagcucagacuggcuaccggccuucggaacgugcccuccauucagucucgcgggcuguucggagccaucgccggcuuuaucgaagggggauggacaggcaugguugacgggugguacggauaucaucaccagaaugagcaaggcagcggcuacgcugcggaucucaaauccacccagaacgccauugacgagaucacaaauaaggugaacagcgucauugaaaagaugaauacccaguucacggcuguggggaaggaguucaaccaccuggaaaagagacuugagaaucugaacaaaaagguugaugacggauuucucgauaucuggacauacaaugccgaacugcuggugcuccuggagaacgagcggacccuugacuaucaugauucuaaugucaaaaaccuguacgaaaaggugcgcucccagcucaaaaacaaugccaaggaggucggcaacggguguuucgaauuuuaucacaagugcgacaauaccuguauggagagcgugaaaaacggaacauacgauuauccuaaguacucugaagaggcuaaacugaauagagaggaaauugacggcguuaaacuugaguccacccggaucuaucaaauccuggccauuuacagcacagcggcuuccucucucgugcuggucgugagccugggggccaucuccuucuggaugugcucuaacggcagccuccgcugcagaauuuguaucuga

SEQ ID NO: 188798 - RNA, 1701 nt, Artificial Sequence
  derived and/or modified sequence opt5 from hemagglutinin__InfluenzaA__ADM32977
augaaggccauccuggugguccuccugugcaccuucgcuacagccaacgcggacacgcuuuguauuggcuaccacgcuaauaacagcaccgauacaguugacaccgugcuggagaaaaaugugacagucacccauuccgugaaccuccuggaagauaagcacaaugggaaacuuugcaagcugagaggaguugcuccccuccaucugggcaaauguaacaucgccggguggauucugggaaauccugagugcgaaucucucagcacagccuccucuuggagcuauaucguggagaccuccucuagcgacaacggcacguguuacccgggggauuuuauugacuaugaagaacugcgggagcagcuuuccagcgucucuuccuucgaacgcuuugagaucuuccccaagaccagcucuuggccuaaucacgauuccaacaagggagugacagccgcuugcccccaugccggcgcgaaaucuuuuuacaagaaucugaucuggcucguuaaaaagggcaacagcuauccuaaacuguccaagagcuacauuaaugacaaggggaaagaagugcuuguccuguggggaauccaccaccccuccaccucugccgaucaacagagccucuaucagaacgcugacgccuacguguucgugggcacauccaaguacagcaaaaaguuuaaaccugagauugcuaucagaccgaagguccgggaucaggaggggcgcaugaauuauuacuggacccugguugaacccggagacaaaauuacguucgaggccacaggcaaccugguggugccuagauaugcguuugccauggaacggaacgcugggucuggaaucauuaucuccgauacccccguccaugacuguaauacaaccugccaaaccccuaagggcgccaucaacacaagccuccccuuccagaauauucacccgaucacgauuggcaaguguccuaaauacgugaagucuaccaaacugcgccuugcuacagggcugagaaacguucccagcauccagucccggggacucuuuggcgccauugccggguucaucgagggaggcuggaccgggaugguggacggaugguauggcuaccaucaccagaaugaacaaggcucuggguaugcugcggaucuuaagagcacacagaacgccaucgacggaauuaccaauaaaaucaacuccgucauugagaagaugaauacgcaguuuacagcugugggcaaggaguucaaccaccuggaaaaacgcaucgagaaucugaacaagaaaguugaugacggguuccucgauauuuggaccuacaaugccgaacugcuggugcuccuggagaacgaaagaacccuugacuaccaugauagcaaugucaagaaccuguaugagaaagugcggucucagcucaagaacaaugccaaggagaucggaaacggcugcuuugaguucuaccacaaaugugacaauacaugcauggaguccgucaagaacgggaccuaugauuacccuaaauauagcgaagaggcuaagcugaaucgcgaagagaucgacggcgugaaacuugagucuacaagaauuuaccaaauccuggccauuuauuccacgguugcgagcucccucgugcuggucgugucucugggagcuaucagcuuuuggaugugcuccaacggcucucuccggugucgcauuugcaucuga

SEQ ID NO: 188799 - RNA, 1701 nt, Artificial Sequence
  derived and/or modified sequence opt5 from hemagglutinin__InfluenzaA__ADM32986
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccaauagcuggccuaaccacgauucuaauaagggagugacagccgcuuguccccaugccggcgcgaaauccuuuuauaagaaccugaucuggcucguuaaaaagggcaauagcuacccuaaacugucuaaguccuauauuaacgacaaggggaaagaagugcuuguccuguggggaauccaccaccccagcaccuccgccgaucaacagucucucuaccagaaugcugacgccuacguguucgugggcacaagcaaguauuccaaaaaguuuaaaccugagauugcuaucagaccgaagguccgggaucaggaggggcgcaugaacuacuauuggacccugguugaacccggagacaaaauuacguucgaggccacaggcaaccugguggugccuagauacgcguuugccauggaacggaaugcugggagcggaaucauuaucucugauacccccguccaugacugcaacacaaccugucaaaccccuaagggcgccaucaauacaucccuccccuuccagaacauucacccgaucacgauuggcaagugcccuaaauauguuaagagcaccaaacugcgccuugcuacagggcugagaaaugugcccucuauccagagccggggacucuuuggcgccauugccggguucaucgagggaggcuggaccgggaugguggacggaugguacggcuaucaucaccagaacgaacaaggcuccggguacgcugcggaucugaagucuacacagaaugccaucgacggaauuaccaacaaaaucaauagcgucauugagaagaugaacacgcaguuuacagcugugggcaaggaguucaaucaccuugaaaaacgcaucgagaaccugaauaagaaaguugaugacggguuccucgauauuuggaccuacaacgccgaacugcuggugcuccuggagaaugaaagaacccuuaacuaucaugacuccaacgucaagaaucuguacgagaaagugcggagccagcucaagaacaaugccaaggagaucggaaacggcuguuuugaguucuaucacaaaugcgauaauacauguauggagucugucaagaacgggaccuacgacuauccuaaauacuccgaagaggcuaagcugaaucgcgaagagaucgauggcgugaaacuugagagcacaagaauuuaucaaauccuggccauuuacucuacgguugcguccagccucgugcuggucgugucccugggagcuaucucuuuuuggaugugcagcaacggcucccuccggugccgcauuuguaucuga

SEQ ID NO: 188800 - RNA, 1701 nt, Artificial Sequence
  derived and/or modified sequence opt5 from hemagglutinin__InfluenzaA__ADM32995
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccaauagcuggccuaaccacgauucuaauaagggagugacagccgcuuguccccaugccggcgcgaaauccuuuuauaagaaccugaucuggcucguuaaaaagggcaauagcuacccuaaacugucuaaguccuauauuaacgacaaggggaaagaagugcuuguccuguggggaauccaccaccccagcaccuccgccgaucaacagucucucuaccagaaugcugacgccuacguguucgugggcacaagcaaguauuccaaaaaguuuaaaccugagauugcuaucagaccgaagguccgggaucaggaggggcgcaugaacuacuauuggacccugguugaacccggagacaaaauuacguucgaggccacaggcaaccugguggugccuagauacgcguuugccauggaacggaaugcugggagcggaaucauuaucucugauacccccguccaugacugcaacacaaccugucaaaccccuaagggcgccaucaauacaucccuccccuuccagaacauucacccgaucacgauuggcaagugcccuaaauauguuaagagcaccaaacugcgccuugcuacagggcugagaaaugugcccucuauccagagccggggacucuuuggcgccauugccggguucaucgagggaggcuggaccgggaugguggacggaugguacggcuaucaucaccagaacgaacaaggcuccggguacgcugcggaucugaagucuacacagaaugccaucgacggaauuaccaacaaaaucaauagcgucauugagaagaugaacacgcaguuuacagcugugggcaaggaguucaaucaccuugaaaaacgcaucgagaaccugaauaagaaaguugaugacggguuccucgauauuuggaccuacaacgccgaacugcuggugcuccuggagaaugaaagaacccuugacuaucaugauuccaacgucaagaaccuguacgagaaagugcggagccagcucaagaauaacgccaaggagaucggaaauggcuguuuugaguucuaucacaaaugcgacaacacauguauggagucugucaagaaugggaccuacgauuauccuaaauacuccgaagaggcuaagcugaaccgcgaagagaucgacggcgugaaacuugagagcacaagaauuuaucaaauccuggccauuuacucuacgguugcguccagccucgugcuggucgugucccugggagcuaucucuuuuuggaugugcagcaauggcucccuccggugccgcauuuguaucuga

SEQ ID NO: 188801 - RNA, 1701 nt, Artificial Sequence; identical to SEQ ID NO: 186794
  derived and/or modified sequence opt5 from hemagglutinin__InfluenzaA__ADM33004

SEQ ID NO: 188802 - RNA, 1701 nt, Artificial Sequence; identical to SEQ ID NO: 185693
  derived and/or modified sequence opt5 from hemagglutinin__InfluenzaA__ADM33023

SEQ ID NO: 188803 - RNA, 1701 nt, Artificial Sequence
  derived and/or modified sequence opt5 from hemagglutinin__InfluenzaA__ADM33040
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucuccccuuccagaauauucacccgaucacaauuggcaagugcccuaaguaugugaaaagcacgaagcugagacuugcuaccgggcugcggaacguucccuccauccagucucgcggacucuuuggcgccauugccggguucaucgagggaggcuggacagggaugguggacggaugguacggcuaucaucaccagaaugaacaaggcagcggguacgcugcggaucugaaauccacccagaacgccaucgacgagauuacaaauaaggucaacagcgugaucgagaaaaugaauacccaguuuacggcuguuggaaaggaguucaaccaccuugagaagagaauugaaaaucugaacaaaaagguggaugacggcuuccucgauaucuggacauacaaugccgagcugcugguccuccuggaaaacgagcggacccuugacuaucaugauucuaaugugaaaaaccuguacgagaagguccgcucccagcucaaaaacaaugccaaggaaauugggaacggauguuuugaguucuaucacaagugcgacaauaccuguauggaaagcgugaaaaacggcacauacgauuauccuaaguacucugaggaagcuaaacugaauagagaggagaucgacgggguuaaacuugaauccacccggaucuaucaaauucuggccaucuacagcacaguggcguccucucucguccuggugguuagccugggcgcuauuuccuuuuggaugugcucuaacggaagccuccgcugcagaaucuguauuuga

SEQ ID NO: 188804 - RNA, 1701 nt, Artificial Sequence
  derived and/or modified sequence opt5 from hemagglutinin__InfluenzaA__ADM33050
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacugaauaaguccuauauuaacgacaaggggaaagaagugcuuguccuguggggaauccaccaccccagcaccuccgccgaucaacagucucucuaccagaaugcugacgccuacguguucgugggcacaagcagauauuccaagaaauuuaagccugagauugcuauccggccgaaaguccgcgaucaggaggggagaaugaacuacuauuggacccugguugaacccggagacaagauuacguucgaggccacaggcaaccugcucgugccucgguacgcguuugccauggaacgcaaugcugggagcggaaucauuaucucugauacccccgugcaugacugcaacacaaccugucaaaccccuaaaggcgccaucaauacaucccugcccuuccagaacauucacccgaucacgauuggcaagugcccuaaguaugucaaaagcaccaaacuuagacuggcuacagggcuccggaaugugcccucuauccagagccgcggacuguuuggcgccauugccggguucaucgagggaggcuggaccgggaugguugacggaugguacggcuaucaucaccagaacgaacaaggcuccggguacgcugcggaucuuaagucuacacagaaugccaucgacgagauuaccaacaaggugaauagcgucaucgagaaaaugaacacgcaguuuacagcugugggaaaggaguucaaucaccuggagaagagaauugaaaaccucaauaaaaagguugaugacggcuuccuggauaucuggaccuacaacgccgagcugcucgugcugcuugaaaaugagcggacccuggacuaucaugauuccaacgucaaaaaccucuacgagaaggugcgcagccagcugaaaaauaacgccaaggaaauugggaauggauguuuugaguucuaucacaagugcgacaacacauguauggaaucugucaaaaauggcaccuacgauuauccuaaguacuccgaggaagcuaaacuuaacagagaggagaucgacggggugaagcuggaaagcacacggaucuaucaaauucucgccaucuacucuacgguugcguccagccuggugcuggucgugucccucggcgcuauuucuuuuuggaugugcagcaauggaucccugcgcugcagaaucuguauuuga

SEQ ID NO: 188805 - RNA, 1701 nt, Artificial Sequence
  derived and/or modified sequence opt5 from hemagglutinin__InfluenzaA__ADM33069
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccugagggcgccaucaacacaagccuccccuuccagaauauucacccgaucacgauuggcaaaugcccuaaguaugugaagucuaccaaacugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaucuuaagagcacacagaacgccaucgacgagauuaccaauaaagucaacuccgugaucgaaaagaugaauacgcaguuuacagcuguuggaaaagaguucaaccaccuggaaaagagaauugagaaucugaacaagaaaguggaugacggcuuccucgauaucuggaccuacaaugccgaacugcugguccuccuggagaacgagcggacccuugacuaucaugauagcaaugugaagaaccuguacgaaaaaguccgcucucagcucaagaacaaugccaaagagauugggaacggauguuuugaguucuaucacaagugcgacaauacauguauggaguccgugaagaacggcaccuacgauuauccuaaauacagcgaagaggcuaagcugaauagagaggaaaucgacgggguuaaacuugagucuacacggaucuaucaaauucuggccaucuacuccacgguggcgagcucccucguccuggugguuucucugggcgcuauuagcuuuuggaugugcuccaacggaucucuccgcugcagaaucuguauuuga

SEQ ID NO: 188806 - RNA, 1701 nt, Artificial Sequence
  derived and/or modified sequence opt5 from hemagglutinin__InfluenzaA__ADM33079
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggaucuaucaaauucuggccaucuacuccacgguggcgagcucccucguccuggugguuucucugggcgcuauuagcuuuuggaugugcuccaacggaucucuccgcugcagaaucuguauuuga

SEQ ID NO: 188807 - RNA, 1701 nt, Artificial Sequence
  derived and/or modified sequence opt5 from hemagglutinin__InfluenzaA__ADM33099
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugauggugccucgguacgcguuugccauggaacgcaacgcugggucuggaaucauuaucuccgauacccccgugcaugacugcaauacaaccugucaaaccccuaaaggcgccaucaacacaagccuccccuuccagaauauucacccgaucacgauuggcaagugcccuaaguaugucaaaucuaccaagcugagacuugcuacagggcugcggaacgugcccagcauccagucccgcggacucuuuggcgccauugccggguucaucgagggaggcuggaccgggaugguugacggaugguacggcuaucaucaccagaaugaacaaggcucuggguacgcugcggaucugaaaagcacacagaacgccaucgacgagauuaccaauaaggugaacuccgucaucgagaaaaugaauacgcaguuuacagcugugggaaaggaguucaaccaccuugagaagagaauugaaaaucugaacaaaaagguugaugacggcuuccucgauaucuggaccuacaaugccgagcugcuggugcuccuggaaaacgagcggacccuugacuaucaugauagcaaugucaaaaaccuguacgagaaggugcgcucucagcucaaaaacaaugccaaggaaauugggaacggauguuuugaguucuaucacaagugcgacaauacauguauggaauccgucaaaaacggcaccuacgauuauccuaaguacagcgaggaagcuaaacugaauagagaggagaucgacggggugaaacuugaaucuacacggaucuaucaaauucuggccaucuacuccacgguugcgagcucccucgugcuggucgugucucugggcgcuauuagcuuuuggaugugcuccaacggaucucuccgcugcagaaucuguauuuga

SEQ ID NO: 188808 - RNA, 1701 nt, Artificial Sequence; identical to SEQ ID NO: 188807
  derived and/or modified sequence opt5 from hemagglutinin__InfluenzaA__ADM33109

SEQ ID NO: 188809 - RNA, 1701 nt, Artificial Sequence
  derived and/or modified sequence opt5 from hemagglutinin__InfluenzaA__ADM33128
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaccugaaaagcacacagaacgccaucgaugagauuaccaauaaggucaacuccgugaucgaaaagaugaauacgcaguuuacagcuguuggaaaggaguucaaccaccuugaaaagagaauugagaaucugaacaaaaagguggacgauggcuuccucgacaucuggaccuacaaugccgaacugcugguccuccuggagaacgagcggacccuugauuaucaugacagcaaugugaaaaaccuguacgaaaagguccgcucucagcucaaaaacaaugccaaggagauugggaacggauguuuugaguucuaucacaagugcgauaauacauguauggaguccgugaaaaacggcaccuacgacuauccuaaguacagcgaagaggcuaaacugaauagagaggaaaucgaugggguuaaacuugagucuacacggaucuaucaaauucuggccaucuacuccacgguggcgagcucccucguccuggugguuucucugggcgcuauuagcuuuuggaugugcuccaacggaucucuccgcugcagaaucuguauuuga

SEQ ID NO: 188810 - RNA, 1701 nt, Artificial Sequence; identical to SEQ ID NO: 188809
  derived and/or modified sequence opt5 from hemagglutinin__InfluenzaA__ADM33137

SEQ ID NO: 188811 - RNA, 1701 nt, Artificial Sequence; identical to SEQ ID NO: 188809
  derived and/or modified sequence opt5 from hemagglutinin__InfluenzaA__ADM33147

SEQ ID NO: 188812 - RNA, 1701 nt, Artificial Sequence; identical to SEQ ID NO: 188809
  derived and/or modified sequence opt5 from hemagglutinin__InfluenzaA__ADM33157

SEQ ID NO: 188813 - RNA, 1701 nt, Artificial Sequence
  derived and/or modified sequence opt5 from hemagglutinin__InfluenzaA__ADM33167
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggaacauccagauauagcaagaaauuuaagccugagaucgcuauucggccgaaaguccgcgaucaggaggggagaaugaauuacuauuggacccucguugaacccggagacaagaucacguucgaggccacaggcaaccugguggugccucgguacgcguuugccauggaacgcaacgcugggucuggaauuaucaucuccgauacccccguccaugacugcaauacaaccugucaaaccccuaaaggcgccauuaacacaagccugcccuuccagaauauccacccgauuacgaucggcaagugcccuaaguaugugaaaucuaccaagcucagacuggcuacagggcuucggaacguucccagcauucagucccgcggacuguuuggcgccaucgccggguucaucgagggaggcuggaccgggaugguggacggaugguacggcuaucaucaccagaaugaacaaggcucuggguacgcugcggaucucaaaagcacacagaacgccauugacgagaucaccaauaaggucaacuccgugauugagaaaaugaauacgcaguuuacagcuguuggaaaggaguucaaccaccuggagaagagaaucgaaaaucuuaacaaaaagguggaugacggcuuccuggauauuuggaccuacaaugccgagcuccugguccugcucgaaaacgagcggacccuggacuaucaugauagcaaugugaaaaaccuuuacgagaagguccgcucucagcugaaaaacaaugccaaggaaaucgggaacggauguuuugaguucuaucacaagugcgacaauacauguauggaauccgugaaaaacggcaccuacgauuauccuaaguacagcgaggaagcuaaacucaauagagagaagaucgacgggguuaaacuggagucuacacggauuuaucaaauccuugccauuuacuccacgguggcgagcucccugguccucgugguuucucugggcgcuaucagcuuuuggaugugcuccaacggaucucugcgcugcagaauuuguaucuga

SEQ ID NO: 188814 - RNA, 1701 nt, Artificial Sequence; identical to SEQ ID NO: 187880
  derived and/or modified sequence opt5 from hemagglutinin__InfluenzaA__ADM33177

SEQ ID NO: 188815 - RNA, 1701 nt, Artificial Sequence; identical to SEQ ID NO: 188809
  derived and/or modified sequence opt5 from hemagglutinin__InfluenzaA__ADM33186

SEQ ID NO: 188816 - RNA, 1701 nt, Artificial Sequence; identical to SEQ ID NO: 188809
  derived and/or modified sequence opt5 from hemagglutinin__InfluenzaA__ADM33195

SEQ ID NO: 188817 - RNA, 1701 nt, Artificial Sequence; identical to SEQ ID NO: 188806
  derived and/or modified sequence opt5 from hemagglutinin__InfluenzaA__ADM33204

SEQ ID NO: 188818 - RNA, 1701 nt, Artificial Sequence
  derived and/or modified sequence opt5 from hemagglutinin__InfluenzaA__ADM33222
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagagccucuaccagaacgcugacgccuacguguucgugggcuccagcagauauucuaaaaaguuuaaaccugagauugcuauccggccgaagguccgcgaucaggaagggagaaugaauuacuauuggacacugguugagcccggagacaaaauuaccuucgaagccacgggcaaccugguggugccucgguacgcguuugccauggagcgcaacgcuggguccggaaucauuaucagcgauacacccguccaugacugcaauaccacaugucaaaccccuaagggcgccaucaacaccucucuccccuuccacaauauucauccgaucacaauuggcaaaugcccuaaguauguuaagagcacgaaacugagacuugcuaccgggcugcggaacgugcccuccauccagucucgcggacucuuuggcgccauugccggguucaucgaaggaggcuggacagggaugguggacggaugguacggcuaucaccaccagaaugagcagggcagcggguacgcugcggaucugaaguccacccaaaacgccaucgacgagauuacaaauaaagucaacagcgugaucgaaaagaugaauacccaguuuacggcuguuggaaaagaguucaaccaucuugaaaagagaauugagaaucugaacaagaaaguggaugacggcuuccucgauaucuggacauacaaugccgaacugcugguccuccuggagaacgagcggacccuugacuaucacgauucuaaugugaagaaccuguacgaaaaaguccgcaaccagcucaagaauaacgccaaagagauugggaauggauguuuugaguucuaucauaagugcgacaacaccuguauggaauccgugaagaauggcacauacgauuauccuaaauacagcgaagaggcuaagcugaacagagaggaaaucgacgggguuaaacuugagucuacccggaucuaucagauucuggccaucuacuccacaguggcgagcucccucguccuggugguuucucugggcgcuauuagcuuuuggaugugcuccaauggaucucuccgcugcagaaucuguauuuga

SEQ ID NO: 188819 - RNA, 1701 nt, Artificial Sequence
  derived and/or modified sequence opt5 from hemagglutinin__InfluenzaA__ADM33232
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagagccucuaccagaacgcugacgccuacguguucgugggcuccagcagauauucuaaaaaguuuaaaccugagauugcuauccggccgaagguccgcgaucaggaagggagaaugaauuacuauuggacacugguugagcccggagacaaaauuaccuucgaagccacgggcaaccugguggugccucgguacgcguuugccauggagcgcaacgcuggguccggaaucauuaucagcgauacacccguccaugacugcaauaccacaugucaaaccccuaagggcgccaucaacaccucucuccccuuccacaauauucauccgaucacaauuggcaaaugcccuaaguauguuaagagcacgaaacugagacuugcuaccgggcugcggaacgugcccuccauccagucucgcggacucuuuggcgccauugccggguucaucgaaggaggcuggacagggaugguggacggaugguacggcuaucaccaccagaaugagcagggcagcggguacgcugcggaucugaaguccacccaaaacgccaucgacgagauuacaaauaaagucaacagcgugaucgaaaagaccaauacgcaguuuacagcuguuggaaaagaguucaaccaucuugaaaagagaauugagaaucugaacaagaaaguggaugacggcuuccucgauaucuggaccuacaaugccgaacugcugguccuccuggagaacgagcggacccuugacuaucacgauucuaaugugaagaaccuguacgaaaaaguccgcaaccagcucaagaauaacgccaaagagauugggaauggauguuuugaguucuaucauaagugcgacaacacauguauggaauccgugaagaauggcaccuacgauuauccuaaauacagcgaagaggcuaagcugaacagagaggaaaucgacgggguuaaacuugagucuacacggaucuaucagauucuggccaucuacuccacgguggcgagcucccucguccuggugguuucucugggcgcuauuagcuuuuggaugugcuccaauggaucucuccaaugccgcaucuguauuuga

SEQ ID NO: 188820 - RNA, 1701 nt, Artificial Sequence
  derived and/or modified sequence opt5 from hemagglutinin__InfluenzaA__ADM33241
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaaaugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaaggaaaacagcuacccuaaacucuccaagagcuauaucaaugacaagggcaaagaggugcugguccuuugggggauucaccaccccuccaccucugccgaucaacagagccuguaccagaacgcugacgccuacguguucgugggauccagcagauauucuaagaaauuuaagccugagaucacaauucggccgaaaguccgcgaucaggaaggcagaaugaauuacuauuggacccucguugagcccggggacaagaucacguucgaagcuacaggaaaccugguggugccucgguacgccuuugcgauggagcgcaacgccggcuccgggauuaucaucagcgauacccccguccaugacugcaauacaaccugucaaaccccuaaaggagcuauuaacacaucucugcccuuccagaauauccacccgauuacgaucggcaagugcccuaaguaugugaaaagcaccaagcucagacuggccacaggccuucggaacguucccuccauucagucucgcgggcuguuuggagcuaucgccggcuucaucgaagggggauggaccggcaugguggacgggugguacggauaucaucaccagaaugagcaaggcagcggcuacgccgcugaucucaaauccacacagaacgcgauugacgagaucaccaauaaggucaacagcgugauugaaaagaugaauacgcaguuuacagccguugggaaggaguucaaccaccuggaaaagagaaucgagaaucuuaacaaaaagguggaugacggauuccuggauauuuggaccuacaaugcugaacuccugguccugcucgagaacgagcggacccuggacuaucaugauucuaaugugaaaaaccuuuacgaaaagguccgcucccagcugaaaaacaaugccaaggagaucggcaacggguguuuugaguucuaucacaagugcgacaauacauguauggagagcgugaaaaacggaaccuacgauuauccuaaguacucugaagaggccaaacucaauagagaggaaaucgacggcguuaagcuggaguccacacggauuuaucaaauccuugcuauuuacagcacgguggccuccucucugguccucgugguuagccugggggcgaucuccuuuuggaugugcucuaacggcagccugcgcugcagaauuuguaucuga

SEQ ID NO: 188821 - RNA, 1701 nt, Artificial Sequence; identical to SEQ ID NO: 188818
  derived and/or modified sequence opt5 from hemagglutinin__InfluenzaA__ADM33251

SEQ ID NO: 188822 - RNA, 1701 nt, Artificial Sequence
  derived and/or modified sequence opt5 from hemagglutinin__InfluenzaA__ADM33260
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcgacagcuacccuaaacucuccaagagcuauaucaacgauaaggggaaagaagugcugguccuuuggggcauucaccaccccuccaccucugccgaccaacagagccuguaccagaaugcugaugccuacguguucgugggauccagcagauauucuaagaaauuuaagccugagaucgcuauucggccgaaaguccgcgaccaggaggggagaaugaacuacuauuggacacucguugaacccggagauaagaucaccuucgaggccacgggcaaucugguggugccucgguacgcguuugccauggaacgcaacgcuggguccggaauuaucaucagcgacacacccguccaugacugcaacaccacaugucaaaccccuaaaggcgccauuaauaccucucugcccuuccagaacauccacccgauuacaaucggcaagugcccuaaguaugugaaaagcacgaagcucagacuggcuaccgggcuucggaauguucccuccauucagucucgcggacuguuuggcgccaucgccggguucaucgagggaggcuggacagggaugguggauggaugguacggcuaucaucaccagaacgaacaaggcagcggguacgcugcggaccucaaauccacccagaaugccauugaugagaucacaaacaaggucaauagcgugauugagaaaaugaacacccaguuuacggcuguuggaaaggaguucaaucaccuggagaagagaaucgaaaaccuuaauaaaaagguggacgauggcuuccuggacauuuggacauacaacaccgagcuccugguccugcucgaaaaugagcggacccuggauuaucaugacucuaacgugaaaaaucuuuacgagaagguccgcucccagcugaaaaacaacgccaaggaaaucgggaauggauguuuugaguucuaucacaagugcgauaacacauguauggaaagcgugaaaaauggcaccuacgacuauccuaaguacucugaggaagccaaacucaacagagaggagaucgaugggguuaagcuggaauccacacggauuuaucaaauccuugcuauuuacagcacgguggccuccucucugguccucgugguuagccugggcgcgaucuccuuuuggaugugcucuaauggaagccugcgcugcagaauuuguaucuga

SEQ ID NO: 188823 - RNA, 1701 nt, Artificial Sequence
  derived and/or modified sequence opt5 from hemagglutinin__InfluenzaA__ADM33280
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaaaugcaacauugccggguggauccugggaaauccugagugugaaucucugagcacaguguccucuuggagcuacauugucgagaccuccucuagcgacaacggcacgugcuauccgggggauuuuaucgacuacgaagaacuccgggagcagcuguccagcgugucuuccuucgaacgcuuugagaucuuccccaagaccagcucuuggccuaaucacgauuccaacaagggaguuacagccgccuguccccaugcuggcgccaagagcuuuuauaagaaucuuauuuggcuggugaaaaagggcaacucuuacccuaaacucuccaagagcuauaucaaugacaaggggaaagaaguccuggugcuuuggggcauucaccaccccuccaccucugcggaucaacagagccuguaccagaacgccgacgcuuacguguucgucggauccagcagauauucuaagaaauuuaagccugagaucgccauucggccgaaaguucgcgaucaggaggggagaaugaauuacuauuggacacucguggaacccggagacaagaucaccuucgaggcuacgggcaaccugguggucccucgguacgccuuugcgauggaacgcaacgccggguccggaauuaucaucagcgauacacccgugcaugacugcaauaccacaugucaaaccccuagaggcgcuauuaacaccucucugcccuuccagaauauccacccgauuacaaucggcaaaugcccuaaguauguuaagagcacgaaacuccggcuggccaccgggcuucgcaacgugcccuccauucagucuagaggacuguuuggcgcuaucgccggguucaucgagggaggcuggacagggauggucgacggaugguacggcuaucaucaccagaaugaacaaggcagcggguacgccgcugaucucaaguccacccagaacgcgauugacgagaucacaaauaaagugaacagcguuauugagaagaugaauacccaguuuacggccgugggaaaagaguucaaccaccuggagaagcggaucgaaaaucuuaacaagaaagucgaugacggcuuccuggauauuuggacauacaaugcugagcuccuggugcugcucgaaaacgagcgcacccuggacuaucaugauucuaaugucaagaaccuuuacgagaaagugagaucccagcugaagaacaaugccaaagaaaucgggaacggauguuuugaguucuaucacaagugcgacaauaccuguauggaaagcguuaagaacggcacauacgauuauccuaaauacucugaggaagccaagcucaaucgggaggagaucgacggggugaaacuggaauccacccgcauuuaucaaauccuugcuauuuacagcacagucgccuccucucuggugcucguugugagccugggcgcgaucuccuuuuggaugugcucuaacggaagccugcagugcagaauuuguaucuga

SEQ ID NO: 188824 - RNA, 1701 nt, Artificial Sequence; identical to SEQ ID NO: 186140
  derived and/or modified sequence opt5 from hemagglutinin__InfluenzaA__ADM33290

SEQ ID NO: 188825 - RNA, 1701 nt, Artificial Sequence; identical to SEQ ID NO: 185693
  derived and/or modified sequence opt5 from hemagglutinin__InfluenzaA__ADM33300

SEQ ID NO: 188826 - RNA, 1701 nt, Artificial Sequence; identical to SEQ ID NO: 185680
  derived and/or modified sequence opt5 from hemagglutinin__InfluenzaA__ADM33310

SEQ ID NO: 188827 - RNA, 1701 nt, Artificial Sequence
  derived and/or modified sequence opt5 from hemagglutinin__InfluenzaA__ADM33320
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaagugcaacaucgccggguggauucugggaaauccugagugugaaucucugagcacagccuccucuuggagcuacaucguggagaccuuuuccucugacaacggcacgugcuauccgggggauuucauugacuacgaagaacuccgggagcagcugagcuccgucagcucuuuugaacgcuucgagaucuuucccaagaccuccagcuggccuaaucacgauucuaacaagggagugacagccgcuuguccccaugccggcgcgaaauccuucuauaagaaucuuaucuggcugguuaaaaagggcaacagcuacccuaaacucucuaaguccuauauuaaugacaaggggaaagaagugcugguccuuuggggaauccaccaccccagcaccuccgccgaucaacagucucuguaccagaacgcugacgccuacguguuugugggcagcuccagauauagcaagaaauucaagccugagauugcuauccggccgaaaguccgcgaucaggaggggagaaugaauuacuauuggacacucguugaacccggagacaagauuaccuuugaggccacgggcaaccugguggugccucgguacgcguucgccauggaacgcaacgcugggucuggaaucauuaucuccgauacacccguccaugacugcaauaccacaugucaaaccccuaaaggcgccaucaacaccagccugcccuuucagaauauucacccgaucacaauuggcaagugcccuaaguaugugaaaucuacgaagcucagacuggcuaccgggcuucggaacguucccagcauccagucccgcggacuguucggcgccauugccggguuuaucgagggaggcuggacagggaugguggacggaugguacggcuaucaucaccagaaugaacaaggcucuggguacgcugcggaucucaaaagcacccagaacgccaucgacgagauuacaaauaaggucaacuccgugaucgagaaaaugaauacccaguucacggcuguuggaaaggaguucaaccaccuggagaagagaauugaaaaucuuaacaaaaagguggaugacggcuuucuggauaucuggacauacaaugccgagcuccugguccugcucgaaaacgagcggacccuggacuaucaugauagcaaugugaaaaaccuuuacgagaagguccgcucucagcugaaaaacaaugccaaggaaauugggaacggauguuucgaguuuuaucacaagugcgacaauaccuguauggaauccgugaaaaacggcacauacgauuauccuaaguacagcgaggaagcuaaacucaauagagaggagaucgacgggguuaagcuggaaucuacccggaucuaucaaauucuugccaucuacuccacaguggcgagcucccugguccucgugguuucucugggcgcuauuagcuucuggaugugcuccaacggaucucugcagugccgcaucuguauuuga

SEQ ID NO: 188828 - RNA, 1701 nt, Artificial Sequence; identical to SEQ ID NO: 185719
  derived and/or modified sequence opt5 from hemagglutinin__InfluenzaA__ADM33340

SEQ ID NO: 188829 - RNA, 1701 nt, Artificial Sequence
  derived and/or modified sequence opt5 from hemagglutinin__InfluenzaA__ADM33355
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaagugcaacaucgccggguggauucugggaaauccugagugugaaucucugagcacagccuccucuuggagcuacaucguggagaccuccucuagcgacaacggcacgugcuauccgggggauuuuauugacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuaucuggcugguuaaaaagggcaacagcuacccuaaacucuccaagagcuauauuaaugacaaggggaaagaagugcugguccuuuggggaauccaccaccccuccaccucugccgaucaacagagccuguaccagaacgcugacgccuacguguucgugggcuccagcagauauucuaagaaauuuaagccugagauugcuauccggccgaaaguccgcgaucaggaggggagaaugaauuacuauuggacacucguugaacccggagacaagauuaccuucgaggccacgggcaaccugguggugccucgguacgcguuugccauggaacgcaacgcuggguccggaaucauuaucagcgauacacccguccauaauugcaacaccacaugucaaaccccuaaaggcgccaucaauaccucucugcccuuccagaacauucacccgaucacaauuggcaagugcccuaaguaugugaaaagcacgaagcucagacuggcuaccgggcuucggaauguucccuccauccagucucgcggacuguuuggcgccauugccggguucaucgagggaggcuggacagggaugguggacggaugguacggcuaucaucaccagaacgaacaaggcagcggguacgcugcggaccucaaauccacccagaaugccaucgaugagauuacaaacaaggucaauagcgugaucgagaaaaugaacacccaguuuacggcuguuggaaaggaguucaaucaccuggagaagagaauugaaaaccuuaauaaaaagguggacgauggcuuccuggacaucuggacauacaacgccgagcuccugguccugcucgaaaaugagcggacccuggauuaucaugacucuaacgugaaaaaccuuuacgagaagguccgcucccagcugaaaaauaacgccaaggaaauugggaauggauguuuugaguucuaucacaagugcgauaacaccuguauggaaagcgugaaaaauggcacauacgacuauccuaaguacucugaggaagcuaaacucaacagagaggagaucgaugggguuaagcuggaauccacccggaucuaucaaauucuugccaucuacagcacaguggcguccucucugguccucgugguuagccugggcgcuauuuccuuuuggaugugcucuaauggaagccugcagugccgcaucuguauuuga

SEQ ID NO: 188830 - RNA, 1701 nt, Artificial Sequence; identical to SEQ ID NO: 188829
  derived and/or modified sequence opt5 from hemagglutinin__InfluenzaA__ADM33365

SEQ ID NO: 188831 - RNA, 1701 nt, Artificial Sequence; identical to SEQ ID NO: 185719
  derived and/or modified sequence opt5 from hemagglutinin__InfluenzaA__ADM33375

SEQ ID NO: 188832 - RNA, 1701 nt, Artificial Sequence
  derived and/or modified sequence opt5 from hemagglutinin__InfluenzaA__ADM33385
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaagugcaacaucgccggguggauucugggaaauccugagugugaaucucugagcacagccuccucuuggagcuacaucguggagaccuccucuagcgacaacggcacgugcuauccgggggauuuuauugacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuaucuggcugguuaaaaagggcaacagcuacccuaaacucuccaagagcuauauuaaugacaaggggaaagaagugcugguccuuuggggaauccaccaccccuccaccucugccgaucaacagagccuguaccagaacgcugacgccuacguguucgugggcuccagcagauauucuaagaaauuuaagccugagauugcuauccggccgaaaguccgcgaucaggaggggagaaugaauuacuauuggacacucguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccucuaaaggcgccaucaacaccagccugccuuuccagaauauucaccccaucacaauuggcaagugcccgaaguaugugaaauccacgaagcucagacuggcuaccgggcuucggaacguuccuucuauccagagccgcggacuguuuggcgccauugccggguucaucgagggaggcuggacagggaugguggacggaugguacggcuaucaucaccagaaugaacaaggcuccggguacgcugcggaucucaaaagcacccagaacgccaucgacgagauuacaaauaaggucaacucugugaucgagaaaaugaauacccaguuuacggcuguuggaaaggaguucaaccaccuggagaagagaauugaaaaucuuaacaaaaagguggaugacggcuuccuggauaucuggacauacaaugccgagcuccugguccugcucgaaaacgagcggacccuggacuaucaugauuccaaugugaaaaaccuuuacgagaagguccgcagccagcugaaaaacaaugccaaggaaauugggaacggauguuuugaguucuaucacaagugcgacaauaccuguauggaaucugugaaaaacggcacauacgauuaucccaaguacuccgaggaagcuaaacucaauagagaggagaucgacgggguuaagcuggaaagcacccggaucuaucaaauucuugccaucuacuccacaguggcgucuagccugguccucgugguuucccugggcgcuauuucuuuuuggaugugcagcaacggaucccugcagugccgcaucuguauuuga

SEQ ID NO: 188833 - RNA, 1701 nt, Artificial Sequence; identical to SEQ ID NO: 186140
  derived and/or modified sequence opt5 from hemagglutinin__InfluenzaA__ADM33395

SEQ ID NO: 188834 - RNA, 1701 nt, Artificial Sequence; identical to SEQ ID NO: 186140
  derived and/or modified sequence opt5 from hemagglutinin__InfluenzaA__ADM33405

SEQ ID NO: 188835 - RNA, 1701 nt, Artificial Sequence; identical to SEQ ID NO: 188829
  derived and/or modified sequence opt5 from hemagglutinin__InfluenzaA__ADM33415

SEQ ID NO: 188836 - RNA, 1701 nt, Artificial Sequence; identical to SEQ ID NO: 186536
  derived and/or modified sequence opt5 from hemagglutinin__InfluenzaA__ADM33425

SEQ ID NO: 188837 - RNA, 1701 nt, Artificial Sequence
  derived and/or modified sequence opt5 from hemagglutinin__InfluenzaA__ADM34007
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccuggaggagcccggagacaagauuacguucgaagccacaggcaaccugguugugccucgguacgcguuugccauggagcgcaacgcugggucuggaaucauuaucuccgauacccccgugcaugacugcaauacaaccugucaaaccccuaaaggcgccaucaacacaagccuccccuuccagaauauucacccgaucacgauuggcaagugcccuaaguaugucaaaucuaccaagcugagacuugcuacagggcugcggaacgugcccagcauccagucccgcggacucuuuggcgccauugccggguucaucgaaggaggcuggaccgggaugguugacggaugguacggcuaucaucaccagaaugagcaaggcucuggguacgcugcggaucugaaaagcacacagaacgccaucgacgagauuaccaauaaggugaacuccgucaucgaaaagaugaauacgcaguuuacagcugugggaaaggaguucaaccaccuugaaaagagaauugagaaucugaacaaaaagguugaugacggcuuccucgauaucuggaccuacaaugccgaacugcuggugcuccuggagaacgagcggacccuugacuaucaugauagcaaugucaaaaaccuguacgaaaaggugcgcucucagcucaaaaacaaugccaaggagauugggaacggauguuuugaguucuaucacaagugcgacaauacauguauggaauccgucaaaaacggcaccuacgauuauccuaaguacagcgaagaggcuaaacugaauagagaggaaaucgacggggugaaacuugagucuacacggaucuaucaaauucuggccaucuacuccacgguugcgagcucccucgugcuggucgugucucugggcgcuauuagcuuuuggaugugcuccaacggaucucuccagugccgcaucuguauuuga

SEQ ID NO: 188838 - RNA, 1701 nt, Artificial Sequence; identical to SEQ ID NO: 185693
  derived and/or modified sequence opt5 from hemagglutinin__InfluenzaA__ADM52443

SEQ ID NO: 188839 - RNA, 1701 nt, Artificial Sequence
  derived and/or modified sequence opt5 from hemagglutinin__InfluenzaA__ADM52453
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggauccagcagauauucuaagaaauuuaagccugagaucgcuauucggccgaaaguccgcgaucaggaggggagaaugaauuacuauuggacacucguugaacccggagacaagaucaccuucgaggccacgggcaaccugguggugccucgguacgcguuugccauggaacgcaacgcuggguccggaauuaucaucagcgauacacccauucaugacugcaauaccacaugucaaaccccuaaaggcgccaucaacaccucucugcccuuccagaauguccacccgauuacaaucggcaagugcccuaaguaugugaaaagcacgaagcucagacuggcuaccgggcuucggaacguucccuccauucagucucgcggacuguuuggcgccaucgccggguucaucgagggaggcuggacagggaugguggacggaugguacggcuaucaucaccagaaugaacaaggcagcggguacgcugcggaucucaaauccacccagaacgccauugacgagaucacaaauaaggucaacagcgugauugagaaaaugaauacccaguuuacggcuguuggaaaggaguucaaccaccuggagaagagaaucgaaaaucuuaacaaaaagguggaugacggcuuccuggauauuuggacauacaaugccgagcuccugguccugcucgaaaacgagcggacccuggacuaucaugauucuaaugugaaaaaccuuuacgagaagguccgcucccagcugaaaaacaaugccaaggaaaucgggaacggauguuuugaguucuaucacaagugcgacaauaccuguauggaaagcgugaaaaacggcacauacgauuauccuaaguacucugaggaagcuaaacucaauagagaggagaucgacgggguuaagcuggaauccacccggauuuaucaaauccuugccauuuacagcacaguggcguccucucugguccucgugguuagccugggcgcuaucuccuuuuggaugugcucuaacggaagccugcagugccgcauuuguaucuga

SEQ ID NO: 188840 - RNA, 1701 nt, Artificial Sequence
  derived and/or modified sequence opt5 from hemagglutinin__InfluenzaA__ADM52473
augaaggccauccuggcugugcuccuguacaccuucgccacagcgaacgcugacacgcuuugcauuggcuaucacgccaauaacagcaccgauacagucgacaccguucuggagaaaaaugugacagugacccauuccgucaaccuccuggaagauaagcacaaugggaaacuuuguaagcugagaggaguggcuccccuccaucugggcaaaugcaacaucgccggguggauucugggaaauccugagugugaaucucucagcacagccuccucuuggagcuacaucguugagaccuccucuagcggcaacgggacgugcuauccgggagacuuuauugauuacgaagaacugcgggagcagcuuuccagcgugucuuccuucgaacgcuuugagaucuuccccaagaccagcucuuggccuaaucacgacuccaacaagggcgucacagcugccuguccccaugcgggcgccaagagcuuuuauaagaaucugcucuggcuggugaaaaaggggaacucuuacccuaaacuuuccaagagcuauaucaaugauaagggaaaagaaguucuggugcucuggggcauucaccaccccuccaccucugcugaccaacagagccuguaccagaacgccgaugcuuacgucuucguggggacauccagauauagcaagaaauuuaagccugagaucgccauucggccgaaagugcgcgaccaggagggaagaaugaauuacuauuggacccuggucggccccggggauaagaucacguucgaagcgacaggaaaccucguugugccucgguacgccuuugcuauggagcgcaacgccggcucuggcauuaucauuuccgacacccccgugcaugauugcaauacaaccugucaaaccccuaaaggggcuaucaacacaagccugcccuuccagaauauccacccgauuacgaucggaaagugcccuaaguaugucaaaucuaccaaacuuagacuggccacaggccuccggaacgugcccagcauucagucccgcgggcuguuuggagccaucgcuggcuucauugaagggggauggaccggcaugguugacggcugguacggguaucaucaccagaaugagcaaggaucuggcuacgcggccgaccuuaaaagcacacagaacgcuaucgaugaaaucaccaauaaggugaacuccgucauugagaaaaugaauacgcaguuuacagccguggggaaggaguucaaccaccuggaaaagagaaucgagaaucucaacaaaaagguugacgauggauuccuggacauuuggaccuacaaugccgaacugcucgugcugcuugagaacgaacggacccuggauuaucaugacagcaaugucaaaaaccucuacgagaaggugcgcucucagcugaaaaacaaugcuaaggagaucggcaacggguguuuugaguucuaucacaagugcgauaauacauguauggaguccgucaaaaacggcaccuacgacuauccuaaguacagcgaagaggccaaacuuaauagagaagagauugauggagugaagcuggagucuacacggaucuaucaaauccucgcgauuuacuccacgguugcuagcucccuggugcuggucgugucucucggcgccaucagcuuuuggaugugcuccaacgggucucugcagugccgcauuuguaucuga

SEQ ID NO: 188841 - RNA, 1701 nt, Artificial Sequence; identical to SEQ ID NO: 186857
  derived and/or modified sequence opt5 from hemagglutinin__InfluenzaA__ADM52483

SEQ ID NO: 188842 - RNA, 1701 nt, Artificial Sequence; identical to SEQ ID NO: 185873
  derived and/or modified sequence opt5 from hemagglutinin__InfluenzaA__ADM52493

SEQ ID NO: 188843 - RNA, 1701 nt, Artificial Sequence; identical to SEQ ID NO: 185873
  derived and/or modified sequence opt5 from hemagglutinin__InfluenzaA__ADM52513

SEQ ID NO: 188844 - RNA, 1701 nt, Artificial Sequence; identical to SEQ ID NO: 185873
  derived and/or modified sequence opt5 from hemagglutinin__InfluenzaA__ADM52524

SEQ ID NO: 188845 - RNA, 1701 nt, Artificial Sequence; identical to SEQ ID NO: 185873
  derived and/or modified sequence opt5 from hemagglutinin__InfluenzaA__ADM52534

SEQ ID NO: 188846 - RNA, 1701 nt, Artificial Sequence; identical to SEQ ID NO: 185873
  derived and/or modified sequence opt5 from hemagglutinin__InfluenzaA__ADM52554

SEQ ID NO: 188847 - RNA, 1701 nt, Artificial Sequence; identical to SEQ ID NO: 185873
  derived and/or modified sequence opt5 from hemagglutinin__InfluenzaA__ADM52564

SEQ ID NO: 188848 - RNA, 1701 nt, Artificial Sequence; identical to SEQ ID NO: 185680
  derived and/or modified sequence opt5 from hemagglutinin__InfluenzaA__ADM52574

SEQ ID NO: 188849 - RNA, 1701 nt, Artificial Sequence; identical to SEQ ID NO: 185693
  derived and/or modified sequence opt5 from hemagglutinin__InfluenzaA__ADM52584

SEQ ID NO: 188850 - RNA, 1701 nt, Artificial Sequence
  derived and/or modified sequence opt5 from hemagglutinin__InfluenzaA__ADM52594
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccaaguauagcaaaaaguuuaaaccugagauugcuaucagaccgaagguccgggaucaggaggggcgcaugaauuacuauuggacccugguugaacccggagacaaaauuacguucgaggccacaggcaaccugguggugccuagauacgcguuugccauggaacggaacgcugggucuggaaucauuaucuccgauacccccguccaugacugcaauacaaccugucaaaccccuaagggcgccaucaacacaagccuccccuuccagaauauucacccgaucacgauuggcaagugcccuaaauaugugaagucuaccaaacugcgccuugcuacagggcugagaaacguucccagcauccagucccggggacucuuuggcgccauugccggguucaucgagggaggcuggaccgggaugguggacggaugguacggcuaucaucaccagaaugaacaaggcucuggguacgcugcggaucuuaagagcacacagaacgccaucgacaaaauuaccaauaaggucaacuccgugaucgagaagaugaauacgcaguuuacagcuguuggaaaagaguucaaccaccuugaaaagcgcauugagaaucugaacaaaaagguggaugacggcuuccucgauaucuggaccuacaaugccgaacugcugguccuccuggagaacgaaagaacccuugacuaucaugauagcaaugugaaaaaccuguacgagaagguccggucucagcucaagaacaaugccaaagagauugggaacggauguuuugaguucuaucacaagugcgacaauacauguauggaguccgugaaaaacggcaccuacgauuauccuaaguacagcgaagaggcuaaacugaaucgcgaagagaucgacgggguuaagcuggagucuacaagaaucuaucaaauucuggccaucuacuccacgguggcgagcucccucguccuggugguuucucugggcgcuauuagcuuuuggaugugcuccaacggaucucuccagugccggaucuguauuuga

SEQ ID NO: 188851 - RNA, 1701 nt, Artificial Sequence; identical to SEQ ID NO: 185873
  derived and/or modified sequence opt5 from hemagglutinin__InfluenzaA__ADM52604

SEQ ID NO: 188852 - RNA, 1701 nt, Artificial Sequence; identical to SEQ ID NO: 185873
  derived and/or modified sequence opt5 from hemagglutinin__InfluenzaA__ADM52614

SEQ ID NO: 188853 - RNA, 1701 nt, Artificial Sequence; identical to SEQ ID NO: 187465
  derived and/or modified sequence opt5 from hemagglutinin__InfluenzaA__ADM52624

SEQ ID NO: 188854 - RNA, 1701 nt, Artificial Sequence; identical to SEQ ID NO: 185873
  derived and/or modified sequence opt5 from hemagglutinin__InfluenzaA__ADM52634

SEQ ID NO: 188855 - RNA, 1701 nt, Artificial Sequence; identical to SEQ ID NO: 185873
  derived and/or modified sequence opt5 from hemagglutinin__InfluenzaA__ADM52644

SEQ ID NO: 188856 - RNA, 1701 nt, Artificial Sequence; identical to SEQ ID NO: 185873
  derived and/or modified sequence opt5 from hemagglutinin__InfluenzaA__ADM52654

SEQ ID NO: 188857 - RNA, 1701 nt, Artificial Sequence; identical to SEQ ID NO: 187281
  derived and/or modified sequence opt5 from hemagglutinin__InfluenzaA__ADM52664

SEQ ID NO: 188858 - RNA, 1701 nt, Artificial Sequence; identical to SEQ ID NO: 187465
  derived and/or modified sequence opt5 from hemagglutinin__InfluenzaA__ADM52674

SEQ ID NO: 188859 - RNA, 1701 nt, Artificial Sequence; identical to SEQ ID NO: 185873
  derived and/or modified sequence opt5 from hemagglutinin__InfluenzaA__ADM52684

SEQ ID NO: 188860 - RNA, 1701 nt, Artificial Sequence; identical to SEQ ID NO: 187465
  derived and/or modified sequence opt5 from hemagglutinin__InfluenzaA__ADM52704

SEQ ID NO: 188861 - RNA, 1701 nt, Artificial Sequence; identical to SEQ ID NO: 187281
  derived and/or modified sequence opt5 from hemagglutinin__InfluenzaA__ADM52714

SEQ ID NO: 188862 - RNA, 1701 nt, Artificial Sequence
  derived and/or modified sequence opt5 from hemagglutinin__InfluenzaA__ADM86399
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggauccagcagauauucuaagaaauuuaagccugagaucgcuauucggccgaaaguccgcgaucaggaggggagaaugaauuacuauuggacacucguugaacccggagacaagaucaccuucgaggccacgggcaaccugguggugccucgguacgcguuugccauggaacgcaacgcuggguccggaauuaucaucagcgauacacccguccaugacugcaauaccacaugucaaaccccuaaaggcgccgugaacaccucucugcccuuccagaauauucacccgaucacaauuggcaagugcccuaaguauguuaaaagcacgaagcucagacuggcuaccgggcuucggaacgugcccuccauccagucucgcggacuguuuggcgccauugccggguucaucgagggaggcuggacagggauggucgacggaugguacggcuaucaucaccagaaugaacaaggcagcggguacgcugcggaucucaaauccacccagaacgccaucgacgagauuacaaauaaggugaacagcguuaucgagaaaaugaauacccaguuuacggcugugggaaaggaguucaaccaccuggagaagagaauugaaaaucuuaacaaaaaggucgaugacggcuuccuggauaucuggacauacaaugccgagcuccuggugcugcucgaaaacgagcggacccuggacuaucaugauucuaaugucaaaaaccuuuacgagaaggugcgcucccagcugaaaaacaaugccaaggaaguugggaacggauguuuugaguucuaucacaagugcgacaauaccuguauggaaagcgugaaaaacggcacauacgauuauccuaaguacucugaggaagcuaaacucaauagagaggagauugacggggucaagcuggaauccacccggaucuaucaaauccuugccauuuacagcacagcggcuuccucucuggugcucguugugagccugggcgccaucuccuuuuggaugugcucuaacggaagccugcagugccgcauuuguaucuga

SEQ ID NO: 188863 - RNA, 1701 nt, Artificial Sequence; identical to SEQ ID NO: 185693
  derived and/or modified sequence opt5 from hemagglutinin__InfluenzaA__ADM86409

SEQ ID NO: 188864 - RNA, 1701 nt, Artificial Sequence; identical to SEQ ID NO: 185693
  derived and/or modified sequence opt5 from hemagglutinin__InfluenzaA__ADM86419

SEQ ID NO: 188865 - RNA, 1701 nt, Artificial Sequence; identical to SEQ ID NO: 187342
  derived and/or modified sequence opt5 from hemagglutinin__InfluenzaA__ADM86440

SEQ ID NO: 188866 - RNA, 1701 nt, Artificial Sequence; identical to SEQ ID NO: 185693
  derived and/or modified sequence opt5 from hemagglutinin__InfluenzaA__ADM86450

SEQ ID NO: 188867 - RNA, 1707 nt, Artificial Sequence
  derived and/or modified sequence opt5 from hemagglutinin__InfluenzaA__ADM95450
auggagaagaucgugcuucucuucgccauugucagccugguuaaauccgaccagaucugcauuggcuaccacgcuaacaauucuaccgaacaaguggauacaaucauggagaagaacgugacggucacccaugcccaggacauucuugaaaagacacacaaugggaagcugugugaucucgacggagugaaaccccugauccuuagagauugcagcguugcgggcuggcugcucgggaacccuaugugugacgaguuuaucaaugugccggaaugguccuauauugucgagaaggcuaaccccgugaaugaucugugcuacccuggagacuucaacgauuaugaggaacugaagcaucuccugucucggaucaaucacuuugagaaaauucagaucauucccaagagcuccuggccuucucaugaagccagccuuggcguuuccgccgcuugucccuaccaggggaaaagcucuuucuuucgcaacguggucuggcugaucaagaaaaauaacaccuauccuacaauuaagagauccuacaauaacaccaaucaagaggaccuccuggugauguggggaauccaccacccgaacgaugccgcugagcagacaaaccuuuaucagaaucccaccacguacaucagcgugggcaccucuacacugaaccagcggcucaccccucgcauugccacaagauccaaggucaauggccaaagcgggcggauggaguucuuuuggaccauccugaaacccaacgacgcgauuaauuucgaaucuaacggaaauuuuaucgccccugaauacgcuuauaagauuguuaaaaagggcgauuccacgaucaugaaaagcgagcuggaauacgggaacugcaauacaaagugucagacccccaugggagccaucaacuccucuaugccguuccauaauauucacccucucacaaucggcgagugccccaaauaugugaaaagcaaccgccuggugcuugcuaccgggcugagaaauuccccucagcgggagggacgcagaaagaaacggggccucuuuggcgccauugcgggguucaucgaaggaggcuggcaggggauggucgacggaugguacggcuaucaucacagcaacgagcaagggucuggauacgccgcugacaaggaauccacccagaaagccauugauggcgugacaaauaagguuaacagcaucaucgacaaaaugaacacgcaguuugaggcugugggccgcgaguucaauaaccuggaaagacggauugagaaucuuaacaagaagauggaagauggguuccuggacgucuggaccuauaaugccgagcuccuggugcugauggaaaacgagcgcacacucgauuuucacgacucuaauguuaaaaaccuguacgauaaggugagacuucaacugcgggacaaugccaaagaacucggaaacggcuguuucgaguuuuaccauaagugcgauaaugaguguauggaaagcgucagaaacgggaccuaugacuacccccaguauuccgaggaagcucgccugaaacgggaggagaucucuggagugaagcuggaaagcauuggcaucuaccagauucuguccaucuauagcacagucgcgucuucccucgcccuggcuauuaugguggccgggcugagccucuggaugugcucuaauggcucccugcagugcagaaucuguaucuga

SEQ ID NO: 188868 - RNA, 1701 nt, Artificial Sequence; identical to SEQ ID NO: 185693
  derived and/or modified sequence opt5 from hemagglutinin__InfluenzaA__ADM95745

SEQ ID NO: 188869 - RNA, 1701 nt, Artificial Sequence; identical to SEQ ID NO: 185693
  derived and/or modified sequence opt5 from hemagglutinin__InfluenzaA__ADM95746

SEQ ID NO: 188870 - RNA, 1701 nt, Artificial Sequence; identical to SEQ ID NO: 185693
  derived and/or modified sequence opt5 from hemagglutinin__InfluenzaA__ADM95747

SEQ ID NO: 188871 - RNA, 1701 nt, Artificial Sequence; identical to SEQ ID NO: 185693
  derived and/or modified sequence opt5 from hemagglutinin__InfluenzaA__ADM95749

SEQ ID NO: 188872 - RNA, 1701 nt, Artificial Sequence
  derived and/or modified sequence opt5 from hemagglutinin__InfluenzaA__ADM95750
augaaggccauccuggugguccuccuguacaccuucgcuacagccaacgcggacacgcuuugcauuggcuaucacgcuaauaacagcaccgauacaguugacaccgugcuggagaagaaugugacagucacccauuccuuuaaccuccuggaagauaagcacaaugggaaacuuuguaagcugagaggaguggcuccccuccaucugggcaaaugcaacaucgccggguggauucugggaaauccugagugugaaucucucagcacagccuccucuuggagcuacaucguugagaccuccucuagcgacaacggcacgugcuauccgggggauuucauugacuacgaagaacugcgggagcagcuuuccagcgugucuuccuuugaacgcuucgagaucuuucccaagaccagcucuuggccuaaucacgauuccaacaagggagucacagccgcuuguccccaugccggcgcgaaaucuuucuauaagaaucugaucuggcucgugaaaaaggggucuuccuacccuaaacugagcaaguccuauauuaacgacaagggcaaagaaguucuugugcuguggggaauccaccaccccucuaccagcgccgaucaacagucccucuaccagaaugcugacgccuacgucuuugugggcagcucuagauauuccaagaaauucaagccugagauugcuauccggccgaaagugcgcgaucaggaggggagaaugaacuacuauuggacacuggucgaacccggagacaagauuaccuuugaggccacgggcaaucugguugugccucgguacgcguucgccauggaacgcaacgcugggagcggaaucauuaucucugauacacccgugcaugacugcaacaccacaugucaaaccccuaaaggcgccaucaauaccagccuccccuuucagaacauucacccgaucacaauuggcaagugcccuaaguaugucaaauccacgaagcugagacuugcuaccgggcugcggaaugugcccucuauccagagccgcggacucuucggcgccauugccggguuuaucgagggaggcuggacagggaugguugacggaugguacggcuaucaucaccagaacgaacaaggcuccggguacgcugcggaucugaaaagcacccagaaugccaucgacgagauuacaaacaaggugaauagcgucaucgagaaaaugaacacccaguucacggcugugggaaaggaguucaaucaccuugagaagagaauugaaaaccugaauaaaaagguugaugacggcuuucucgauaucuggacauacaacgccgagcugcuggugcuccuggaaaaugagcggacccuugacuaucaugauuccaacgucaaaaaucuguacgagaaggugcgcagccagcucaaaaacaacgccaaggaaauugggaauggauguuucgaguuuuaucacaagugcgacaacaccuguauggaaucugucaaaaauggcacauacgauuauccuaaguacuccgaggaagcuaaacugaacagagaggagaucgacggggugaaacuugaaagcacccggaucuaucaaauucuggccaucuacuccacaguugcgucuagccucgugcuggucgugucccugggcgcuauuucuuucuggaugugcagcaauggaucccuccagugccgcaucuguauuuga

SEQ ID NO: 188873 - RNA, 1701 nt, Artificial Sequence; identical to SEQ ID NO: 185693
  derived and/or modified sequence opt5 from hemagglutinin__InfluenzaA__ADM95751

SEQ ID NO: 188874 - RNA, 1701 nt, Artificial Sequence; identical to SEQ ID NO: 185693
  derived and/or modified sequence opt5 from hemagglutinin__InfluenzaA__ADM95752

SEQ ID NO: 188875 - RNA, 1701 nt, Artificial Sequence; identical to SEQ ID NO: 185693
  derived and/or modified sequence opt5 from hemagglutinin__InfluenzaA__ADM95753

SEQ ID NO: 188876 - RNA, 1701 nt, Artificial Sequence; identical to SEQ ID NO: 185693
  derived and/or modified sequence opt5 from hemagglutinin__InfluenzaA__ADM95754

SEQ ID NO: 188877 - RNA, 1701 nt, Artificial Sequence; identical to SEQ ID NO: 185693
  derived and/or modified sequence opt5 from hemagglutinin__InfluenzaA__ADM95755

SEQ ID NO: 188878 - RNA, 1701 nt, Artificial Sequence; identical to SEQ ID NO: 185873
  derived and/or modified sequence opt5 from hemagglutinin__InfluenzaA__ADM95757

SEQ ID NO: 188879 - RNA, 1701 nt, Artificial Sequence; identical to SEQ ID NO: 185693
  derived and/or modified sequence opt5 from hemagglutinin__InfluenzaA__ADM95758

SEQ ID NO: 188880 - RNA, 1701 nt, Artificial Sequence
  derived and/or modified sequence opt5 from hemagglutinin__InfluenzaA__ADM95759
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacuauggcacgugcuacccgggggauuuuauugacuaugaagaacugcgggagcagcuuuccagcgucucuuccuucgaacgcuuugagaucuuccccaagaccagcucuuggccuaaccacgauuccaauaagggagugacagccgcuuguccccaugccggcgcgaaaucuuuuuacaagaaccugaucuggcucguuaaaaagggcaauagcuauccuaaacuguccaagagcuacauuaacgacaaggggaaagaagugcuuguccuguggggaauccaccaccccuccaccucugccgaucaacagagccucuaccagaaugcugacgccuauguguucgugggcacauccagauacagcaagaaauuuaagccugagauugcuauccggccgaaaguccgcgaucaggaggggagaaugaacuauuacuggacccugguugaacccggagacaagauuacguucgaggccacaggcaaucugguggugccucgguaugcguuugccauggaacgcaacgcugggucuggaaucauuaucuccgauacccccguccaugacugcaacacaaccugucaaaccccuaaaggcgccaucaauacaagccuccccuuccagaacauucacccgaucacgauuggcaagugcccuaaguacgugaaaucuaccaagcugagacuugcuacagggcugcggaauguucccagcauccagucccgcggacucuuuggcgccauugccggguucaucgagggaggcuggaccgggaugguggacggaugguauggcuaccaucaccagaacgaacaaggcucuggguacgcugcggaucugaaaagcacacagaaugccaucgacgagauuaccaacaaggucaauuccgugaucgagaaaaugaacacgcaguuuacagcuguuggaaaggaguucaaucaccuugagaagagaauugaaaaccugaauaaaaagguggaugacggcuuccucgauaucuggaccuauaacgccgagcugcugguccuccuggaaaaugagcggacccuugacuaccaugauagcaacgugaaaaaucuguaugagaagguccgcucucagcucaaaaacaacgccaaggaaauugggaauggauguuuugaguucuaccacaagugcgacaacacauguauggaauccgugaaaaauggcaccuaugauuacccuaaguauagcgaggaagcuaaacugaacagagaggagaucgacgggguuaaacuugaaucuacacggaucuaccaaauucuggccaucuacuccacgguggcgagcucccucguccuggugguuucucugggcgcuauuagcuuuuggaugugcuccaauggaucucuccagugccgcaucuguauuuga

SEQ ID NO: 188881 - RNA, 1701 nt, Artificial Sequence; identical to SEQ ID NO: 185680
  derived and/or modified sequence opt5 from hemagglutinin__InfluenzaA__ADM95760

SEQ ID NO: 188882 - RNA, 1701 nt, Artificial Sequence; identical to SEQ ID NO: 185693
  derived and/or modified sequence opt5 from hemagglutinin__InfluenzaA__ADM95761

SEQ ID NO: 188883 - RNA, 1701 nt, Artificial Sequence
  derived and/or modified sequence opt5 from hemagglutinin__InfluenzaA__ADM95763
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagaauaacgggaaacuuuguaagcugagaggaguugcuccccuccaccugggcaaaugcaauaucgccggguggauucugggaaacccugagugugaaucucucagcacagccuccucuuggagcuacaucguggagaccuccucuagcgacaauggcacgugcuauccgggggauuuuauugacuacgaagaacugcgggagcagcuuuccagcgucucuuccuucgaacgcuuugagaucuuccccaagaccagcucuuggccuaaccaugauuccaauaagggagugacagccgcuuguccccacgccggcgcgaaaucuuuuuauaagaaccugaucuggcucguuaaaaagggcaauagcuacccuaaacuguccaagagcuauauuaacgacaaggggaaagaagugcuuguccuguggggaauccaucaccccuccaccucugccgaucaacagagccucuaccagaaugcugacgccuacguguucgugggcuccagcagauauucuaagaaauuuaagccugagauugcuauccggccgaaaguccgcgaucaggaggggagaaugaacuacuauuggacacugguugaacccggagacaagauuaccuucgaggccacgggcaaccugguggugccucgguacgcguuugccauggaacgcaaugcuggguccggaaucauuaucagcgauacacccguccacgacugcaacaccacaugucaaaccccuaaaggcgccaucaauaccucucuccccuuccagaacauucauccgaucacaauuggcaagugcccuaaguaugugaaaagcacgaagcugagacuugcuaccgggcugcggaauguucccuccauccagucucgcggacucuuuggcgccauugccggguucaucgagggaggcuggacagggaugguggacggaugguacggcuaucaccaucagaacgaacaaggcagcggguacgcugcggaucugaaauccacccagaaugccaucgacgagauuacaaacaaggucaauagcgugaucgagaaaaugaacacccaguuuacggcuguuggaaaggaguucaaucaccuugagaagagaauugaaaaccugaauaaaaagguggaugacggcuuccucgauaucuggacauacaacgccgagcugcugguccuccuggaaaaugagcggacccuugacuaucacgauucuaacgugaaaaaccuguacgagaagguccgcucccagcucaaaaauaacgccaaggaaauugggaauggauguuuugaguucuaucauaagugcgacaacaccuguauggaaagcgugaaaaauggcacauacgauuauccuaaguacucugaggaagcuaaacugaacagagaggagaucgacgggguuaaacuugaauccacccggaucuaucaaauucuggccaucuacagcacaguggcguccucucucguccuggugguuagccugggcgcuauuuccuuuuggaugugcucuaauggaagccuccagugccgcaucuguauuuga

SEQ ID NO: 188884 - RNA, 1701 nt, Artificial Sequence; identical to SEQ ID NO: 185693
  derived and/or modified sequence opt5 from hemagglutinin__InfluenzaA__ADM95764

SEQ ID NO: 188885 - RNA, 1701 nt, Artificial Sequence; identical to SEQ ID NO: 185693
  derived and/or modified sequence opt5 from hemagglutinin__InfluenzaA__ADM95765

SEQ ID NO: 188886 - RNA, 1701 nt, Artificial Sequence; identical to SEQ ID NO: 185693
  derived and/or modified sequence opt5 from hemagglutinin__InfluenzaA__ADM95767

SEQ ID NO: 188887 - RNA, 1701 nt, Artificial Sequence; identical to SEQ ID NO: 186536
  derived and/or modified sequence opt5 from hemagglutinin__InfluenzaA__ADM95768

SEQ ID NO: 188888 - RNA, 1701 nt, Artificial Sequence; identical to SEQ ID NO: 186046
  derived and/or modified sequence opt5 from hemagglutinin__InfluenzaA__ADM95769

SEQ ID NO: 188889 - RNA, 1701 nt, Artificial Sequence; identical to SEQ ID NO: 187809
  derived and/or modified sequence opt5 from hemagglutinin__InfluenzaA__ADM95771

SEQ ID NO: 188890 - RNA, 1701 nt, Artificial Sequence; identical to SEQ ID NO: 185693
  derived and/or modified sequence opt5 from hemagglutinin__InfluenzaA__ADM95772

SEQ ID NO: 188891 - RNA, 1701 nt, Artificial Sequence; identical to SEQ ID NO: 185693
  derived and/or modified sequence opt5 from hemagglutinin__InfluenzaA__ADM95774

SEQ ID NO: 188892 - RNA, 1701 nt, Artificial Sequence; identical to SEQ ID NO: 185693
  derived and/or modified sequence opt5 from hemagglutinin__InfluenzaA__ADM95775

SEQ ID NO: 188893 - RNA, 1701 nt, Artificial Sequence; identical to SEQ ID NO: 186046
  derived and/or modified sequence opt5 from hemagglutinin__InfluenzaA__ADM95776

SEQ ID NO: 188894 - RNA, 1701 nt, Artificial Sequence; identical to SEQ ID NO: 186046
  derived and/or modified sequence opt5 from hemagglutinin__InfluenzaA__ADM95778

SEQ ID NO: 188895 - RNA, 1701 nt, Artificial Sequence
  derived and/or modified sequence opt5 from hemagglutinin__InfluenzaA__ADM95779
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacauccccagcauucagucccgcggacucuuuggcgccaucgccggguucaucgagggaggcuggaccgggaugguugacggaugguacggcuaucaucaccagaaugaacaaggcucuggguacgcugcggaucugaaaagcacacagaacgccauugacgagaucaccaauaaggugaacuccgucauugagaaaaugaauacgcaguuuacagcugugggaaaggaguucaaccaccuugagaagagaaucgaaaaucugaacaaaaagguugaugacggcuuccucgauauuuggaccuacaaugccgagcugcuggugcuccuggaaaacgagcggacccuugacuaucaugauagcaaugucaaaaaccuguacgagaaggugcgcucucagcucaaaaacaaugccaaggaaaucgggaacggauguuuugaguucuaucacaagugcgacaauacauguauggaauccgucaaaaacggcaccuacgauuauccuaaguacagcgaggaagcuaaacugaauagagaggagaucgacggggugaaacuugaacccacacggauuuaucaaauccuggccauuuacucuacgguugcguccagccucgugcuggucgugucccugggcgcuaucucuuuuuggaugugcagcaacggaucccuccagugccgcauuuguaucuga

SEQ ID NO: 188896 - RNA, 1701 nt, Artificial Sequence; identical to SEQ ID NO: 186046
  derived and/or modified sequence opt5 from hemagglutinin__InfluenzaA__ADM95780

SEQ ID NO: 188897 - RNA, 1701 nt, Artificial Sequence; identical to SEQ ID NO: 186536
  derived and/or modified sequence opt5 from hemagglutinin__InfluenzaA__ADM95783

SEQ ID NO: 188898 - RNA, 1701 nt, Artificial Sequence; identical to SEQ ID NO: 185693
  derived and/or modified sequence opt5 from hemagglutinin__InfluenzaA__ADM95784

SEQ ID NO: 188899 - RNA, 1701 nt, Artificial Sequence; identical to SEQ ID NO: 185693
  derived and/or modified sequence opt5 from hemagglutinin__InfluenzaA__ADM95785

SEQ ID NO: 188900 - RNA, 1701 nt, Artificial Sequence
  derived and/or modified sequence opt5 from hemagglutinin__InfluenzaA__ADM95786
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguagccaugccggcgcgaaaucuuuuuauaagaaucugaucuggcucguuaaaaagggcaacuccuaccccaaacugagcaaguccuauauuaaugacaaggggaaagaagugcuuguccuguggggaauccaccacccuucuaccagcgccgaucaacagucccucuaccagaacgcugacgccuacguguucgugggcacaagcagauauucuaagaaauuuaagcccgagauugcuauccggccuaaaguccgcgagcaggaagggagaaugaauuacuauuggacccugguugagccgggagauaagauuacguucgaagccacaggcaaccugguggugccccgguacgcguuugccauggagcgcaacgcuggguccggaaucauuaucagcgacaccccuguccaugauugcaauacaaccugucaaacccccaaaggcgccaucaacacaucucucccuuuccagaauauucaccccaucacgauuggcaagugcccgaaguaugugaaaagcaccaagcugagacuugcuacagggcugcggaacguuccuuccauccagucucgcggacucuuuggcgccauugccggguucaucgaaggaggcuggaccgggaugguggacggaugguacggcuaucaucaccagaaugagcaaggcagcggguacgcugcggaccugaaauccacacagaacgccaucgaugagauuaccaauaaggucaacagcgugaucgaaaagaugaauacgcaguuuacagcuguuggaaaggaguucaaccaccuugaaaagagaauugagaaucugaacaaaaagguggacgauggcuuccucgacaucuggaccuacaaugccgaacugcugguccuccuggagaacgagcggacccuugauuaucaugacucuaaugugaaaaaccuguacgaaaagguccgcucccagcucaaaaacaaugccaaggagauugggaacggauguuuugaguucuaucacaagugcgauaauacauguauggagagcgugaaaaacggcaccuacgacuaucccaaguacucugaagaggcuaaacugaauagagaggaaaucgaugggguuaaacuugaguccacacggaucuaucaaauucuggccaucuacagcacgguggcguccucucucguccuggugguuagccugggcgcuauuuccuuuuggaugugcucuaacggaagccuccagugccgcaucuguauuuga

SEQ ID NO: 188901 - RNA, 1701 nt, Artificial Sequence; identical to SEQ ID NO: 186046
  derived and/or modified sequence opt5 from hemagglutinin__InfluenzaA__ADM95788

SEQ ID NO: 188902 - RNA, 1701 nt, Artificial Sequence; identical to SEQ ID NO: 186046
  derived and/or modified sequence opt5 from hemagglutinin__InfluenzaA__ADM95789

SEQ ID NO: 188903 - RNA, 1701 nt, Artificial Sequence
  derived and/or modified sequence opt5 from hemagglutinin__InfluenzaA__ADM95790
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacugagaaaguccuauauuaaugacaaggggaaagaagugcuuguccuguggggaauccaccaccccagcaccuccgccgaucaacagucucucuaccagaacgcugacgccuacguguucgugggcacaagccgguauuccaagaaauuuaagccugagauugcuauccgcccgaaagucagagaucaggaggggcggaugaauuacuauuggacccugguugaacccggagacaagauuacguucgaggccacaggcaaccugguggugccucgcuacgcguuugccauggaaagaaacgcugggagcggaaucauuaucucugauacccccguccaugacugcaauacaaccugucaaaccccuaaaggcgccaucaacacaucccuccccuuccagaauauucacccgaucacgauuggcaagugcccuaaguaugugaaaagcaccaagcugcggcuugcuacagggcugcgcaacauccccucuauucagagcagaggacucuuuggcgccaucgccggguucaucgagggaggcuggaccgggaugguugacggaugguacggcuaucaucaccagaaugaacaaggcuccggguacgcugcggaucugaaaucuacacagaacgccauugacgagaucaccaauaaggugaacagcgucauugagaaaaugaauacgcaguuuacagcugugggaaaggaguucaaccaccuugagaagcggaucgaaaaucugaacaaaaagguugaugacggcuuccucgauauuuggaccuacaaugccgagcugcuggugcuccuggaaaacgagcgcacccuugacuaucaugauuccaaugucaaaaaccuguacgagaaggugagaagccagcucaaaaacaaugccaaggaaaucgggaacggauguuuugaguucuaucacaagugcgacaauacauguauggaaucugucaaaaacggcaccuacgauuauccuaaguacuccgaggaagcuaaacugaaucgggaggagaucgacggggugaaacuugaaagcacacgcauuuaucaaauccuggccauuuacucuacgguugcguccagccucgugcuggucgugucccugggcgcuaucucuuuuuggaugugcagcaacggaucccuccagugcagaauuuguaucuga

SEQ ID NO: 188904 - RNA, 1701 nt, Artificial Sequence; identical to SEQ ID NO: 188903
  derived and/or modified sequence opt5 from hemagglutinin__InfluenzaA__ADM95791

SEQ ID NO: 188905 - RNA, 1701 nt, Artificial Sequence; identical to SEQ ID NO: 188903
  derived and/or modified sequence opt5 from hemagglutinin__InfluenzaA__ADM95792

SEQ ID NO: 188906 - RNA, 1701 nt, Artificial Sequence; identical to SEQ ID NO: 188290
  derived and/or modified sequence opt5 from hemagglutinin__InfluenzaA__ADM95793

SEQ ID NO: 188907 - RNA, 1701 nt, Artificial Sequence; identical to SEQ ID NO: 186046
  derived and/or modified sequence opt5 from hemagglutinin__InfluenzaA__ADM95794

SEQ ID NO: 188908 - RNA, 1701 nt, Artificial Sequence; identical to SEQ ID NO: 185693
  derived and/or modified sequence opt5 from hemagglutinin__InfluenzaA__ADM95795

SEQ ID NO: 188909 - RNA, 1701 nt, Artificial Sequence; identical to SEQ ID NO: 186795
  derived and/or modified sequence opt5 from hemagglutinin__InfluenzaA__ADM95798

SEQ ID NO: 188910 - RNA, 1701 nt, Artificial Sequence
  derived and/or modified sequence opt5 from hemagglutinin__InfluenzaA__ADM95799
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugagaacggguguuuugaguucuaucacaagugcgacaauacauguauggaauccgugaaaaacggaaccuacgauuauccuaaguacagcgaagaggcuaaacugaauagagaggaaaucgacggcguuaaacuugagucuacacggaucuaucaaauucuggccaucuacuccacgguggcgagcucccucguccuggugguuucucugggggcuauuagcuuuuggaugugcuccaacggcucucuccagugccgcaucuguauuuga

SEQ ID NO: 188911 - RNA, 1701 nt, Artificial Sequence
  derived and/or modified sequence opt5 from hemagglutinin__InfluenzaA__ADM95800
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugcccccggagacaagauuacguucgaagcgacaggcaaccugguggugccucgguacgccuuugcuauggagcgcaacgccgggucuggaaucauuaucuccgauacccccguccaugacugcaauacaaccugucaaaccccuaaaggcgcuaucaacacaagccuccccuuccagaauauucacccgaucacgauuggcaagugcccuaaguaugugaaaucuaccaagcugagacuugccacagggcugcggaacguucccagcauccagucccgcggacucuuuggcgccauugcuggguucaucgaaggaggcuggaccgggaugguggacggaugguacggcuaucaucaccagaaugagcaaggcucuggguacgcggccgaucugaaaagcacacagaacgcuaucgacgaaauuaccaauaaggucaacuccgugaucgagaaaaugaauacgcaguuuacagccguuggaaaggaguucaaccaccuugaaaagagaauugagaaucugaacaaaaagguggaugacggcuuccucgauaucuggaccuacaaugccgaacugcugguccuccuggagaacgaacggacccuugacuaucaugauagcaaugugaaaaaccuguacgagaagguccgcucucagcucaaaaacaaugcuaaggagauugggaacggauguuuugaguucuaucacaagugcgacaauacauguauggaguccgugaaaaacggcaccuacgauuauccuaaguacagcgaagaggccaaacugaauagagaagagaucgacgggguuaaacuugagucuacacggaucuaucaaauucuggcgaucuacuccacgguggcuagcucccucguccuggugguuucucugggcgccauuagcuuuuggaugugcuccaacggaucucuccagugccgcaucuguauuuga

SEQ ID NO: 188912 - RNA, 1701 nt, Artificial Sequence; identical to SEQ ID NO: 186046
  derived and/or modified sequence opt5 from hemagglutinin__InfluenzaA__ADM95801

SEQ ID NO: 188913 - RNA, 1701 nt, Artificial Sequence; identical to SEQ ID NO: 186046
  derived and/or modified sequence opt5 from hemagglutinin__InfluenzaA__ADM95802

SEQ ID NO: 188914 - RNA, 1701 nt, Artificial Sequence; identical to SEQ ID NO: 188900
  derived and/or modified sequence opt5 from hemagglutinin__InfluenzaA__ADM95803

SEQ ID NO: 188915 - RNA, 1701 nt, Artificial Sequence
  derived and/or modified sequence opt5 from hemagglutinin__InfluenzaA__ADM95804
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaaauuuuuauaagaaccugaucuggcucguuaaaaagggcaauagcuacccuaaacugucuaaguccuauauuaacgacaaggggaaagaagugcuuguccuguggggaauccaccaccccagcaccuccgccgaucaacagucucucuaccagaaugcugacgccuacguguucgugggcacaagcagauauuccaagaaauuuaagccugagauugcuauccggccgaaaguccgcgaucaggaggggagaaugaacuacuauuggacccugguugaacccggagacaagauuacguucgaggccacaggcaaccugguggugccucgguacgcguuugccauggaacgcaaugcugggagcggaaucauuaucucugauacccccguccaugacugcaacacaaccugucaaaccccuaaaggcgccaucaauacaucccuccccuuccagaacauucacccgaucacgauuggcaagugcccuaaguaugugaaaagcaccaagcugagacuugcuacagggcugcggaauguucccucuauccagagccgcggacucuuuggcgccauugccggguucaucgagggaggcuggaccgggaugguggacggaugguacggcuaucaucaccagaacgaacaaggcuccggguacgcugcggaucugaaaucuacacagaaugccaucgacgagauuaccaacaaggucaauagcgugaucgagaaaaugaacacgcaguuuacagcuguuggaaaggaguucaaucaccuugagaagagaauugaaaaccugaauaaaaagguggaugacggcuuccucgauaucuggaccuacaacgccgagcugcugguccuccuggaaaaugagcggacccuugacuaucaugauuccaacgugaaaaagcuguacgagaaaguccgcagccagcucaagaacaaugccaaggaaauugggaacggauguuuugaguucuaucacaaaugcgacaauacauguauggaaucugugaagaacggcaccuacgauuauccuaaauacuccgaggaagcuaagcugaauagagaggagaucgacgggguuaaacuugaaagcacacggaucuaucaaauucuggccaucuacucuacgguggcguccagccucguccuggugguuucccugggcgcuauuucuuuuuggaugugcagcaacggaucccuccagugccgcaucuguauuuga

SEQ ID NO: 188916 - RNA, 1701 nt, Artificial Sequence; identical to SEQ ID NO: 187375
  derived and/or modified sequence opt5 from hemagglutinin__InfluenzaA__ADM95805

SEQ ID NO: 188917 - RNA, 1701 nt, Artificial Sequence; identical to SEQ ID NO: 186794
  derived and/or modified sequence opt5 from hemagglutinin__InfluenzaA__ADM95808

SEQ ID NO: 188918 - RNA, 1701 nt, Artificial Sequence; identical to SEQ ID NO: 186794
  derived and/or modified sequence opt5 from hemagglutinin__InfluenzaA__ADM95809

SEQ ID NO: 188919 - RNA, 1701 nt, Artificial Sequence; identical to SEQ ID NO: 186794
  derived and/or modified sequence opt5 from hemagglutinin__InfluenzaA__ADM95810

SEQ ID NO: 188920 - RNA, 1701 nt, Artificial Sequence
  derived and/or modified sequence opt5 from hemagglutinin__InfluenzaA__ADM95812
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaacuccugucuacagccagcuccuggucuuacaucguggagaccagcuccucugacaacggcacgugcuauccgggggauuuuauugacuacgaagaacuucgggagcagcugagcuccgucagcucuuucgaacgcuuugagaucuuccccaagaccuccagcuggccuaaucacgauucuaacaagggagugacagccgcuuguccccaugccggcgcgaaauccuuuuauaagaaucucaucuggcugguuaaaaagggcaacagcuacccuaaacuuucuaaguccuauauuaaugacaaggggaaagaagugcugguccucuggggaauccaccaccccagcaccuccgccgaucaacagucucuguaccagaacgcugacgccuacguguucgugggcacaagcagauauuccaagaaauuuaagccugagauugcuauccggccgaaaguccgcgaucaggaggggagaaugaauuacuauuggacccugguugaacccggagacaagauuacguucgaggccacaggcaaccucguggugccucgguacgcguuugccauggaacgcaacgcugggagcggaaucauuaucucugauacccccguccaugacugcaauacaaccugucaaaccccuaaaggcgccaucaacacaucccugcccuuccagaauauucacccgaucacgauuggcaagugcccuaaguaugugaaaagcaccaaacuuagacuggcuacagggcuccggaacguucccucuauccagagccgcggacuguuuggcgccauugccggguucaucgagggaggcuggaccgggaugguggacggaugguacggcuaucaucaccagaaugaacaaggcuccggguacgcugcggaucuuaagucuacacagaacgccaucgacgagauuaccaauaaggucaacagcgugaucgagaaaaugaauacgcaguuuacagcuguuggaaaggaguucaaccaccuggagaagagaauugaaaaucucaacaaaaagguggaugacggcuuccuggauaucuggaccuacaaugccgagcugcucguccugcuugaaaacgagcggacccuggacuaucaugauuccaaugugaaaaaccucuacgagaagguccgcagccagcugaaaaacaaugccaaggaaauugggaacggauguuuugaguucuaucacaagugcgacaauacauguauggaaucugugaaaaacggcaccuacgauuauccuaaguacuccgaggaagcuaaacuuaauagagaggagaucgacgggguuaagcuggaaagcacacggaucuaucaaauucucgccaucuacucuacgguggcguccagccugguccuggugguuucccucggcgcuauuucuuuuuggaugugcagcaacggaucccugcagugccgcaucuguauuuga

SEQ ID NO: 188921 - RNA, 1701 nt, Artificial Sequence; identical to SEQ ID NO: 188290
  derived and/or modified sequence opt5 from hemagglutinin__InfluenzaA__ADM95816

SEQ ID NO: 188922 - RNA, 1701 nt, Artificial Sequence; identical to SEQ ID NO: 188290
  derived and/or modified sequence opt5 from hemagglutinin__InfluenzaA__ADM95819

SEQ ID NO: 188923 - RNA, 1701 nt, Artificial Sequence; identical to SEQ ID NO: 187375
  derived and/or modified sequence opt5 from hemagglutinin__InfluenzaA__ADM95820

SEQ ID NO: 188924 - RNA, 1701 nt, Artificial Sequence; identical to SEQ ID NO: 188290
  derived and/or modified sequence opt5 from hemagglutinin__InfluenzaA__ADM95821

SEQ ID NO: 188925 - RNA, 1701 nt, Artificial Sequence; identical to SEQ ID NO: 186794
  derived and/or modified sequence opt5 from hemagglutinin__InfluenzaA__ADM95822

SEQ ID NO: 188926 - RNA, 1701 nt, Artificial Sequence; identical to SEQ ID NO: 186794
  derived and/or modified sequence opt5 from hemagglutinin__InfluenzaA__ADM95823

SEQ ID NO: 188927 - RNA, 1701 nt, Artificial Sequence
  derived and/or modified sequence opt5 from hemagglutinin__InfluenzaA__ADM95824
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuaccauuggacccugguugaacccggagacaagauuacguucgaggccacaggcaaccugguggugccucgguaugcguuugccauggaacgcaacgcugggucuggaaucauuaucuccgauacccccguccacgacugcaauacaaccugucaaaccccuaaaggcgccaucaacacaagccuccccuuccagaauauucauccgaucacgauuggcaagugcccuaaguacgugaaaucuaccaagcugagaauggcuacagggcuucggaacguucccagcauccagucccgcggacuguuuggcgccauugccggguucaucgagggaggcuggaccgggaugguggacggaugguauggcuaccaccaccagaaugaacaaggcucuggguaugcugcggaucucaaaagcacacagaacgccaucgacgagauuaccaauaaggucaacuccgugaucgagaaaaugaauacgcaguuuacagcuguuggaaaggaguucaaccaucuggagaagagaauugaaaaucuuaacaaaaagguggaugacggcuuccuggauaucuggaccuacaaugccgagcuccugguccugcucgaaaacgagcggacccuggacuaccacgauagcaaugugaaaaaccuuuaugagaagguccgcucucagcugaaaaacaaugccaaggaaauugggaacggauguuuugaguucuaccauaagugcgacaauacauguauggaauccgugaaaaacggcaccuaugauuacccuaaguauagcgaggaagcuaaacucaauagagaggagaucgacgggguuaagcuggaaucuacacggaucuaccaaauucuugccaucuauuccacgguggcgagcucccugguccucgugguuucucugggcgcuauuagcuuuuggaugugcuccaacggaucucugcagugccgcaucuguauuuga

SEQ ID NO: 188928 - RNA, 1701 nt, Artificial Sequence; identical to SEQ ID NO: 188290
  derived and/or modified sequence opt5 from hemagglutinin__InfluenzaA__ADM95825

SEQ ID NO: 188929 - RNA, 1701 nt, Artificial Sequence; identical to SEQ ID NO: 188290
  derived and/or modified sequence opt5 from hemagglutinin__InfluenzaA__ADM95826

SEQ ID NO: 188930 - RNA, 1701 nt, Artificial Sequence
  derived and/or modified sequence opt5 from hemagglutinin__InfluenzaA__ADM95827
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugaaaggaguugcgccccuccaucugggcaagugcaacaucgccggguggauucugggaaauccugagugugaaucucucagcacagcuuccucuuggagcuacaucguggagaccuccucuagcgacaacggcacgugcuauccgggggauuuuauugacuacgaagaacugagagagcagcuuuccagcgucucuuccuucgaacgguuugagaucuuccccaagaccagcucuuggccuaaucacgauuccaacaaaggagugacagccgcuuguccccaugccggcgccaagagcuuuuauaaaaaucugaucuggcucguuaagaaaggcaacucuuacccuaagcuguccaagagcuauauuaaugacaaagggaaggaagugcuuguccuguggggaauccaccaccccuccaccucugccgaucaacagagccucuaccagaacgcugacgccuacguguucgugggcacaucccgcuauagcaaaaaguuuaaaccugagauugcuaucagaccgaagguccgggaucaggaggggcgcaugaauuacuauuggacccugguugaacccggagacaaaauuacguucgaggccacaggcaaccugguggugccuagauacgcguuugccauggaacggaacgcugggucuggaaucauuaucuccgauacccccguccaugacugcaauacaaccugucaaaccccuaagggcgccaucaacacaagccuccccuuccagaauauucacccgaucacgauuggcaagugcccuaaauaugugaagucuaccaaacugcgccuugcuacagggcugagaaacguucccagcauccagucccggggacucuuuggcgccauugccggguucaucgagggaggcuggaccgggaugguggacggaugguacggcuaucaucaccagaaugaacaaggcucuggguacgcugcggaucuuaagagcacacagcacgccaucgacgagauuaccaacaaagucaauuccgugaucgagaagaugaacacgcaguuuacagcuguuggaaaggaguucaaucaucuggagaaacgcauugaaaaccugaauaagaaaguggaugacggcuuccucgauaucuggaccuacaacgccgagcugcugguccuccuggaaaaugagagaacccuugacuaucacgauagcaacgugaagaaucuguacgagaaaguccggucucagcucaagaacaacgccaaggaaauugggaauggauguuuugaguucuaucauaaaugcgacaacacauguauggaauccgugaagaauggcaccuacgauuauccuaaauacagcgaggaagcuaagcugaaccgcgaggagaucgacgggguuaaacuugaaucuacaagaaucuaucaaauucuggccaucuacuccacgguggcgagcucccucguccuggugguuucucugggcgcuauuagcuuuuggaugugcuccaauggaucucuccagugccggaucuguauuuga

SEQ ID NO: 188931 - RNA, 1701 nt, Artificial Sequence
  derived and/or modified sequence opt5 from hemagglutinin__InfluenzaA__ADM95828
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccgcccaugacugcaauacaaccugucaaaccccuaaaggcgcuaucaacacaagccuccccuuccagaauauucacccgaucacgauuggcaagugcccuaaguaugucaaaucuaccaagcugagaauggccacagggcuucggaacgugcccagcauccagucccgcggacuguuuggcgccauugcuggguucaucgagggaggcuggaccgggaugguugacggaugguacggcuaucaucaccagaaugaacaaggcucuggguacgcggccgaucucaaaagcacacagaacgcuaucgacgagauuaccaauaaggugaacuccgucaucgagaaaaugaauacgcaguuuacagccgugggaaaggaguucaaccaccuggagaagagaauugaaaaucuuaacaaaaagguugaugacggcuuccuggauaucuggaccuacaaugccgagcuccuggugcugcucgaaaacgagcggacccuggacuaucaugauagcaaugucaaaaaccuuuacgagaaggugcgcucucagcugaaaaacaaugcuaaggaaauugggaacggauguuuugaguucuaucacaagugcgacaauacauguauggaauccgucaaaaacggcaccuacgauuauccuaaguacagcgaggaagccaaacucaauagagaggagaucgacggggugaagcuggaaucuacacggaucuaucaaauucuugcgaucuacuccacgguugcuagcucccuggugcucgucgugucucugggcgccauuagcuuuuggaugugcuccaacggaucucugcagugccgcaucuguauuuga

SEQ ID NO: 188932 - RNA, 1701 nt, Artificial Sequence
  derived and/or modified sequence opt5 from hemagglutinin__InfluenzaA__ADM95829
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaagcuguacgagaaaguccgcucucagcucaagaacaacgccaaggaaauugggaauggauguuuugaguucuaucacaaaugcgacaacauguguauggaauccgugaagaauggcacauacgauuauccuaaauacagcgaggaagcuaagcugaacagagaggagaucgacgggguuaaacuugaaucuacccggaucuaucaaauucuggccaucuacuccacaguggcgagcucccucguccuggugguuucucugggcgcuauuagcuuuuggaugugcuccaauggaucucuccagugccgcaucuguauuuga

SEQ ID NO: 188933 - RNA, 1701 nt, Artificial Sequence
  derived and/or modified sequence opt5 from hemagglutinin__InfluenzaA__ADM95831
augaaggccauccuggugguccuccuguacaccuucguuacagcuaacgccgacacgcuuugcauuggcuaucacgcgaauaacagcaccgauacaguggacaccgugcuggagaaaaaugucacagugacccauuccguuaaccuccuggaagauaagcacaaugggaaacuuuguaagcugagaggaguggcuccccuccaucugggcaaaugcaacaucgccggguggauucugggaaauccugagugugaaucucucagcacagccuccucuuggagcuacaucgucgagaccuccucuagcgacaacggcacgugcuauccgggggauuuuauugacuacgaagaacugcgggagcagcuuuccagcgugucuuccuucgaacgcuuugagaucuuccccaagaccagcucuuggccuaaucacgauuccaacaagggaguuacagcugccuguccccaugcuggcgccaaauccuuuuauaagaaucugaucuggcucgugaaaaagggcaacucuuacccuaaacuguccaagagcuauauuaaugacaaggggaaagaaguccuugugcuguggggaauccaccaccccuccaccucugcggaucaacagagccucuaccagaacgccgacgcuuacguguucgucggcacauccagauauagcaagaaauuuaagccugagauugccauccggccgaaaguucgcgaucaggaggggagaaugaauuacuauuggacccugguggaacccggagacaagauuacguucgaggcuacaggcaaccugguggucccucgguacgccuuugcgauggagaaaaacgccgggucuggaaucauuaucuccgauacccccgugcaugacugcaauacaaccugucaaaccccuaagggcgcuaucaacacaagccuccccuuccagaauauucacccgaucacgauuggcaagugcccuaaauauguuaagucuaccaaacugcgccuugccacagggcugagaaacgugcccagcauccagucccggggacucuuuggcgcuauugccggguucaucgagggaggcuggaccgggauggucgacggaugguacggcuaucaucaccagaaugaacaaggcucuggguacgccgcugaucuuaagagcacacagcacgcgaucgacgagauuaccaacaaagugaauagcguuaucgagaagaugaacacgcaguuuacagccgugggaaaggaguucaaucaucuggaaaaacgcauugaaaaccugaauaagaaagucgaugacggcuuccucgauaucuggaccuacaacgcugagcugcuggugcuccuggaaaaugagagaacccuugacuaucacgauagcaacgucaagaaucuguacgagaaagugcggucucagcucaagaacaacgccaaggaaauugggaauggauguuuugaguucuaucauaaaugcgacaacacauguauggaauccguuaagaauggcaccuacgauuauccuaaauacagcgaggaagccaagcugaaccgcgaggagaucgacggggugaaacuugaaucuacaagaaucuaucaaauucuggcuaucuacuccacggucgccagcucccucgugcugguugugucucugggcgcgauuagcuuuuggaugugcuccaauggaucucuccagugccggaucuguauuuga

SEQ ID NO: 188934 - RNA, 1701 nt, Artificial Sequence; identical to SEQ ID NO: 186794
  derived and/or modified sequence opt5 from hemagglutinin__InfluenzaA__ADM95832

SEQ ID NO: 188935 - RNA, 1701 nt, Artificial Sequence; identical to SEQ ID NO: 187375
  derived and/or modified sequence opt5 from hemagglutinin__InfluenzaA__ADM95833

SEQ ID NO: 188936 - RNA, 1701 nt, Artificial Sequence; identical to SEQ ID NO: 188920
  derived and/or modified sequence opt5 from hemagglutinin__InfluenzaA__ADM95834

SEQ ID NO: 188937 - RNA, 1701 nt, Artificial Sequence; identical to SEQ ID NO: 187375
  derived and/or modified sequence opt5 from hemagglutinin__InfluenzaA__ADM95836

SEQ ID NO: 188938 - RNA, 1701 nt, Artificial Sequence; identical to SEQ ID NO: 188290
  derived and/or modified sequence opt5 from hemagglutinin__InfluenzaA__ADM95837

SEQ ID NO: 188939 - RNA, 1701 nt, Artificial Sequence
  derived and/or modified sequence opt5 from hemagglutinin__InfluenzaA__ADM95838
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuugucugcaugccggcgcgaaaucuuuuuauaagaaucucaucuggcugguuaaaaagggcaacagcuaccccaaacuuuccaagagcuauauuaaugacaaggggaaagaagugcugguccucuggggaauccaccacccuuccaccucugccgaucaacagagccuguaccagaacgcugacgccuacguguucgugggcacauccagauauagcaagaaauuuaagcccgagauugcuauccggccuaaaguccgcgaucaggaggggagaaugaauuacuauuggacccugguugaaccgggagacaagauuacguucgaggccacaggcaaccucguggugccccgguacgcguuugccauggaacgcaacgcugggucuggaaucauuaucuccgauaccccuguccaugacugcaauacaaccugucaaacccccaaaggcgccaucaacacaagccugccuuuccagaauauucaccccaucacgauuggcaagugcccgaaguaugugaaaucuaccaaacuuagacuggcuacagggcuccggaacguuccuagcauccagucccgcggacuguuuggcgccauugccggguucaucgagggaggcuggaccgggaugguggacggaugguacggcuaucaucaccagaaugaacaaggcucuggguacgcugcggaucuuaaaagcacacagaacgccaucgacaagauuaccaauaaagucaacuccgugaucgagaagaugaauacgcaguuuacagcuguuggaaaggaguucaaccaccuggaaaagagaauugagaaucucaacaagaaaguggaugacggcuuccuggauaucuggaccuacaaugccgaacugcucguccugcuugagaacgaacggacccuggacuaucaugauagcaaugugaagaaccucuacgagaaaguccgcucucagcugaagaacaaugccaaggagauugggaacggauguuuugaguucuaucacaaaugcgacaauacauguauggaguccgugaagaacggcaccuacgauuaucccaaauacagcgaagaggcuaaacuuaauagagaagagaucgacgggguuaagcuggagucuacacggaucuaucaaauucucgccaucuacuccacgguggcgagcucccugguccuggugguuucucucggcgcuauuagcuuuuggaugugcuccaacggaucucugcagugccgcaucuguauuuga

SEQ ID NO: 188940 - RNA, 1701 nt, Artificial Sequence; identical to SEQ ID NO: 187375
  derived and/or modified sequence opt5 from hemagglutinin__InfluenzaA__ADM95839

SEQ ID NO: 188941 - RNA, 1701 nt, Artificial Sequence; identical to SEQ ID NO: 188900
  derived and/or modified sequence opt5 from hemagglutinin__InfluenzaA__ADM95840

SEQ ID NO: 188942 - RNA, 1701 nt, Artificial Sequence; identical to SEQ ID NO: 188900
  derived and/or modified sequence opt5 from hemagglutinin__InfluenzaA__ADM95842

SEQ ID NO: 188943 - RNA, 1701 nt, Artificial Sequence; identical to SEQ ID NO: 188290
  derived and/or modified sequence opt5 from hemagglutinin__InfluenzaA__ADM95843

SEQ ID NO: 188944 - RNA, 1701 nt, Artificial Sequence; identical to SEQ ID NO: 188290
  derived and/or modified sequence opt5 from hemagglutinin__InfluenzaA__ADM95844

SEQ ID NO: 188945 - RNA, 1701 nt, Artificial Sequence
  derived and/or modified sequence opt5 from hemagglutinin__InfluenzaA__ADM95845
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagaauggcuacagggcuucggaacguucccagcauccagucccgcggacuguuuggcgccauugccggguucaucgagggaggcuggaccgggaugguggacggaugguacggcuaucaucaccagaaugaacaaggcucuggguacgcugcggaucucaaaagcacacagaacgccaucgacgagauuaccaauaaggucaacuccgugaucgagaaaaugaauacgcaguuuacagcuguuggaaaggaguucaaccaccuggagaagagaauugaaaaucuuaacaaaaagguggaugacggcuuccuggauaucuggaccuacaaugccgagcuccugguccugcucgaaaacgagcggacccuggacuaucaugauagcaaugugaaaaaccuuuacgagaagguccgcucucagcugaaaaacaaugccaaggaaauugggaacggauguuuugaguucuaucacaagugcgacaauacauguauggaauccgugaaaaacggcaccuacgauuauccuaaguacagcgaggaaacaaaacucaauagagaggagaucgacgggguuaagcuggaaucuacgcggaucuaucaaauucuugcuaucuacuccaccguggccagcucccugguccucgugguuucucugggcgcgauuagcuuuuggaugugcuccaacggaucucugcagugccgcaucuguauuuga

SEQ ID NO: 188946 - RNA, 1701 nt, Artificial Sequence
  derived and/or modified sequence opt5 from hemagglutinin__InfluenzaA__ADM95846
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggaggccuccucuagcgacaacgggaccugcuauccgggcgauuuuauugacuacgaagaacugcgggagcagcuuuccagcgucucuuccuucgaacgcuuugagaucuuccccaagacgagcucuuggccuaaucacgauuccaacaagggagugaccgcugccuguccccaugcgggcgccaagagcuuuuauaagaaucugaucuggcucguuaaaaagggcaacucuuacccuaaacuguccaagagcuauauuaaugacaaggggaaagaagugcuuguccuguggggaauccaccaccccuccacaucugcugaucaacagagccucuaccagaacgccgacgcuuacguguucgugggcaccuccagauauagcaagaaauuuaagccugagauugccauccggccgaaaguccgcgaucaggaggggagaaugaauuacuauuggacacugguugaacccggagacaagauuaccuucgaggcgacgggcaaccugguggugccucgguacgccuuugcuauggaacgcaacgccgggucuggaaucauuaucuccgauacacccguccaugacugcaauaccacaugucaaaccccuaaaggcgcuaucaacaccagccuccccuuccagaauauucacccgaucacaauuggcaagugcccuaaguaugugaaaucuacgaagcugagacuugccaccgggcugcggaacauccccagcauucagucccgcggacucuuuggcgccaucgcuggguucaucgagggaggcuggacagggaugguugacggaugguacggcuaucaucaccagaaugaacaaggcucuggguacgcggccgaucugaaaagcacccagaacgcuauugacgagaucacaaauaaggugaacuccgucauugagaaaaugaauacccaguuuacggccgugggaaaggaguucaaccaccuugagaagagaaucgaaaaucugaacaaaaagguugaugacggcuuccucgauauuuggacauacaaugccgagcugcuggugcuccuggaaaacgagcggacccuugacuaucaugauagcaaugucaaaaaccuguacgagaaggugcgcucucagcucaaaaacaaugcuaaggaaaucgggaacggauguuuugaguucuaucacaagugcgacaauaccuguauggaauccgucaaaaacggcacauacgauuauccuaaguacagcgaggaagccaaacugaauagagaggagaucgacggggugaaacuugaaucuacccggauuuaucaaauccuggcgauuuacuccacaguugcuagcucccucgugcuggucgugucucugggcgccaucagcuuuuggaugugcuccaacggaucucuccagugccgcauuuguaucuga

SEQ ID NO: 188947 - RNA, 1701 nt, Artificial Sequence; identical to SEQ ID NO: 186794
  derived and/or modified sequence opt5 from hemagglutinin__InfluenzaA__ADM95847

SEQ ID NO: 188948 - RNA, 1701 nt, Artificial Sequence; identical to SEQ ID NO: 186794
  derived and/or modified sequence opt5 from hemagglutinin__InfluenzaA__ADM95848

SEQ ID NO: 188949 - RNA, 1701 nt, Artificial Sequence
  derived and/or modified sequence opt5 from hemagglutinin__InfluenzaA__ADM95849
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaagcuguacgagaaaguccgcucucagcucaagaacaacgccaaggaaauugggaauggauguuuugaguucuaucacaaaugcgacaacacauguauggaauccgugaagaauggcaccuacgauuauccuaaauacagcgaggaagcuaagcugaacagagaggagaucgacgggguuaaacuugaaucuacacggaucuaucaaauucuggccaucuacuccacgguggcgagcucccucguccuggugauuucucugggcgcuaucagcuuuuggaugugcuccaauggaucucuccagugccgcauuuguaucuga

SEQ ID NO: 188950 - RNA, 1701 nt, Artificial Sequence; identical to SEQ ID NO: 188290
  derived and/or modified sequence opt5 from hemagglutinin__InfluenzaA__ADM95850

SEQ ID NO: 188951 - RNA, 1701 nt, Artificial Sequence
  derived and/or modified sequence opt5 from hemagglutinin__InfluenzaA__ADM95851
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacaaccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgccgccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacauccccagcauucagucccgcggacucuuuggcgcuaucgccggguucaucgagggaggcuggacagggaugguugacggaugguacggcuaucaucaccagaaugaacaaggcucuggguacgccgcugaucugaaaagcacccagaacgcgauugacgagaucacgaauaaggugaacuccgucauugagaaaaugaauacacaguuuaccgccgugggaaaggaguucaaccaccuugagaagagaaucgaaaaucugaacaaaaagguugaugacggcuuccucgauauuuggaccuacaaugcugagcugcuggugcuccuggaaaacgagcggacacuugacuaucaugauagcaaugucaaaaaccuguacgagaaggugcgcucucagcucaaaaacaaugccaaggaaaucgggaacggauguuuugaguucuaucacaagugcgacaauaccuguauggaauccgucaaaaacggcacauacgauuauccuaaguacagcgaggaagccaaacugaauagagaggagaucgacggggugaaacuugaaucuacgcggauuuaucaaauccuggcuauuuacuccaccguugccagcucccucgugcuggucgugucucugggcgcgaucagcuuuuggaugugcuccaacggaucucuccagugccgcauuuguaucuga

SEQ ID NO: 188952 - RNA, 1701 nt, Artificial Sequence
  derived and/or modified sequence opt5 from hemagglutinin__InfluenzaA__ADM95852
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaagcuguacgagaaaauucgcucucagcucaagaacaacgccaaggaaaucgggaauggauguuuugaguucuaucacaaaugcgacaacacauguauggaauccgucaagaauggcaccuacgauuauccuaaauacagcgaggaagcuaagcugaacagagaggagaucgacggggugaaacuugaaucuacacggauuuaucaaauccuggccauuuacuccacgguugcgagcucccucgugcuggucgugucucugggcgcuaucagcuuuuggaugugcuccaauggaucucuccagugccgcauuuguaucuga

SEQ ID NO: 188953 - RNA, 1701 nt, Artificial Sequence; identical to SEQ ID NO: 187113
  derived and/or modified sequence opt5 from hemagglutinin__InfluenzaA__ADM95854

SEQ ID NO: 188954 - RNA, 1701 nt, Artificial Sequence
  derived and/or modified sequence opt5 from hemagglutinin__InfluenzaA__ADM95855
augaaggccauccuggugguccuccuguacaccuucgcuacaacgaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaaaaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacgagauuacgaauaaggucaacuccgugaucgagaaaaugaauacacaguuuaccgccguuggaaaggaguucaaccaccuugagaagagaauugaaaaucugaacaaaaagguggaugacggcuuccucgauaucuggaccuacaaugcugagcugcugguccuccuggaaaacgagcggacacuugacuaucaugauagcaaugugaaaaagcuguacgagaaaguccgcucucagcucaagaacaacgccaaggaaauugggaauggauguuuugaguucuaucacaaaugcgacaacaccuguauggaauccgugaagaauggcacauacgauuauccuaaauacagcgaggaagccaagcugaacagagaggagaucgacgggguuaaacuugaaucuacgcggaucuaucaaauucuggcuaucuacuccaccguggccagcucccucguccuggugguuucucugggcgcgauuagcuuuuggaugugcuccaauggaucucuccagugccgcaucuguauuuga

SEQ ID NO: 188955 - RNA, 1701 nt, Artificial Sequence
  derived and/or modified sequence opt5 from hemagglutinin__InfluenzaA__ADM95857
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccaacuccuggucuuacaucguggagaccagcuccucugacaauggcacgugcuauccgggggauuuuauugacuacgaagaacugcgggagcagcuuagcuccgucagcucuuucgaacgcuuugagaucuuccccaagaccuccagcuggccuaaccacgauucuaauaagggagugacagccgcuuguccccaugccggcgcgaaauccuuuuauaagaaccugaucuggcucguuaaaaagggcaauagcuacccuaaacugucuaaguccuauauuaacgacaaggggaaagaagugcuuguccuguggggaauccaccaccccagcaccuccgccgaucaacagucucucuaccagaaugcugacgccuacguguucgugggcacaagcagauauuccaagaaauuuaagccugagauugcuauccggccgaaaguccgcgaucaggaggggagaaugaacuacuauuggacccugguugaacccggagacaagauuacguucgaggccacaggcaaccugguggugccucgguacgcguuugccauggaacgcaaugcugggagcggaaucauuaucucugauacccccguccaugacugcaacacaaccugucaaaccccuaaaggcgccaucaauacaucccuccccuuccagaacauucacccgaucacgauuggcaagugcccuaaguaugugaaaagcaccaagcugagaauggcuacagggcuucggaauguucccucuauccagagccgcggacuguuuggcgccauugccggguucaucgagggaggcuggaccgggaugguggacggaugguacggcuaucaucaccagaacgaacaaggcuccggguacgcugcggaucucaaaucuacacagaaugccaucgacgagauuaccaacaaggucaauagcgugaucgagaaaaugaacacgcaguuuacagcuguuggaaaggaguucaaucaccuggagaagagaauugaaaaccuuaauaaaaagguggaugacggcuuccuggauaucuggaccuacaacgccgagcuccugguccugcucgaaaaugagcggacccuggacuaucaugauuccaacgugaaaaaccuuuacgagaagguccgcagccagcugaaaaauaacgccaaggaaauugggaauggauguuuugaguucuaucacaagugcgacaacacauguauggaaucugugaaaaauggcaccuacgauuauccuaaguacuccgaggaagcuaaacucaacagagaggagaucgacgggguuaagcuggaaagcacacggaucuaucaaauucuugccaucuacucuacgguggcguccagccugguccucgugguuucccugggcgcuauuucuuuuuggaugugcagcaauggaucccugcagugccgcaucuguauuuga

SEQ ID NO: 188956 - RNA, 1701 nt, Artificial Sequence; identical to SEQ ID NO: 187375
  derived and/or modified sequence opt5 from hemagglutinin__InfluenzaA__ADM95858

SEQ ID NO: 188957 - RNA, 1701 nt, Artificial Sequence
  derived and/or modified sequence opt5 from hemagglutinin__InfluenzaA__ADM95859
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugagaaacuuuguaagcugagagggguugcuccccuccaucugggaaaaugcaacaucgccggcuggauucuggggaauccugaaugugagucucucagcacagccuccucuuggagcuacaucguggaaaccuccucuagcgacaacggaacgugcuauccgggcgauuuuauugacuacgaggagcugcgggaacagcuuuccagcgucucuuccuucgagcgcuuugaaaucuuccccaagaccagcucuuggccuaaucacgauuccaacaagggggugacagccgcuuguccccaugccggagcgaaaucuuuuuauaagaaucugaucuggcucguuaaaaagggcaacagcuacccuaaacuguccaagagcuauauuaaugacaagggcaaagaggugcuuguccugugggggauccaccaccccuccaccucugccgaucaacagagccucuaccagaacgcugacgccuacguguucgugggaacauccagauauagcaagaaauuuaagccugagauugcuauccggccgaaaguccgcgaucaggaaggcagaaugaauuacuauuggacccugguugagcccggggacaagauuacguucgaagccacaggaaaccugguggugccucgguacgcguuugccauggagcgcaacgcuggcucugggaucauuaucuccgauacccccguccaugacugcaauacaaccugucaaaccccuaaaggagccaucaacacaagccuccccuuccagaauauucacccgaucacgauuggcaagugcccuaaguaugugaaaucuaccaagcugagacuugcuacaggccugcggaacguucccagcauccagucccgcgggcucuuuggagccauugccggcuucaucgaagggggauggaccggcaugguggacgggugguacggauaucaucaccagaaugagcaaggcucuggcuacgcugcggaucugaaaagcacacagaacgccaucgacgagauuaccaauaaggucaacuccgugaucgaaaagaugaauacgcaguuuacagcuguugggaaagaguucaaccaccuugaaaagagaauugagaaucugaacaaaaagguggaugacggauuccucgauaucuggaccuacaaugccgaacugcugguccuccuggagaacgagcggacccuugacuaucaugauagcaaugugaaaaagcuguacgaaaaaguccgcucucagcucaagaacaacgccaaggagauuggcaauggguguuuugaguucuaucacaaaugcgacaacacauguauggaauccgugaagaauggaaccuacgauuauccuaaauacagcgaagaggcuaagcugaacagagaggaaaucgacggcguuaaacuugagucuacacggaucuaucaaauucuggccaucuacuccacgguggcgagcucccucguccuggugguuucucugggggcuauuagcuuuuggaugugcuccaauggcucucuccagugccgcaucuguauuuga

SEQ ID NO: 188958 - RNA, 1701 nt, Artificial Sequence; identical to SEQ ID NO: 187320
  derived and/or modified sequence opt5 from hemagglutinin__InfluenzaA__ADM95860

SEQ ID NO: 188959 - RNA, 1701 nt, Artificial Sequence; identical to SEQ ID NO: 188920
  derived and/or modified sequence opt5 from hemagglutinin__InfluenzaA__ADM95862

SEQ ID NO: 188960 - RNA, 1701 nt, Artificial Sequence
  derived and/or modified sequence opt5 from hemagglutinin__InfluenzaA__ADM95864
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgcgcgucagagaucaggaggggcggaugaauuaccauuggacccugguugaacccggagacaaaauuacguucgaggccacaggcaaccugguggugccucgcuaugcguuugccauggaaagaaacgcugggucuggaaucauuaucuccgauacccccguccacgacugcaauacaaccugucaaaccccuaagggcgccaucaacacaagccuccccuuccagaauauucauccgaucacgauuggcaaaugcccuaaguacgugaagucuaccaaacugcggcuugcuacagggcugcgcaacauccccagcauucaguccagaggacucuuuggcgccaucgccggguucaucgagggaggcuggaccgggaugguugacggaugguauggcuaccaccaccagaaugaacaaggcucuggguaugcugcggaucuuaagagcacacagaacgccauugacgagaucaccaauaaagugaacuccgucauugagaagaugaauacgcaguuuacagcugugggaaaagaguucaaccaucuggagaagcggaucgaaaaucugaacaagaaaguugaugacggcuuccucgauauuuggaccuacaaugccgagcugcuggugcuccuggaaaacgagcgcacccuugacuaccacgauagcaaugucaagaaccuguaugagaaagugagaucucagcucaagaacaaugccaaagaaaucgggaacggauguuuugaguucuaccauaagugcgacaauacauguauggaauccgucaagaacggcaccuaugauuacccuaaauauagcgaggaagcuaagcugaaucgggaggagaucgacggggugaaacuugaaucuacacgcauuuaccaaauccuggccauuuauuccacgguugcgagcucccucgugcuggucgugucucugggcgcuaucagcuuuuggaugugcuccaacggaucucuccagugcagaauuuguaucuga

SEQ ID NO: 188961 - RNA, 1701 nt, Artificial Sequence; identical to SEQ ID NO: 187245
  derived and/or modified sequence opt5 from hemagglutinin__InfluenzaA__ADM95865

SEQ ID NO: 188962 - RNA, 1701 nt, Artificial Sequence
  derived and/or modified sequence opt5 from hemagglutinin__InfluenzaA__ADM95866
augaaggccauccuggugguccuccuguacaccuucgcuacaacgaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagauuuccucuagcgacaacggcacgugcuauccgggggauuuuaucgacuacgaagaacugcgggagcagcuuuccagcgucucuuccuucgaacgcuuugagaucuuccccaagaccagcucuuggccuaaucacgauuccaacaagggagugacagcugccuguccccaugcuggcgccaagagcuuuuauaaaaaucugauuuggcucguuaaaaagggcaacucuuacccuaaacuguccaagagcuauaucaaugacaaggggaaagaagugcuuguccuguggggcauucaccaccccuccaccucugcggaucaacagagccucuaccagaacgccgacgcuuacguguucgugggaacauccagauauagcaagaaauuuaagccugagaucgccauucggccgaaaguccgcgaucaggaggggagaaugaauuacuauuggacccugguugaacccggagacaagaucacguucgaggcuacaggcaaccugguggugccucgguacgccuuugcgauggaacgcaacgccgggucuggaauuaucaucuccgauacccccguccaugacugcaauacaaccugucaaaccccuaaaggcgcuauuaacacaagccuccccuuccagaauauccacccgauuacgaucggcaagugcccuaaguaugugaaaucuaccaagcugagacuuguuacagggcugcggaacgugcccagcauucagucccgcggacucuuuggcgccaucgcuggguucaucgagggaggcuggaccgggauggucgacggaugguacggcuaucaucaccagaaugaacaaggcucuggguacgccgccgaucugaaaagcacacagaacgcuauugacaagaucaccaauaaagugaacuccguuauugagaagaugaauacgcaguuuacagcggugggaaaggaguucaaccaccuugagaaaagaaucgagaaucugaacaagaaagucgaugacggcuuccucgauauuuggaccuacaaugccgaacugcuggugcuccuggagaacgaacggacccuugacuaucaugauagcaaugucaagaaccuguacgagaaagugcgcucucagcucaagaacaaugcuaaggagaucgggaacggauguuuugaguucuaucacaaaugcgacaauacauguauggaauccguuaagaacggcaccuacgauuauccuaaauacagcgaagaggccaagcugaauagagaagagaucgacggggugaaacuugagucuacacggauuuaucaaauccuggccauuuacuccacggcugccagcucccucguccuggugguuucucugggcgcgaucagcuuuuggaugugcuccaacggaucucuccagugccgcauuuguaucuga

SEQ ID NO: 188963 - RNA, 1698 nt, Artificial Sequence; identical to SEQ ID NO: 188537
  derived and/or modified sequence opt5 from hemagglutinin__InfluenzaA__ADN06300

SEQ ID NO: 188964 - RNA, 1698 nt, Artificial Sequence
  derived and/or modified sequence opt5 from hemagglutinin__InfluenzaA__ADN06311
augaaggugaaacugcucguccugcuuugcacccugacagccacguacgcugacaccaucuguauuggcuaucacgccaacaauagcacagauaccguugacacagugcucgagaagaacgugaccgucacacauuccgugaaucugcuugaaaacucucacaaugggaaacugugccuccugaagggaaucgcgccccugcagcucggcaacuguagcguugcuggguggauucugggaaauccugagugcgaacuucugaucuccaaagagucuuggagcuacauuguggaaaagccgaaccccgagaauggcaccuguuauccugggcauuucgccgauuacgaggaacucagagagcaacuguccucugucagcuccuuugaacgguucgagaucuuucccaagggaagcucuuggccuaaccacacggugaccggcguuuccgccagcugcucucauaauggcgagaacuccuucuaucgcaaucuucuguggcucacagggaaaaacggacuguaccccaaucugagcaagucuuaugcuaacaacaaagaaaaggaggugcucguccuguggggcgugcaccacccuccgaauaucgccgaccagaaaacccuuuaccauacagaaaacgcuuacguguccgucguuagcucccacuauucuagaaaguuuacccccgagauugccaagcggccuaaagugcgcgaucaggaagggagaaucaauuacuauuggacgcugcucgagcccggagacacaauuaucuucgaggcgaacggcaaucugauugccccucgguacgcuuuugcccuuagccgcggguucggauccggcaucauuaacagcaaugcucccauggauaagugugacgccaaaugccagaccccgcaaggcgcgaucaacucuucccugccuuuucagaaugugcaucccgucacaaucggggaauguccuaaguaugugagaagcgccaaacuccggaugguuaccggacugcgcaacauucccucuauccagagcagaggccuguucggggcuauugccggauuuaucgagggcggguggaccggaaugguggauggcugguacggcuaucaccaccagaaugaacaaggguccggauacgcugccgaccagaagucuacacagaacgccauuaauggcaucacgaacaaagucaauagcgugaucgagaagaugaacacccaguucacagcuguugggaaggaauuuaacaaacucgagcggcgcauggagaaucugaacaagaaaguggaugacggauucauugauaucuggaccuacaaugcggaacuucugguccuccuggagaacgaaagaacacuugacuuccaugacuccaaugugaagaaccuguaugagaaagucaagagccaacucaagaauaacgccaaagaaauuggcaaugggugcuuugaguucuaccacaaguguaacgaugagugcauggaaucugugaaaaauggcaccuaugacuaccccaaguauuccgaggaaagcaaacugaaccgggagaagaucgauggaguuaagcuggagucuaugggcguguaccagauucucgcuaucuauuccacggucgccagcucccuggugcuucugguuucucucggggccaucagcuuuuggaugugcuccaauggaucucugcagugucgcauuugcaucuga

SEQ ID NO: 188965 - RNA, 1698 nt, Artificial Sequence
  derived and/or modified sequence opt5 from hemagglutinin__InfluenzaA__ADN06322
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaugguggaccagagaacccuguaccggacagagaaugccuacgucagcguuguguccucucauuauagccgcaaauucacccccgaaaucgcuaagagaccuaaggugcgggaucaggagggccgcauuaacuacuauuggacgcuucuggagcccggggacacaaucauuuuugaagccaauggaaaccucaucgcgccuagauacgccuucgcucugucccggggcuuugggagcggaauuaucaauucuaacgcccccaugggcaaaugugaugcuaagugccagaccccgcaaggcgccauuaauuccagccuuccuuuccagaacguccaccccgugacaaucggggaguguccuaaauauguucgcucugcgaagcugagaauggugaccggacuccggaauauccccagcauucagucccgcggccuguuuggggccaucgcuggauucauugaaggcggguggaccggaauggucgacggcugguacggcuaucaucaccagaacgagcaagggucuggauacgccgcugaucagaaaagcacacagaaugccaucaacggcauuacgaauaaggugaacuccguuaucgaaaagaugaauacccaguuuacagccguggggaaagaguucaacaagcuggagagacggauggaaaaccucaauaaaaaggucgacgauggauucaucgacauuuggaccuacaacgcugagcugcuugugcugcucgaaaaugagcgcacacuggauuuucacgacagcaacgucaaaaaucuuuaugaaaaggugaaaucucaacugaagaacaaugcgaaggagaucggcaacgggugcuucgaguuuuaccauaaauguaaugacgaaugcauggaguccguuaagaacggcaccuaugauuaccccaaauauagcgaagagucuaagcucaauagagagaaaauugacggagugaagcuggaauccaugggcgucuaccagauccuggccauuuauagcacgguggcuuccucucucguucugcuugugagccugggggccaucuccuucuggaugugcucuaacggaagccuccagugucggaucugcauuuga

SEQ ID NO: 188966 - RNA, 1698 nt, Artificial Sequence
  derived and/or modified sequence opt5 from hemagglutinin__InfluenzaA__ADN06344
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgagcaucuccgaccagaaaacccuguaccauacagagaacgccuacgugucugucguuagcucccacuauagcagaaaguucacccccgaaauugcuaagcggccuaaagugcgcgaucaggagggcagaaucaauuacuauuggacgcuucuggagcccggggacacaauuaucuuugaagccaacggaaaucucauugcgccucgguacgccuucgcucugucucgcggcuuuggguccggaaucauuaacagcaaugcccccauggauaagugugacgcuaaaugccagaccccgcaaggcgccaucaacucuagccuuccuuuccagaaugugcaucccgucacaaucggcgaguguccuaaguaugugagauccgcgaaacugcggaugguuaccgggcuccgcaacauucccucuauccagagcagaggacuguuuggcgccauugcuggguucaucgaaggaggcuggaccgggaugguggauggaugguacggcuaucaccaccagaaugagcaaggcuccggguacgccgcugaccaaaagagcacacagaacgccauuaauggaaucacgaacaaagucaauucugugaucgaaaagaugaacacccaguuuacagccguuggcaaggaguucaauaaacuggagcggcgcauggaaaaccucaacaagaaaguggaugacggguucauugauaucuggaccuacaaugcugagcugcuuguccugcucgaaaacgagagaacacuggacuuucaugacuccaaugugaagaaccuuuaugaaaaagucaagagccagcugaagaauaacgcgaaagagauuggaaauggcugcuucgaguuuuaccacaaguguaacgaugaaugcauggagucugugaaaaaugggaccuaugacuaccccaaguauuccgaagagagcaaacucaaccgggagaagaucgauggcguuaagcuggaauccaugggaguguaccagauucuggccaucuauucuacggucgcuagcucccucgugcugcuuguuucucugggcgccaucagcuucuggaugugcuccaaugggagccuccagugucgcauuugcaucuga

SEQ ID NO: 188967 - RNA, 1701 nt, Artificial Sequence; identical to SEQ ID NO: 188557
  derived and/or modified sequence opt5 from hemagglutinin__InfluenzaA__ADN06366

SEQ ID NO: 188968 - RNA, 1701 nt, Artificial Sequence
  derived and/or modified sequence opt5 from hemagglutinin__InfluenzaA__ADN26165
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagggaagcacaauggaaaacuuuguaagcugagaggcguugcuccccuccaucuggggaaaugcaacaucgccggauggauucugggcaauccugagugugaaucucucagcacagccuccucuuggagcuacaucguggagaccuccucuagcgauaacgggacgugcuauccgggagacuuuauugauuacgaagaacugcgggagcagcuuuccagcgucucuuccuucgaacgcuuugagaucuuccccaagaccagcucuuggccuaaucacgacuccaacaagggcgugacagccgcuuguccccaugccggcgcgaaaucuuuuuauaagaaucugaucuggcucauuaaaaaggggaacagcuacccuaaacuguccaagagcuauaucaaugauaagggaaaagaaguucuugugcuguggggcauucaccaccccuccaccucugccgaccaacagagccucuaccagaacgcugaugccuacgucuucguggggacauccagauauagcaagaaauuuaagccugagaucgcuauucggccgaaagugcgcgaccaggagggaagaaugaauuacuauuggacccuggucgaacccggcgauaagaucacguucgaggccacagggaaccugguugugccucgguacgcguuugccauggaacgcaacgcuggaucuggcauuaucaucuccgacacccccgugcaugauugcaauacaaccugucaaaccccuaaaggcgccauuaacacaagccuccccuuccagaauauccacccgauuacgaucgggaagugcccuaaguaugucaaaucuaccaagcugagacuugcuacaggacugcggaacauucccagcauccagucccgcggccucuuuggggccaucgccggauucauugagggcggguggaccggaaugguggacggcugguacggcuaucaucaccagaaugaacaagggucuggauacgcugcggaccugaaaagcacacagaacgccaucgaugagauuaccaauaagguuaacuccgugaucgagaaaaugaauacgcaguuuacagcugucggcaaggaguucaaccaccuugagaagagaauugaaaaucugaacaaaaagguggacgauggguuccucgacaucuggaccuacaaugccgagcugcugguucuccuggaaaacgagcggacccuugauuaucaugacagcaaugugaaaaaccuguacgagaagguccgcucucagcucaaaaacaaugccaaggaaaucggaaacggcuguuuugaguucuaucacaagugcgauaauacauguauggaauccgugaaaaacgggaccuacgacuauccuaaguacagcgaggaagcuaaacugaauagagaggagauugauggcgucaaacuugaaucugcccggaucuaucaaauucuggcgaucuacuccacaguggcuagcucccucguucugguggucucucugggagccauuagcuuuuggaugugcuccaacggcucucuccagugccgcaucuguauuuga

SEQ ID NO: 188969 - RNA, 1701 nt, Artificial Sequence; identical to SEQ ID NO: 185873
  derived and/or modified sequence opt5 from hemagglutinin__InfluenzaA__ADN26175

SEQ ID NO: 188970 - RNA, 1701 nt, Artificial Sequence
  derived and/or modified sequence opt5 from hemagglutinin__InfluenzaA__ADN78194
augaaggccauccuggugguccuccuguacaccuucgcuacaacgaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacaagauuacgaauaaagucaacuccgugaucgagaagaugaauacacaguuuaccgccguuggaaaggaguucaaccaccuugagaaaagaauugagaaucugaacaagaaaguggaugacggccuccuggauaucuggaccuacaaugcugaacugcucguccugcuugagaacgaacggacacuggacuaucaugauagcaaugugaagaaccucuacgagaaaguccgcucucagcugaagaacaaugccaaggagauugggaacggauguuucgaauuuuaucacaaaugcgacaauaccuguauggaguccgugaagaacggcacauacgauuauccuaaauacagcgaagaggccaaacuuaauagagaagagaucgacgggguuaaacuggagucuacgcggaucuaucaaauucucgcuaucuacuccaccguggccagcucccugguccuggugguuucucucggcgcgauuagcuucuggaugugcuccaacggaucucugcagugccgcaucuguauuuga

SEQ ID NO: 188971 - RNA, 1701 nt, Artificial Sequence; identical to SEQ ID NO: 186857
  derived and/or modified sequence opt5 from hemagglutinin__InfluenzaA__ADN78195

SEQ ID NO: 188972 - RNA, 1701 nt, Artificial Sequence; identical to SEQ ID NO: 187245
  derived and/or modified sequence opt5 from hemagglutinin__InfluenzaA__ADN78212

SEQ ID NO: 188973 - RNA, 1701 nt, Artificial Sequence; identical to SEQ ID NO: 187245
  derived and/or modified sequence opt5 from hemagglutinin__InfluenzaA__ADN78221

SEQ ID NO: 188974 - RNA, 1698 nt, Artificial Sequence; identical to SEQ ID NO: 188964
  derived and/or modified sequence opt5 from hemagglutinin__InfluenzaA__ADN89050

SEQ ID NO: 188975 - RNA, 1698 nt, Artificial Sequence
  derived and/or modified sequence opt5 from hemagglutinin__InfluenzaA__ADN89061
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacagagaaaaauggccucuaccccaaccugucuaaguccuaugcuaauaacaaagaaaaggaggugcugguccucuggggagugcaccacccuccgagcaucuccgaccagaaaacccuguaccauacagaaaacgccuacgugucugucguuagcucccacuauagcagaaaguucacccccgagauugcuaagcggccuaaagugcgcgaucaggaggggagaaucaauuacuauuggacgcuucuggaacccggcgacacaauuaucuuugaggccaacgggaaucucauugcgccucgguacgccuucgcucugucucgcggauuuggcuccgggaucauuaacagcaaugcccccauggauaagugugacgcuaaaugccagaccccgcaaggagccaucaacucuagccuuccuuuccagaaugugcaucccgucacaaucggcgaauguccuaaguaugugagauccgcgaaacugcggaugguuaccggccuccgcaacauucccucuauccagagcagagggcuguuuggagccauugcuggcuucaucgaagggggauggaccggcaugguggaugggugguacggauaucaccaccagaaugaacaaggcuccggcuacgccgcugaccaaaagagcacacagaacgccauuaaugagaucacgaacaaagucaauucugugaucgagaagaugaacacccaguuuacagccguugggaaggaguucaauaaacuggagcggcgcauggaaaaccucaacaagaaaguggaugacggauucauugauaucuggaccuacaaugcugagcugcuuguccugcucgaaaacgagagaacacuggacuuucaugacuccaaugugaagaaccuuuaugagaaagucaagaaucagcugaagaacaaugcgaaagaaauuggcaacgggugcuucgaguuuuaccacaaguguaaugaugaaugcauggagagcgugaaaaacggaaccuaugacuaccccaaguauucugaggaauccaaacucaaucgggagaagaucgauggcguuaagcuggaaagcauggggguguaccagauucuggccaucuauuccacggucgcuucuagccucgugcugcuuguuucccugggcgccaucucuuucuggaugugcagcaacggaucccuccagugucgcauuugcaucuga

SEQ ID NO: 188976 - RNA, 1698 nt, Artificial Sequence; identical to SEQ ID NO: 188966
  derived and/or modified sequence opt5 from hemagglutinin__InfluenzaA__ADN89072

SEQ ID NO: 188977 - RNA, 1698 nt, Artificial Sequence
  derived and/or modified sequence opt5 from hemagglutinin__InfluenzaA__ADN89083
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaaaacuccuuuuaucgcaaucugcuuuggcugacaggcaaaaacgggcucuaccccaaucugagcaagucuuaugcuaacaacaaagagaaggaagugcugguccucuggggagugcaccacccuccgaauauggccgaccagaaaacccuguaccauacagagaacgcuuacguguccgucguuagcucccacuauucuagaaaguucacccccgaaaucgccaagcggccuaaagugcgcgaucaggagggcagaauuaauuacuauuggacgcuucuggagcccggggacacaaucauuuuugaagcgaacggaaaucucaucgccccucgguacgcuuucgcccugagccgcggcuuuggguccggaauuaucaacagcaaugcucccauggauaagugugacgccaaaugccagaccccgcaaggcgcgauuaacucuucccuuccuuuccagaaugugcaucccgucacaaucggcgaguguccuaaguaugugagaagcgccaaacugcggaugguuaccgggcuccgcaacauccccucuauucagagcagaggacuguuuggcgcuaucgccggguucauugaaggaggcuggaccgggaugguggauggaugguacggcuaucaccaccagaaugagcaaggcuccggguacgcugccgaccagaagucuacacagaacgccaucaauggaauuacgaacaaagucaauagcgugaucgaaaagaugaacacccaguuuacagcuguuggcaaggaguucaacaaacuggagcggcgcauggaaaaucucaacaagaaaguggaugacggguucaucgauauuuggaccuacaaugcggagcugcuuguccugcucgaaaacgagagaacacuggacuuucaugacuccaaugugaagaaccuuuaugaaaaagucaagagccaacugaagaauaacgccaaagagaucggaaauggcugcuucgaguuuuaccacaaguguaacgaugaaugcauggagucugugaaaaaugggaccuaugacuaccccaaguauuccgaagagagcaaacucaaccgggagaagauugauggcguuaagcuggaaucuaugggaguguaccagauccuggcuauuuauuccacggucgccagcucccucgugcugcuuguuucucugggcgccaucagcuucuggaugugcuccaaugggucucuccagugucgcaucugcauuuga

SEQ ID NO: 188978 - RNA, 1698 nt, Artificial Sequence
  derived and/or modified sequence opt5 from hemagglutinin__InfluenzaA__ADN89094
augaaggugaaacugcucguccugcuuugcaccuucacagccacguacgcugacaccaucuguauuggcuaucacgccaacaauagcacagauaccguugacacagcgcuggagaagaacgugaccgugacacauuccgucaaucuccuggaaaacucucacaaugggaaacuuugccugcucaagggaaucgcuccccugcagcugggcaacuguagcguggccggguggauucucggaaauccugagugcgaacugcuuaucuccaaagagucuuggagcuacauuguugaaaagccgaaccccgagaauggcaccuguuauccugggcauuuugccgauuacgaggaacugagagagcaacucuccucugugagcuccuucgaacgguuugagaucuuccccaaggagagcucuuggccuaaccacacggucaccggaguguccgcuagcugcucucauaauggcgaaaacuccuuuuaucgcaaucugcuuuggcugacaggcaaaaacgggcucuaccccaaucugagcaagucuuaugccaacaacaaaggaaaggagguucuggugcucuggggcguccaccacccuccgaauaucgcugaccagaaaacccuguaccauacagaaaacgccuacguguccguggucagcucccacuauucuagaaaguucacccccgagauugcgaagcggccuaaaguucgcgaucaggaagggagaaucaauuacuauuggacgcuucuggagcccggagacacaauuaucuuugaggccaacggcaaucucauugcuccucgguacgccuucgcucugagccgcggguuuggauccggcaucauuaacagcaaugcccccauggauaagugugacgcgaaaugccagaccccgcaaggcgccaucaacucuucccuuccuuuccagaaugugcaucccgugacaaucggggaauguccuaaguaugucagaagcgcuaaacugcggauggugaccggacuccgcaacauucccucuauccagagcagaggccuguuuggggccauugcuggauucaucgagggcggguggaccggaaugguugauggcugguacggcuaucaccaccagaaugaacaaggguccggauacgccgccgaccagaagucuacacagaacgcuauuaauggcaucacgaacaaagugaauagcgucaucgagaagaugaacacccaguuuacagcgguggggaaggaguucaacaaacuggaacggcgcauggagaaucucaacaagaaaguugaugacggauucauugauaucuggaccuacaaugccgaacugcuugugcugcucgagaacgaaagaacacuggacuuucaugacuccaaugucaagaaccuuuaugagaaagucaagagccaacugaagaauaacgcuaaagaaauuggcaaugggugcuucgaguuuuaccacaaguguaacgaugagugcauggaaucugugaaaaauggcaccuaugacuaccccaaguauuccgaggaaagcaaacucaaccgggagaagaucgauggagugaagcuggagucuaugggcguuuaccagauucuggccaucuauuccacgguggccagcucccucguccugcuugugucucugggggcuaucagcuucuggaugugcuccaauggaucucuccagugucgcauuugcaucuga

SEQ ID NO: 188979 - RNA, 1698 nt, Artificial Sequence
  derived and/or modified sequence opt5 from hemagglutinin__InfluenzaA__ADN89116
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaaaacucucacaaugggaaacuuugccugcucaagggaauugcgccccugcagcugggcaacuguagcguggcuggguggauccucggaaauccugagugcgaacugcuuauuuccaaagagucuuggagcuacaucguugaaaagccgaaccccgagaauggcaccuguuauccugggcauuuugccgauuacgaggaacugagagagcaacucuccucugugagcuccuucgaacgguuugagaucuuccccaaggagagcucuuggccuaaccacacggucaccggaguguccgccagcugcucucauaauggcgaauccagcuuuuaucgcaaccugcuuuggcugacaguuaaaaauggccucuaccccaaccugucuaaguccuaugcuaauaacaaagagaaggaagugcugguccucuggggagugcaccacccuccgaacauuguggaccagaaaacccuguacagaacagagaaugccuacgucagcguuguguccucucauuauagccggaaguucacccccgaaaucgcuaagcgcccuaaagugagagaucaggaggggcggauuaacuacuauuggacgcuucuggagcccggcgacacaaucauuuuugaagccaaugggaaccucaucgcgccucgcuacgccuucgcucuguccagaggauuuggcagcgggauuaucaauucuaacgcccccauggauaagugugacgcuaaaugccagaccccgcggggagccaucaauuccagccuuccuuuccaaaacguccaccccgugacaauuggcgaguguccuaaguauguucgcucugcgaaacugagaauggugaccggccuccggaauauccccagcauucagucccgcgggcuguuuggagccaucgcuggcuucauugaagggggauggaccggcauggucgaugggugguacggauaucaucaccagaacgagcagggcucuggcuacgccgcugaccaaaagagcacacagaaugccaucaacgggaucacgaauaaagugaacuccguuauugaaaagaugaauacccaguuuacagccgugggaaaggaguucaacaaccuggagagacggauggaaaaucucaacaaaaaggucgaugacggcuucaucgauauuuggaccuacaaugcugagcugcuugugcugcucgaaaacgagcgcacacuggacuuucacgacagcaaugucaaaaaccuuuaugaaaaggugaaaucucagcugaagaauaacgcgaaggagaucgggaauggaugcuucgaguuuuaccauaaauguaacgaugaaugcauggaguccguuaagaauggcaccuaugacuaccccaaauauagcgaagagucuaagcucaacagagagaaaauugauggggugaagcuggaauccaugggcgucuaccaaauccuggccaucuauagcacgguggcuuccucucucguucugcuugugagccugggagccauuuccuucuggaugugcucuaauggcagccuccagugucggaucugcauuuga

SEQ ID NO: 188980 - RNA, 1698 nt, Artificial Sequence
  derived and/or modified sequence opt5 from hemagglutinin__InfluenzaA__ADN89127
augaaggugaaacugcucguccugcuuugcacccugacagccacguacgcugacaccaucuguauuggcuaucacgccaacaauagcacagauaccguugacacagugcucgagaagaacgugaccgucacacauuccgugaaucugcuugaaaacucucacaaugggaaacugugccuccugaagggaaucgcgccccugcagcucggcaacuguagcguugcuggguggauucugggaaauccugagugcgaacuucugaucuccaaagagucuuggagcuacauuguggaaaagccgaaccccgagaauggcaccuguuauccugggcauuucgccgauuacgaggaacucagagagcaacuguccucugucagcuccuuugaacgguucgagaucuuucccaagggaagcucuuggccuaaccacacggugaccggcguuuccgccagcugcucucauaauggcgagaacuccuucuaucgcaaucuucuguggcucacagggaaaaacggacuguaccccaaucugagcaagucuuaugcuaacaacaaagaaaaggaggugcucguccuguggggcgugcaccacccuccgaauaucgccgaccagaaaacccuuuaccauacagaaaacgcuuacguguccgucguuagcucccacuauucuagaaaguuuacccccgagauugccaagcggccuaaagugcgcgaucaggaagggagaaucaauuacuauuggacgcugcucgagcccggagacacaauuaucuucgaggcgaacggcaaucugauugccccucgguacgcuuuugcccuuagccgcggguucggauccggcaucauuaacagcaaugcucccauggauaagugugacgccaaaugccagaccccgcaaggcgcgaucaacucuucccugccuuuucagaaugugcaucccgucacaaucggggaauguccuaaguaugugagaagcgccaaacuccggaugguuaccggacugcgcaacauucccucuauccagagcagaggccuguucggggcuauugccggauuuaucgagggcggguggaccggaaugguggauggcugguacggcuaucaccaccagaaugaacaaggguccggauacgcugccgaccagaagucuacacagaacgccauuaauggcaucacgaacaaagucaauagcgugaucgagaagaugaacacccaguucacagcuguugggaaggaauuuaacaaacucgagcggcgcauggagaaucugaacaagaaaguggaugacggauucauugauaucuggaccuacaaugcggaacuucugguccuccuggagaacgaaagaacacuugacuuccaugacuccaaugugaagaaccuguaugagaaagucaagagccaacucaagaauaacgccgaagagauuggcaaugggugcuuugaguucuaccacaaauguaacgaugaaugcauggagucugugaagaauggcaccuaugacuaccccaaauauuccgaagagagcaagcugaaccgggagaaaaucgauggaguuaagcuggaaucuaugggcguguaccagauucucgcuaucuauuccacggucgccagcucccuggugcuucugguuucucucggggccaucagcuuuuggaugugcuccaauggaucucugcagugucgcauuugcaucuga

SEQ ID NO: 188981 - RNA, 1698 nt, Artificial Sequence
  derived and/or modified sequence opt5 from hemagglutinin__InfluenzaA__ADN89149
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacagagaaaaauggccucuaccccaaccugucuaaguccuaugcuaauaacaaagaaaaggaggugcugguccucuggggagugcaccacccuccgagcaucuccgaccagaaaacccuguaccauacagaaaacgccuacgugucugucguuagcucccacuauagcagaaaguucacccccgagguggcuaagcggccuaaagugcgcgaucaggaggggagaauuaauuacuauuggacgcuucuggaacccggcgacacaaucauuuuugaggccaacgggaaucucaucgcgccucgguacgccuucgcucugucucgcggauuuggcuccgggauuaucaacagcaaugcccccauggauaagugugacgcuaaaugccagaccccgcaaggagccauuaacucuagccuuccuuuccagaauguccaucccgugacaaucggcgaauguccuaaguauguuagauccgcgaaacugcggauggugaccggccuccgcaacauccccucuauucagagcagagggcuguuuggagccaucgcuggcuucauugaagggggauggaccggcauggucgaugggugguacggauaucaccaccagaaugagcaaggcuccggcuacgccgcugaccagaagucuacacagaacgccaucaaugggauuacgaacaaagugaauagcguuaucgagaagaugaacacccaguuuacagccgugggaaaggaguucaauaaacuggaacggcgcauggagaaccucaacaagaaagucgaugacggcuucaucgauauuuggaccuacaaugcugaacugcuugugcugcucgagaacgaaagaacacuggacuuucaugacuccaaugucaagaaccuuuaugagaaaguuaagagccaacugaagaauaacgcgaaagagaucgggaauggaugcuucgaauuuuaccacaaguguaacgaugagugcauggaaucugugaaaaauggcaccuaugacuaccccaaguauuccgaggagagcaaacucaaccgggaaaagauugauggggugaagcuggaguccaugggcgucuaccagauccuggccauuuauucuacgguggcuagcucccucguucugcuugugucucugggagccaucagcuucuggaugugcuccaauggcagccuccagugucgcaucugcauuuga

SEQ ID NO: 188982 - RNA, 1698 nt, Artificial Sequence; identical to SEQ ID NO: 188537
  derived and/or modified sequence opt5 from hemagglutinin__InfluenzaA__ADN89171

SEQ ID NO: 188983 - RNA, 1698 nt, Artificial Sequence
  derived and/or modified sequence opt5 from hemagglutinin__InfluenzaA__ADN89182
augaaggugaaacugcucguccugcuuugcacccugacagccacguacgcugacaccaucuguauuggcuaucacgccaacaauagcacagauaccguugacacagugcucgagaagaacgugaccgucacacauuccgugaaucugcuugaaaacucucacaaugggaaacugugccuccugaagggaaucgcgccccugcagcucggcaacuguagcguugcuggguggauucugggaaauccugagugcgaacuucugaucuccaaagagucuuggagcuacauuguggaaaagccgaaccccgagaauggcaccuguuauccugggcauuucgccgauuacgaggaacucagagagcaacuguccucugucagcuccuuugaacgguucgagaucuuucccaaggagagcucuuggccuaaccacacggugaccggaguuuccgccagcugcucucauaauggcgaauccagcuucuaucgcaaccuucuguggcucacaggcaaaaaugggcuguaccccaaccugucuaaguccuaugcuaauaacaaagagaaggaagugcucguccuguggggagugcaccacccuccgaacaucguggaccagaaaacccuuuacagaacagagaaugccuacgucagcguuguguccucucauuauagccggaaguuuacccccgaaauugcuaagcgcccuaaagugagagaucaggagggccggaucaacuacuauuggacgcugcucgagcccggggacacaauuaucuucgaagccaauggaaaccugauugcgccucgcuacgccuuugcucuuuccagaggcuucgggagcggaaucauuaauucuaacgcccccauggauaagugugacgcuaaaugccagaccccgcaaggcgccaucaauuccagccugccuuuucagaacguccaccccgugacaaucggcgaguguccuaaguauguucggucugcgaaacuccgcauggugaccgggcugagaaauauucccagcauccagucccggggacuguucggcgccauugcuggguuuaucgaaggaggcuggaccgggauggucgauggaugguacggcuaucaucaccagaacgagcaaggcucuggguacgccgcugaccaaaagagcacacagaaugccauuaacggaaucacgaauaaagugaacuccguuaucgaaaagaugaauacccaguucacagccgugggcaaggaguuuaacaaacucgagcgcagaauggaaaaccugaauaagaaagucgaugacggguucauugauaucuggaccuacaacgcugagcuucuggugcuccuggaaaaugagcggacacuugacuuccacgacagcaacgucaagaaucuguaugaaaaagugaagucucagcucaagaacaaugcgaaagagauuggaaacggcugcuuugaguucuaccauaaguguaaugaugaaugcauggaguccguuaaaaacgggaccuaugacuaccccaaguauagcgaagagucuaaacugaaucgcgagaagaucgauggcgugaagcuggaauccaugggagucuaccagauucucgccaucuauagcacgguggcuuccucucugguucuucuggugagccucggcgccaucuccuuuuggaugugcucuaacgggagccugcaguguagaauuugcaucuga

SEQ ID NO: 188984 - RNA, 1698 nt, Artificial Sequence; identical to SEQ ID NO: 188537
  derived and/or modified sequence opt5 from hemagglutinin__InfluenzaA__ADN89193

SEQ ID NO: 188985 - RNA, 1698 nt, Artificial Sequence; identical to SEQ ID NO: 188537
  derived and/or modified sequence opt5 from hemagglutinin__InfluenzaA__ADN89204

SEQ ID NO: 188986 - RNA, 1698 nt, Artificial Sequence; identical to SEQ ID NO: 188964
  derived and/or modified sequence opt5 from hemagglutinin__InfluenzaA__ADN89215

SEQ ID NO: 188987 - RNA, 1698 nt, Artificial Sequence
  derived and/or modified sequence opt5 from hemagglutinin__InfluenzaA__ADN89226
augaaggugaaacugcucguccugcuuugcaccuucgccgcuacauacgccgacacgaucuguauuggcuaucacgcgaacaauagcaccgauacaguugacaccgugcuggagaagaacgugacagucacccauuccgugaaucuccuggaaaacucucacaaugggaaacuuugccugcucaagggaaucgcuccccugcagcugggcaacuguagcguugccggguggauucucggaaauccugagugcgaacugcuuaucuccaaagagucuuggagcuacauuguggaaaagccgaaccccgagaauggcacauguuauccugggcauuuugccgauuacgaggaacugagagagcaacucuccucugucagcuccuucgaacgguuugagaucuuccccaaggagagcucuuggccuaaccacaccgugacgggaguuuccgcuagcugcucucauaauggcgaauccagcuuuuaucgcaaccugcuuuggcugaccgagaaaaauggccucuaccccaaccugucuaaguccuaugccaauaacaaagaaaaggaggugcugguccucuggggagugcaccacccuccgagcaucuccgaccagaaaacacuguaccauaccgaaaacgcuuacgugucugucguuagcucccacuauagcagaaaguucacacccgagauugccaagcggccuaaagugcgcgaucaggaggggagaaucaauuacuauuggacccuucuggaacccggcgacacgauuaucuuugaggcgaacgggaaucucauugccccucgguacgcuuucgcccugaaccgcggauuuggcucugggaucauuaauuccaacgcucccauggauaagugugacgccaaaugccagacaccgcaaggagcgaucaauagcucucuuccuuuccagaacgugcaucccgucaccaucggcgaauguccuaaguaugugagaagcgccaaacugcggaugguuacaggccuccgcaauauucccuccgugcagucuagagggcuguuuggagcuaucgccggcuucauugaagggggauggaccggcauggucgaugggugguacggauaucaccaccagaacgagcaaggcagcggcuacgcugccgaccagaaguccacccagaaugccaucaacgggauuacaaauaaagugaacagcguuaucgagaagaugaauacgcaguuuaccgcugugggaaaggaguucaacaaacuggaacggcgcauggagaaccucaauaagaaagucgaugacggcuucaucgauauuuggacauacaacgcggaacugcuugugcugcucgagaaugaaagaacccuggacuuucaugacucuaacgucaagaaucuuuaugagaaagugaagaaccaacugaagaauaacgccaaagagaucgggaauggaugcuucgaauuuuaccacaaguguaacgaugagugcauggaauccguuaaaaauggcacauaugacuaccccaaguauagcgaggagucuaaacucaaccgggaaaagauugauggggugaagcuggaguccaugggcgucuaccagauccuggcuauuuauagcaccguggccuccucucucguucugcuugugagccugggagccaucuccuucuggaugugcucuaauggcagccuccagugucgcaucugcauuuga

SEQ ID NO: 188988 - RNA, 1698 nt, Artificial Sequence; identical to SEQ ID NO: 188964
  derived and/or modified sequence opt5 from hemagglutinin__InfluenzaA__ADN89237

SEQ ID NO: 188989 - RNA, 1698 nt, Artificial Sequence
  derived and/or modified sequence opt5 from hemagglutinin__InfluenzaA__ADN89248
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcauugcuggguggauccucggaaauccugagugcgaacugcuuauuuccaaagagucuuggagcuacaucguugaaaagccgaaccccgagaauggcaccuguuauccugggcauuuugccgauuacgaggaacugagagagcaacucuccucugugagcuccuucgaacgguuugagaucuuccccaaggagagcucuuggccuaaccacacggucaccggaguguccgccagcugcucucauaauggcgaauccagcuuuuaucgcaaccugcuuuggcugacaggcaaaaaugggcucuaccccaaccugucuaaguccuaugcuaauaacaaagagaaggaaguucuggugcucuggggaguccaccacccuccgagcauuuccgaccagaaaacccuguaccauacagagaacgccuacgugucuguggucagcucccacuauagcagaaaguucacccccgaaaucgcuaagcggccuaaaguucgcgaucaggagggcagaauuaauuacuauuggacgcuucuggagcccggggacacaaucauuuuugaagccaacggaaaucucaucgcgccucgguacgccuucgcucugucucgcggcuuuggguccggaauuaucaacagcaaugcccccauggauaagugugacgcuaaaugccagaccccgcaaggcgccaucaacucuagccuuccuuuccagaaugugcaucccgugacaauuggcgaguguccuaaguaugucagauccgcgaaacugcggauggugaccgggcuccgcaacauccccucuauucagagcagaggacuguuuggcgccaucgcuggguucauugaaggaggcuggaccgggaugguugauggaugguacggcuaucaccaccagaaugagcaaggcuccggguacgccgcugaccagaagucuacacagaacgccaucaauggaaucacgaacaaagugaauagcgucauugaaaagaugaacacccaguuuacagccgugggcaaggaguucaauaaacuggagcggcgcauggaaaaccucaacaagaaaguugaugacggguucaucgauauuuggaccuacaaugcugagcugcuugugcugcucgaaaacgagagaacacuggacuuucaugacuccaaugucaagaaccuuuaugaaaaagucaagagccaacugaagaauaacgcgaaagagaucggaaauggcugcuucgaguuuuaccacaaguguaacgaugaaugcauggagucugugaaaaaugggaccuaugacuaccccaaguauuccgaagagagcaaacucaaccgggagaagauugauggcgugaagcuggaauccaugggaguuuaccagauccuggccaucuauucuacgguggcuagcucccucguccugcuugugucucugggcgccauuagcuucuggaugugcuccaaugggagccuccagugucgcaucugcauuuga

SEQ ID NO: 188990 - RNA, 1698 nt, Artificial Sequence; identical to SEQ ID NO: 188977
  derived and/or modified sequence opt5 from hemagglutinin__InfluenzaA__ADN89259

SEQ ID NO: 188991 - RNA, 1698 nt, Artificial Sequence
  derived and/or modified sequence opt5 from hemagglutinin__InfluenzaA__ADN89281
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacagagaaaaauggccucuaccccaaccugucuaaguccuaugcuaauaacaaagaaaaggaggugcugguccucuggggagugcaccacccuccgagcaucuccgaccagaaaacccuguaccauacagaaaacgccuacgugucugucguuagcucccacuauagcagaaaguucacccccgagauugcuaagcggccuaaagugcgcgaucaggaggggagaaucaauuacuauuggacgcuucuggaacccggcgacacaauuaucuuugaggccaacgggaaucucauugcgccucgguacgccuucgcucugucucgcggauuuggcuccgggaucauuaacagcaaugcccccauggauaagugugacgcuaaaugccagaccccgcaaggagccaucaacucuagccuuccuuuccagaaugugcaucccgucacaaucggcgaauguccuaaguaugugagauccgcgaaacugcggaugguuaccggccuccgcaacauucccucuauccagagcagagggcuguuuggagccauugcuggcuucaucgaagggggauggaccggcaugguggaugggugguacggauaucaccaccagaaugagcaaggcuccggcuacgccgcugaccaaaagagcacacagaacgccauuaaugggaucacgaacaaagucaauucugugaucgagaagaugaacacccaguuuacagccguuggaaaggaguucaauaaacuggaacggcgcauggagaaccucaacaagaaaguggaugacggcuucauugauaucuggaccuacaaugcugaacugcuuguccugcucgagaacgaaagaacacuggacuuucaugacuccaaugugaagaaccuuuaugagaaagucaagaaucagcugaagaacaaugcgaaagagauugggaacggaugcuucgaauuuuaccacaaguguaaugaugagugcauggaaagcgugaaaaacggcaccuaugacuaccccaaguauucugaggaguccaaacucaaucgggaaaagaucgaugggguuaagcuggagagcaugggcguguaccagauucuggccaucuauuccacggucgcuucuagccucgugcugcuuguuucccugggagccaucucuuucuggaugugcagcaacggcucccuccagugucgcauuugcaucuga

SEQ ID NO: 188992 - RNA, 1698 nt, Artificial Sequence; identical to SEQ ID NO: 188991
  derived and/or modified sequence opt5 from hemagglutinin__InfluenzaA__ADN89292

SEQ ID NO: 188993 - RNA, 1698 nt, Artificial Sequence; identical to SEQ ID NO: 188991
  derived and/or modified sequence opt5 from hemagglutinin__InfluenzaA__ADN89303

SEQ ID NO: 188994 - RNA, 1698 nt, Artificial Sequence; identical to SEQ ID NO: 186650
  derived and/or modified sequence opt5 from hemagglutinin__InfluenzaA__ADN89314

SEQ ID NO: 188995 - RNA, 1698 nt, Artificial Sequence; identical to SEQ ID NO: 186155
  derived and/or modified sequence opt5 from hemagglutinin__InfluenzaA__ADN89325

SEQ ID NO: 188996 - RNA, 1698 nt, Artificial Sequence
  derived and/or modified sequence opt5 from hemagglutinin__InfluenzaA__ADN89336
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaacgcuccuuuuauagaaaccugcuuuggcugacaggcaaaaaugggcucuaccccaaccugagcaagucuuaugcuaauaacaaagagaaggaagugcugguccucuggggagugcaccacccuccggacaucggcgaucagaaaacccuguaccauacagagaacgccuacguguccgucguuagcucccacuauucucggaaguucacccccgaaauugcuaagcgcccuaaagugagagaccaggaggggcggaucaauuacuauuggacgcuucuggagcccggagauacaauuaucuuugaagccaacggcaaucucauugcgccucgcuacgccuucgcucugagcagaggguuuggauccggcaucauuaacagcaaugcccccauggacaagugugaugcuaaaugccagaccccgcaaggcgccaucaacucuucccuuccuuuccagaaugugcaucccgucacaaucggggaguguccuaaguaugugcggagcgcgaaacugcgcaugguuaccggacucagaaacauucccucuauccagagccggggccuguuuggggccauugcuggauucaucgaaggcggguggaccggaaugguggacggcugguacggcuaucaccaccagaaugagcaaggguccggauacgccgcugaucagaagucuacacagaacgccauuaauggcaucacgaacaaagucaauagcgugaucgaaaagaugaacacccaguuuacagccguugggaaggaguucaauaaacuggagcgcagaauggaaaaccucaacaagaaaguggacgauggauucauugacaucuggaccuacaaugcugagcugcuuguccugcucgaaaacgagcggacacuggacuuucaugauuccaaugugaagaaccuuuaugaaaaagucaagagccaacugaagaauaacgcgaaagagauuggcaaugggugcuucgaguuuuaccacaaguguaacgacgaaugcauggagucugugaaaaauggcaccuaugauuaccccaaguauuccgaagagagcaaacucaaccgcgagaagaucgacggaguuaagcuggaaucuaugggcguguaccagauucuggccaucuauuccacggucgcuagcucccucgugcugcuuguuucucugggggccaucagcuucuggaugugcuccaauggaucucuccaguguagaauuugcaucuga

SEQ ID NO: 188997 - RNA, 1698 nt, Artificial Sequence; identical to SEQ ID NO: 188987
  derived and/or modified sequence opt5 from hemagglutinin__InfluenzaA__ADN89347

SEQ ID NO: 188998 - RNA, 1698 nt, Artificial Sequence; identical to SEQ ID NO: 186155
  derived and/or modified sequence opt5 from hemagglutinin__InfluenzaA__ADN89358

SEQ ID NO: 188999 - RNA, 1698 nt, Artificial Sequence
  derived and/or modified sequence opt5 from hemagglutinin__InfluenzaA__ADN89369
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacagugaaaaauggccucuaccccaaccugucuaaguccuaugcuaauaacaaagagaaggaaguccuggugcucuggggagugcaccacccuccgaacaucgucgaccagaaaacccuguacagaacagagaaugccuacguuagcgugguguccucucauuauagccggaaguucauucccgaaaucgcuaagcgcccuaaagucagagaucaggaggggcggauuaacuacuauuggacccuucuggagcccggcgacacgaucauuuuugaagccaaugggaaccucaucgcgccucgcuacgccuucgcucuguccagaggauuuggcagcgggauuaucaauucuaacgcccccauggauaagugugacgcuaaaugccagacaccgcggggagccaucaauuccagccuuccuuuccaaaacgugcaccccguuaccauuggcgaguguccuaaguaugugcgcucugcgaaacugagaauggucacaggccuccggaauauccccagcauucagucccgcgggcuguuuggagccaucgcuggcuucauugaagggggauggaccggcaugguggaugggugguacggauaucaucaccagaacgagcagggcucuggcuacgccgcugaccaaaagagcacccagaaugccaucaacgggaucacaaauaaaguuaacuccgugauugaaaagaugaauacgcaguuuaccgccgucggaaaggaguucaacaaacuggagagacggauggaaaaccucaauaagaaaguggaugacggcuucaucgauauuuggacauacaacgcugagcugcuuguccugcucgaaaaugagcgcacccuggacuuucacgacagcaacgugaagaaucuuuaugaaaaaguuaagucucagcugaagaacaaugcgaaagagaucgggaacggaugcuucgaguuuuaccauaaguguaaugaugaaugcauggaguccgugaaaaacggcacauaugacuaccccaaguauagcgaagagucuaaacucaauagagagaagauugauggggucaagcuggaauccaugggcguguaccaaauccuggccaucuauagcaccguugcuuccucucucgugcugcuugucagccugggagccauuuccuucuggaugugcucuaacggcagccuccagugucggaucugcauuuga

SEQ ID NO: 189000 - RNA, 1698 nt, Artificial Sequence
  derived and/or modified sequence opt5 from hemagglutinin__InfluenzaA__ADN89380
augaaggugaaacugcucguccugcuuugcacccugacagccacguacgcugacaccaucuguauuggcuaucacgccaacaauagcacagauaccguugacacagugcucgagaagaacgugaccgucacacauuccgugaaucugcuugaaaacucucacaaugggaaacugugccuccugaagggaaucgcgccccugcagcucggcaacuguagcguugcuggguggauucugggaaauccugagugcgaacuucugaucuccaaagagucuuggagcuacauuguggaaaagccgaaccccgagaauggcaccuguuauccugggcauuucgccgauuacgaggaacucagagagcaacuguccucugucagcuccuuugaacgguucgagaucuuucccaaggagagcucuuggccuaaccacacggugaccggaguuuccgccagcugcucucauaauggcgaauccagcuucuaucgcaaccuucuguggcucacaggcaaaaaugggcuguaccccaaccugucuaaguccuaugcuaauaacaaagagaaggaagugcucguccuguggggagugcaccacccuccgaacaucguggaccagaaaacccuuuacagaacagagaaugccuacgucagcguuguguccucucauuauagccggaaguuuacccccgaaauugcuaagcgcccuaaagugagagaucaggagggccggaucaacuacuauuggacgcugcucgagcccggggacacaauuaucuucgaagccaauggaaaccugauugcgccucgcuacgccuuugcucuuuccagaggcuucgggagcggaaucauuaauucuaacgcccccauggauaagugugacgcuaaaugccagaccccgcaaggcgccaucaauuccagccugccuuuucagaacguccaccccgugacaaucggcgaguguccuaaguauguucggucugcgaaacuccgcauggugaccgggcugagaaauauucccagcauccagucccggggacuguucggcgccauugcuggguuuaucgaaggaggcuggaccgggauggucgauggaugguacggcuaucaucaccagaacgagcaaggcucuggguacgccgcugaccaaaagagcacacagaaugccauuaacggaaucacgaauaaagugaacuccguuaucgaaaagaugaauacccaguucacagccgugggcaaggaguuuaacaaacucgagcgcagaauggaaaaccugaauaagaaagucgaugacggguucauugauaucuggaccuacaacgcugagcuucuggugcuccuggaaaaugagcggacacuugacuuccacgacagcaacgucaagaaucuguaugaaaaagugaagucucagcucaagaacaaugcgaaagagauuggaaacggcugcuuugaguucuaccauaaguguaauaacgaaugcauggaguccguuaaaaaugggaccuaugauuaccccaaguauagcgaagagucuaaacugaaccgcgagaagaucgacggcgugaagcuggaauccaugggagucuaccagauucucgccaucuauagcacgguggcuuccucucugguucuucuggugagccucggcgccaucuccuuuuggaugugcucuaaugggagccugcaguguagaauuugcaucuga

SEQ ID NO: 189001 - RNA, 1698 nt, Artificial Sequence
  derived and/or modified sequence opt5 from hemagglutinin__InfluenzaA__ADN89391
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaacgcuccuuuuauaaaaaccugcuuuggcugacaggcaagaaugggcucuaccccaaccugagcaaaucuuaugcuaauaacaaggagaaagaagugcugguccucuggggagugcaccacccuccggacaucggcgaucagaagacccuguaccauacagagaacgccuacguguccgucguuagcucccacuauucuagaaaguucacccccgaaauugcuaaacggccuaaggugcgcgaccaggaggggagaaucaauuacuauuggacgcuucuggagcccggagauacaauuaucuuugaagccaacggcaaucucauugcgccucgguacgccuucgcucugagccgcggguuuggauccggcaucauuaacagcaaugcccccauggacaaaugugaugcuaagugccagaccccgcaaggcgccaucaacucuucccuuccuuuccagaaugugcaucccgucacaaucggggaguguccuaaauaugugagaagcgcgaagcugcggaugguuaccggacuccgcaacauucccucuauccagagcagaggccuguuuggggccauugcuggauucaucgaaggcggguggaccggaaugguggacggcugguacggcuaucaccaccagaaugagcaaggguccggauacgccgcugaucagaaaucuacacagaacgccauuaauggcaucacgaacaaggucaauagcgugaucgaaaagaugaacacccaguuuacagccguugggaaagaguucaauaagcuggagcggcgcauggaaaaccucaacaaaaagguggacgauggauucauugacaucuggaccuacaaugcugagcugcuuguccugcucgaaaacgagagaacacuggacuuucaugauuccaaugugaaaaaccuuuaugaaaaggucaagagccaacugaaaaauaacgcgaaggagauuggcaaugggugcuucgaguuuuaccacaaauguaacgacgaaugcauggagucugugaagaauggcaccuaugauuaccccaaauauuccgaagagagcaagcucaaccgggagaagaucgacggaguuaaacuggaaucuaugggcguguaccagauucuggccaucuauuccacggucgcuagcucccucgugcugcuuguuucucugggggccaucagcuucuggaugugcuccaauggaucucuccagugucgcauuugcaucuga

SEQ ID NO: 189002 - RNA, 1698 nt, Artificial Sequence
  derived and/or modified sequence opt5 from hemagglutinin__InfluenzaA__ADN89402
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaaaagucuuggagcuacauuguggagaagccgaaccccgaaaauggcaccuguuauccugggcauuuugccgauuacgaggagcugaaagaacaacucuccucugucagcuccuucgagagauuugaaaucuuccccaaggagagcucuuggccuaaccacacggugaccggaguuuccgccagcugcucucauaauggcgaguccagcuuuuaucggaaccugcuuuggcugacaggcaaaaaugggcucuaccccaaccugucuaaguccuaugcuaauaacaaagaaaaggaggugcugguccucuggggagugcaccacccuccgaacaucguggaccagaagacccuguaccgcacagaaaaugccuacgucagcguuguguccucucauuauagcagaaaauucacccccgagauugcuaagcggccuaaagugcgcgaucaggaaggcagaaucaacuacuauuggacgcuucuggagcccggggacacaauuaucuuugaggccaauggaaaccucauugcgccucgguacgccuucgcucugucccgcggcuuugggagcggaaucauuaauucuaacgcccccaugggcaagugugaugcuaaaugccagaccccgcaaggcgccaucaauuccagccuuccuuuccagaacguccaccccgugacaaucggggaauguccuaaguauguuagaucugcgaaacugcggauggugaccggacuccgcaauauucccagcauccaguccagaggccuguuuggggccauugcuggauucaucgagggcggguggaccggaauggucgacggcugguacggcuaucaucaccagaacgaacaagggucuggauacgccgcugaucaaaagagcacacagaaugccauuaacggcaucacgaauaaggugaacuccguuaucgagaaaaugaauacccaguuuacagccguggggaaggaguucaacaaacuggaacggcgcauggagaaccucaauaagaaagucgacgauggauucauugacaucuggaccuacaacgcugaacugcuugugcugcucgagaaugaaagaacacuggauuuucacgacagcaacgucaagaaucuuuaugagaaggugaaaucucagcugaagaacaaugcgaaagaaauuggcaacgggugcuucgaguuuuaccauaaguguaaugacgagugcauggaauccguuaaaaacggcaccuaugauuaccccaaguauagcgaggaaucuaagcucaaucgggagaaaaucgacggagugaagcuggaguccaugggcgucuaccagauucuggccaucuauagcacgguggcuuccucucucguucugcuugugagccugggggccaucuccuucuggaugugcucuaacggaagccuccagugucgcauuugcaucuga

SEQ ID NO: 189003 - RNA, 1698 nt, Artificial Sequence; identical to SEQ ID NO: 188964
  derived and/or modified sequence opt5 from hemagglutinin__InfluenzaA__ADN89413

SEQ ID NO: 189004 - RNA, 1698 nt, Artificial Sequence; identical to SEQ ID NO: 188537
  derived and/or modified sequence opt5 from hemagglutinin__InfluenzaA__ADN89424

SEQ ID NO: 189005 - RNA, 1698 nt, Artificial Sequence
  derived and/or modified sequence opt5 from hemagglutinin__InfluenzaA__ADN89435
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaaaacuccuuuuaucgcaaucugcuuuggcugacaggcaaaaacgggcucuaccccaaucugagcaagucuuaugcuaacaacaaagagaaggaagugcugguccucuggggagugcaccacccuccgaauaucgccgaccagaaaacccuguaccauacagagaacgcuuacguguccgucguuagcucccacuauucuagaaaguucacccccgaaauugccaagcggccuaaagugcgcgaucaggagggcagaaucaauuacuauuggacgcuucuggagcccggggacacaauuaucuuugaagcgaacggaaaucucauugccccucgguacgcuuucgcccugagccgcggcuuuggguccggaaucauuaacagcaaugcucccauggauaagugugacgccaaaugccagaccccgcaaggcgcgaucaacucuucccuuccuuuccagaaugugcaucccgucacaaucggcgaguguccuaaguaugugagaagcgccaaacugcggaugguuaccgggcuccgcaacauucccucuauccagagcagaggacuguuuggcgcuauugccggguucaucgaaggaggcuggaccgggaugguggauggaugguacggcuaucaccaccagaaugagcaaggcuccggguacgcugccgaccagaagucuacacagaacgccauuaauggaaucacgaacaaagucaauagcgugaucgaaaagaugaacacccaguuuacagcuguuggcaaggaguucaacaaacuggagcggcgcauggaaaaucucaacaagaaaguggaugacggguucauugauaucuggaccuacaaugcggagcugcuuguccugcucgaaaacgagagaacacuggacuuucaugacuccaaugugaagaaccuuuaugaaaaagucaagagccaacugaagaauaacgccaaagagauuggaaauggcugcuucgaguuuuaccacaaguguaacgaugaaugcauggagucugugaaaaaugggaccuaugacuaccccaaguauuccgaagagagccggcucaaccgcgagaaaaucgauggcguuaagcuggaaucuaugggaguguaccagauucuggcuaucuauuccacggucgccagcucccucgugcugcuuguuucucugggcgccaucagcuucuggaugugcuccaaugggucucuccaguguagaauuugcaucuga

SEQ ID NO: 189006 - RNA, 1698 nt, Artificial Sequence
  derived and/or modified sequence opt5 from hemagglutinin__InfluenzaA__ADN89446
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaaaacucucacaaugggaaacuuugccugcucaagggaaucgcuccccugcagcugggcaacuguagcguggccggguggauucucggaaauccugagugcgaacugcuuaucuccaaagagucuuggagcuacauuguugaaaagccgaaccccgagaauggcaccuguuauccugggcauuuugccgauuacgaggaacugagagagcaacucuccucugugagcuccuucgaacgguuugagaucuuccccaaggagagcucuuggccuaaccacacggucaccggaguguccgcuagcugcucucauaauggcgaaaacuccuuuuaucgcaaucugcuuuggcugacaggcaaaaacgggcucuaccccaaucugagcaagucuuaugccaacaacaaagagaaggaaguucuggugcucuggggaguccaccacccuccgaauaucgcugaccagaaaacccuguaccauacagagaacgccuacguguccguggucagcucccacuauucuagaaaguucacccccgaaauugcgaagcggccuaaaguucgcgaucaggagggcagaaucaauuacuauuggacgcuucuggagcccggggacacaauuaucuuugaagccaacggaaaucucauugcuccucgguacgccuucgcucugagccgcggcuuuggguccggaaucauuaacagcaaugcccccauggauaagugugacgcgaaaugccagaccccgcaaggcgccaucaacucuucccuuccuuuccagaaugugcaucccgugacaaucggcgaguguccuaaguaugucagaagcgcuaaacugcggauggugaccgggcuccgcaacauucccucuauccagagcagaggacuguuuggcgccauugcuggguucaucgaaggaggcuggaccgggaugguugauggaugguacggcuaucaccaccagaaugagcaaggcuccggguacgccgccgaccagaagucuacacagaacgcuauuaauggaaucacgaacaaagugaauagcgucaucgaaaagaugaacacccaguuuacagcggugggcaaggaguucaacaaacuggagcggcgcauggaaaaucucaacaagaaaguugaugacggguucauugauaucuggaccuacaaugccgagcugcuugugcugcucgaaaacgagagaacacuggacuuucaugacuccaaugucaagaaccuuuaugaaaaagucaagagccaacugaagaauaacgcuaaagagauuggaaauggcugcuucgaguuuuaccacaaguguaacgaugaaugcauggagucugugaaaaaugggaccuaugacuaccccaaguauuccgaagagagcaaacucaaccgggagaagaucgauggcgugaagcuggaaucuaugggaguuuaccagauucuggccaucuauuccacgguggccagcucccucguccugcuugugucucugggcgcuaucagcuucuggaugugcuccaaugggucucuccagugucgcauuugcaucuga

SEQ ID NO: 189007 - RNA, 1698 nt, Artificial Sequence; identical to SEQ ID NO: 188537
  derived and/or modified sequence opt5 from hemagglutinin__InfluenzaA__ADN89457

SEQ ID NO: 189008 - RNA, 1698 nt, Artificial Sequence
  derived and/or modified sequence opt5 from hemagglutinin__InfluenzaA__ADN89468
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggacagcucuuggccuaaccacacggugaccggaguuuccgccagcugcucucauaauggcgaguccagcuuuuaucgcaaccugcuuuggcugacaggcaaaaaugggcucuaccccaaccugucuaaguccuaugcuaauaacaaagaaaaggaggugcugguccucuggggagugcaccacccuccgagcaucaacgaucagaaaacccuguaccauacagaaaaugccuacguguccgucguuucuagccacuauuccagaaaguucacccccgagauugcuaagcggccuaaagugcgcgaccaggaaggcagaaucaacuacuauuggacgcuucuggagcccggggauacaauuaucuuugaggccaauggaaaccucauugcgccucgguacgccuucgcucugagccgcggcuuugggucuggaaucauuaauuccaacgcccccauggacaagugugaugcuaaaugccagaccccgcaaggcgccaucaauagcucucuuccuuuccagaacgugcaucccgucacaaucggcgaauguccuaaguaugugagaagcgcgaaacugcggaugguuaccgggcuccgcaauauucccuccauccagucuagaggacuguuuggcgccauugcuggguucaucgagggaggcuggaccgggaugguggacggaugguacggcuaucaccaccagaacgaacaaggcagcggguacgccgcugaucagaaguccacacagaaugccauuaacggaaucacgaauaaagucaacagcgugaucgagaagaugaauacccaguuuacagccguuggcaaggaguucucuaaacuggaacggcgcauggagaaccucaacaagaaaguggacgauggguucauugacaucuggaccuacaaugcugaacugcuuguccugcucgagaacgaaagaacacuggacuuucaugauuccaaugugaagaaccuuuaugagaaagucaagagccaacugaagaauaacgcgaaagaaauuggaaauggcugcuucgaguuuuaccacaaguguaacgacgagugcauggaaucugugaaaaaugggaccuaugauuaccccaaguauuccgaggaaagcaaacucaaccgggagaagaucgacggcguuaagcuggaguccaugggaguguaccagauucugacgaucuauucuacagucgccagcucccucgugcugcuuaucucucugggcgcuauuagcuucuggaugugcuccaaugggagccuccagugucgcaucugcauuuga

SEQ ID NO: 189009 - RNA, 1698 nt, Artificial Sequence; identical to SEQ ID NO: 188966
  derived and/or modified sequence opt5 from hemagglutinin__InfluenzaA__ADN89479

SEQ ID NO: 189010 - RNA, 1698 nt, Artificial Sequence; identical to SEQ ID NO: 188966
  derived and/or modified sequence opt5 from hemagglutinin__InfluenzaA__ADN89490

SEQ ID NO: 189011 - RNA, 1698 nt, Artificial Sequence; identical to SEQ ID NO: 188989
  derived and/or modified sequence opt5 from hemagglutinin__InfluenzaA__ADN89501

SEQ ID NO: 189012 - RNA, 1698 nt, Artificial Sequence; identical to SEQ ID NO: 188977
  derived and/or modified sequence opt5 from hemagglutinin__InfluenzaA__ADN89512

SEQ ID NO: 189013 - RNA, 1698 nt, Artificial Sequence; identical to SEQ ID NO: 188991
  derived and/or modified sequence opt5 from hemagglutinin__InfluenzaA__ADN89523

SEQ ID NO: 189014 - RNA, 1698 nt, Artificial Sequence; identical to SEQ ID NO: 189000
  derived and/or modified sequence opt5 from hemagglutinin__InfluenzaA__ADN89534

SEQ ID NO: 189015 - RNA, 1698 nt, Artificial Sequence; identical to SEQ ID NO: 189005
  derived and/or modified sequence opt5 from hemagglutinin__InfluenzaA__ADN89545

SEQ ID NO: 189016 - RNA, 1698 nt, Artificial Sequence; identical to SEQ ID NO: 186650
  derived and/or modified sequence opt5 from hemagglutinin__InfluenzaA__ADN89556

SEQ ID NO: 189017 - RNA, 1698 nt, Artificial Sequence; identical to SEQ ID NO: 188966
  derived and/or modified sequence opt5 from hemagglutinin__InfluenzaA__ADN89567

SEQ ID NO: 189018 - RNA, 1698 nt, Artificial Sequence
  derived and/or modified sequence opt5 from hemagglutinin__InfluenzaA__ADN89578
augaaggugaaacugcucguccugcuuugcacccugacagccacguacgcugacaccaucuguauuggcuaucacgccaacaauagcacagauaccguugacacagugcucgagaagaacgugaccgucacacauuccgugaaucugcuugaaaacucucacaaugggaaacugugccuccugaagggaaucgcgccccugcagcucggcaacuguagcguugcuggguggauucugggaaauccugagugcgaacuucugaucuccaaagagucuuggagcuacauuguggaaaagccgaaccccgagaauggcaccuguuauccugggcauuucgccgauuacgaggaacucagagagcaacuguccucugucagcuccuuugaacgguucgagaucuuucccaagggaagcucuuggccuaaccacacggugaccggcguuuccgccagcugcucucauaauggcgagaacuccuucuaucgcaaucuucuguggcucacagggaaaaacggacuguaccccaaucugagcaagucuuaugcuaacaacaaagaaaaggaggugcuccugcuuuggggcguccaccacccuccgaauaucgccgaccagaaaacccuguaccauacagaaaacgcuuacguguccguggucagcucccacuauucuagaaaguuuacccccgagauugccaagcggccuaaaguucgcgaucaggaagggagaaucaauuacuauuggacgcuccuggagcccggagacacaauuaucuucgaggcgaacggcaaucuuauugccccucgguacgcuuuugcccugagccgcggguucggauccggcaucauuaacagcaaugcucccauggauaagugugacgccaaaugccagaccccgcaaggcgcgaucaacucuucccucccuuuucagaaugugcaucccgugacaaucggggaauguccuaaguaugucagaagcgccaaacugcggauggugaccggacugcgcaacauucccucuauccagagcagaggccucuucggggcuauugccggauuuaucgagggcggguggaccggaaugguugauggcugguacggcuaucaccaccagaaugaacaaggguccggauacgcugccgaccagaagucuacacagaacgccauuaauggcaucacgaacaaagugaauagcgucaucgagaagaugaacacccaguucacagcuguggggaaggaauuuaacaaacuggagcggcgcauggagaaucuuaacaagaaaguugaugacggauucauugauaucuggaccuacaaugcggaacugcucgugcugcuugagaacgaaagaacacuggacuuccaugacuccaaugucaagaaccucuaugagaaagucaagagccaacugaagaauaacgccaaagaaauuggcaaugggugcuuugaguucuaccacaaguguaacgaugagugcauggaaucugugaaaaauggcaccuaugacuaccccaaguauuccgaggaaagcaaacugaaccgggagaagaucgauggagugaagcucgagucuaugggcguuuaccagauucuggcuaucuauuccacgguggccagcucccuuguccugcucgugucucugggggccaucagcuuuuggaugugcuccaauggaucucugcagugucgcauuugcaucuga

SEQ ID NO: 189019 - RNA, 1698 nt, Artificial Sequence; identical to SEQ ID NO: 188537
  derived and/or modified sequence opt5 from hemagglutinin__InfluenzaA__ADN89589

SEQ ID NO: 189020 - RNA, 1698 nt, Artificial Sequence
  derived and/or modified sequence opt5 from hemagglutinin__InfluenzaA__ADN89600
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaagaaagaauggccucuaccccaaccugucuaaguccuaugcuaauaacaaagagaaggaagugcugguccucuggggagugcaccacccuccgaacaugguggaccagaaaacccuguaccggacagagaaugccuacgucagcguuguguccucucauuauagccgcaaguucacccccgaaaucgcuaagagaccuaaagugcgggaucaggaggggcgcauuaacuacuauuggacgcuucuggagcccggcgacacaaucauuuuugaagccaaugggaaccucaucgcgccuagauacgccuucgcucugucccggggauuuggcagcgggauuaucaauucuaacgcccccaugggaaagugugaugcuaaaugccagaccccgcaaggcgccauuaauuccagccuuccuuuccagaacguccaccccgugacaaucggcgaguguccuaaguauguucgcucugcgaaacugagaauggugaccgggcuccggaauauccccagcauucagucccgcggacuguuuggcgccaucgcuggguucauugaaggaggcuggaccgggauggucgacggaugguacggcuaucaucaccagaacgagcaaggcucuggguacgccgcugaucagaaaagcacacagaaugccaucaacggaauuacgaauaaagugaacuccguuaucgaaaagaugaauacccaguuuacagccgugggcaaggaguucaacaaacuggagagacggauggaaaaccucaauaagaaagucgacgauggguucaucgacauuuggaccuacaacgcugagcugcuugugcugcucgaaaaugagcgcacacuggauuuucacgacagcaacgucaagaaucuuuaugaaaaagugaagucucaacugaagaacaaugcgaaagagaucggaaacggcugcuucgaguuuuaccauaaguguaaugacgaaugcauggaguccguuaaaaacgggaccuaugauuaccccaaguauagcgaagagucuaaacucaauagagagaagauugacggcgugaagcuggaauccaugggagucuaccagauccuggccauuuauagcacgguggcuuccucucucguucugcuugugagccugggcgccaucuccuucuggaugugcucuaacgggagccuccagugucggaucugcauuuga

SEQ ID NO: 189021 - RNA, 1698 nt, Artificial Sequence; identical to SEQ ID NO: 188537
  derived and/or modified sequence opt5 from hemagglutinin__InfluenzaA__ADN89611

SEQ ID NO: 189022 - RNA, 1698 nt, Artificial Sequence; identical to SEQ ID NO: 188964
  derived and/or modified sequence opt5 from hemagglutinin__InfluenzaA__ADN89622

SEQ ID NO: 189023 - RNA, 1698 nt, Artificial Sequence; identical to SEQ ID NO: 189005
  derived and/or modified sequence opt5 from hemagglutinin__InfluenzaA__ADN89633

SEQ ID NO: 189024 - RNA, 1698 nt, Artificial Sequence; identical to SEQ ID NO: 188989
  derived and/or modified sequence opt5 from hemagglutinin__InfluenzaA__ADN89644

SEQ ID NO: 189025 - RNA, 1698 nt, Artificial Sequence; identical to SEQ ID NO: 189005
  derived and/or modified sequence opt5 from hemagglutinin__InfluenzaA__ADN89655

SEQ ID NO: 189026 - RNA, 1698 nt, Artificial Sequence; identical to SEQ ID NO: 188537
  derived and/or modified sequence opt5 from hemagglutinin__InfluenzaA__ADN89666

SEQ ID NO: 189027 - RNA, 1698 nt, Artificial Sequence; identical to SEQ ID NO: 188977
  derived and/or modified sequence opt5 from hemagglutinin__InfluenzaA__ADN89677

SEQ ID NO: 189028 - RNA, 1698 nt, Artificial Sequence; identical to SEQ ID NO: 188977
  derived and/or modified sequence opt5 from hemagglutinin__InfluenzaA__ADN89688

SEQ ID NO: 189029 - RNA, 1698 nt, Artificial Sequence; identical to SEQ ID NO: 188964
  derived and/or modified sequence opt5 from hemagglutinin__InfluenzaA__ADN89699

SEQ ID NO: 189030 - RNA, 1698 nt, Artificial Sequence; identical to SEQ ID NO: 188966
  derived and/or modified sequence opt5 from hemagglutinin__InfluenzaA__ADN89710

SEQ ID NO: 189031 - RNA, 1698 nt, Artificial Sequence; identical to SEQ ID NO: 188989
  derived and/or modified sequence opt5 from hemagglutinin__InfluenzaA__ADN89721

SEQ ID NO: 189032 - RNA, 1698 nt, Artificial Sequence; identical to SEQ ID NO: 188966
  derived and/or modified sequence opt5 from hemagglutinin__InfluenzaA__ADN89732

SEQ ID NO: 189033 - RNA, 1698 nt, Artificial Sequence; identical to SEQ ID NO: 188966
  derived and/or modified sequence opt5 from hemagglutinin__InfluenzaA__ADN89743

SEQ ID NO: 189034 - RNA, 1698 nt, Artificial Sequence; identical to SEQ ID NO: 188991
  derived and/or modified sequence opt5 from hemagglutinin__InfluenzaA__ADN89765

SEQ ID NO: 189035 - RNA, 1698 nt, Artificial Sequence
  derived and/or modified sequence opt5 from hemagglutinin__InfluenzaA__ADN89776
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgagcaucuccgaccagaaaacccuguaccauacagagaacgccuacgugucugucguuagcucccacuauagcagaaaguucacccccgaaguggcuaagcggccuaaagugcgcgaucaggagggcagaauuaauuacuauuggacgcuucuggagcccggggacacaaucauuuuugaagccaacggaaaucucaucgcgccucgguacgccuucgcucugucucgcggcuuuggguccggaauuaucaacagcaaugcccccauggauaagugugacgcuaaaugccagaccccgcaaggcgccauuaacucuagccuuccuuuccagaauguccaucccgugacaaucggcgaguguccuaaguauguuagauccgcgaaacugcggauggugaccgggcuccgcaacauccccucuauucagagcagaggacuguuuggcgccaucgcuggguucauugaaggaggcuggaccgggauggucgauggaugguacggcuaucaccaccagaaugagcaaggcuccggguacgccgcugaccagaagucuacacagaacgccaucaauggaauuacgaacaaagugaauagcguuaucgaaaagaugaacacccaguuuacagccgugggcaaggaguucaauaaacuggagcggcgcauggaaaaccucaacaagaaagucgaugacggguucaucgauauuuggaccuacaaugcugagcugcuugugcugcucgaaaacgagagaacacuggacuuucaugacuccaaugucaagaaccuuuaugaaaaaguuaagagccaacugaagaauaacgcgaaagagaucggaaauggcugcuucgaguuuuaccacaaguguaacgaugaaugcauggagucugugaaaaaugggaccuaugacuaccccaaguauuccgaagagagcaaacucaaccgggagaagauugauggcgugaagcuggaauccaugggagucuaccagauccuggccauuuauucuacgguggcuagcucccucguucugcuugugucucugggcgccaucagcuucuggaugugcuccaaugggagccuccagugucgcaucugcauuuga

SEQ ID NO: 189036 - RNA, 1698 nt, Artificial Sequence; identical to SEQ ID NO: 188977
  derived and/or modified sequence opt5 from hemagglutinin__InfluenzaA__ADN89787

SEQ ID NO: 189037 - RNA, 1698 nt, Artificial Sequence; identical to SEQ ID NO: 188991
  derived and/or modified sequence opt5 from hemagglutinin__InfluenzaA__ADN89798

SEQ ID NO: 189038 - RNA, 1698 nt, Artificial Sequence; identical to SEQ ID NO: 188537
  derived and/or modified sequence opt5 from hemagglutinin__InfluenzaA__ADN89809

SEQ ID NO: 189039 - RNA, 1698 nt, Artificial Sequence; identical to SEQ ID NO: 188537
  derived and/or modified sequence opt5 from hemagglutinin__InfluenzaA__ADN89820

SEQ ID NO: 189040 - RNA, 1698 nt, Artificial Sequence; identical to SEQ ID NO: 188537
  derived and/or modified sequence opt5 from hemagglutinin__InfluenzaA__ADN89831

SEQ ID NO: 189041 - RNA, 1698 nt, Artificial Sequence
  derived and/or modified sequence opt5 from hemagglutinin__InfluenzaA__ADN89842
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacagacacaaugggaaacuuugccugcucaagggaaucgcgccccugcagcugggcaacuguucuguugcuggguggauucucggaaauccugagugcgaacugcuuaucagcaaagaguccuggucuuacauuguggaaaagccgaaccccgagaauggcaccuguuauccugggcauuuugccgauuacgaggaacugcgggagcaacucagcuccgucucuagcuucgaacgcuuugagaucuuccccaaggaguccagcuggccuaaccacacggugaccggaguuucugccuccugcagccauaauggcgaaucuuccuuuuauagaaaccugcuuuggcugacaggcaaaaaugggcucuaccccaaccugagcaagucuuaugcuaauaacaaagagaaggaagugcugguccucuggggagugcaccacccuccgaacaucguggaccagaaaacccuguaccggacagagaaugccuacgucuccguugugagcucccauuauucucgcaaguucacccccgaaauugcuaagagaccuaaagugcgggaucaggagggccgcaucaacuacuauuggacgcuucuggagcccggggacacaauuaucuuugaagccaauggaaaccucauugcgccuagauacgccuucgcucugagccggggcuuuggguccggaaucauuaauagcaacgcccccauggauaagugugacgcuaaaugccagaccccgcaaggcgccaucaauucuucccuuccuuuccagaacguccaccccgugacaaucggcgaguguccuaaguauguucgcagcgcgaaacugagaauggugaccgggcuccggaauauucccucuauccagagccgcggacuguuuggcgccauugcuggguucaucgaaggaggcuggaccgggauggucgauggaugguacggcuaucaucaccagaacgagcaaggcuccggguacgccgcugaccagaagucuacacagaaugccauuaacggaaucacgaauaaagugaacagcguuaucgaaaagaugaauacccaguuuacagccgugggcaaggaguucaacaaacuggagagacggauggaaaaccucaauaagaaagucgaugacggguucauugauaucuggaccuacaacgcugagcugcuugugcugcucgaaaaugagcgcacacuggacuuucacgacuccaacgucaagaaucuuuaugaaaaaguuaagagccaacugaagaacaaugcgaaagagauuggaaacggcugcuucgaguuuuaccauaaguguaaugaugaaugcauggagucugugaaaaacgggaccuaugacuaccccaaguauuccgaagagagcaaacucaauagagagaagaucgauggcgugaagcuggaaucuaugggagucuaccagauucuggccaucuauuccacgguggcuagcucccucguucugcuugugucucugggcgccaucagcuucuggaugugcuccaacgggucucuccagugucggauuugcaucuga

SEQ ID NO: 189042 - RNA, 1701 nt, Artificial Sequence; identical to SEQ ID NO: 188557
  derived and/or modified sequence opt5 from hemagglutinin__InfluenzaA__ADN89864

SEQ ID NO: 189043 - RNA, 1701 nt, Artificial Sequence; identical to SEQ ID NO: 188557
  derived and/or modified sequence opt5 from hemagglutinin__InfluenzaA__ADN89875

SEQ ID NO: 189044 - RNA, 1701 nt, Artificial Sequence
  derived and/or modified sequence opt5 from hemagglutinin__InfluenzaA__ADN89886
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaauuuuaaguauccugcccuuaacgucaccaugcccaacaaugagcaguucgacaagcuguacauuuggggcgugcaccauccugggacggauaaagaccagaucuuucucuaugcgcaagccucuggacgcauuacaguuuccaccaagagaagccagcaggcugugaucccgaacauuggcucccggccccgcgucagaaauaucccuucucggaucagcauuuacuggacaaucgugaaacccggggauauucugcugaucaacuccaccggaaaucucauugccccucgcggcuacuucaagaucagaagcgggaaaucuuccaucaugcggagcgacgcucccauuggaaaguguaacucugaaugcaucaccccgaauggcagcauuccuaacgacaagcccuuucagaaugugaaccgcaucacauauggcgccuguccuagauacgucaaacaauccacgcugaagcuggcgaccgggaugcggaauguucccgagaaacagacacgcggaauuuucggcgccaucgcuggguuuaucgaaaacggaugggagggcaugguggaugggugguauggauucagacaccaaaauucugagggccggggccaggccgcugaccuuaagagcacccaggccgccauugaucagaucaacgggaaacucaauagacugauuggaaagacaaacgaaaaauuccaccagaucgagaaggaauuuuccgagguggaaggccgcauucaagaccuugagaaguacgucgaggauaccaaaaucgaccuguggagcuauaacgcugaacuccugguggcgcuggagaaucagcauacgauugaucucacagacucugaaaugaacaagcuguucgagaaaacccggaagcagcuuagagaaaaugccgaggauauggggaacggaugcuuuaccaucuaccacaaaugugacaaugcuugcaucggcuccauucgcaacgggacauaugaucauaauguuuaccgggacgaggcccugaacaauagauuccagaucaagggcguggaacucaagagcggauacaaagacuggauucuguggaucucuuuugccauuuccugcuuccuucugugugucgcucuccugggcuuuaucaugugggccugccaaaaggggaacauccgcuguaauauuugcaucuga

SEQ ID NO: 189045 - RNA, 1701 nt, Artificial Sequence; identical to SEQ ID NO: 188557
  derived and/or modified sequence opt5 from hemagglutinin__InfluenzaA__ADN89897

SEQ ID NO: 189046 - RNA, 1701 nt, Artificial Sequence; identical to SEQ ID NO: 188557
  derived and/or modified sequence opt5 from hemagglutinin__InfluenzaA__ADN89908

SEQ ID NO: 189047 - RNA, 1701 nt, Artificial Sequence; identical to SEQ ID NO: 188557
  derived and/or modified sequence opt5 from hemagglutinin__InfluenzaA__ADN89919

SEQ ID NO: 189048 - RNA, 1701 nt, Artificial Sequence; identical to SEQ ID NO: 188557
  derived and/or modified sequence opt5 from hemagglutinin__InfluenzaA__ADN89930

SEQ ID NO: 189049 - RNA, 1701 nt, Artificial Sequence; identical to SEQ ID NO: 188557
  derived and/or modified sequence opt5 from hemagglutinin__InfluenzaA__ADN89941

SEQ ID NO: 189050 - RNA, 1701 nt, Artificial Sequence; identical to SEQ ID NO: 188557
  derived and/or modified sequence opt5 from hemagglutinin__InfluenzaA__ADN89952

SEQ ID NO: 189051 - RNA, 1701 nt, Artificial Sequence; identical to SEQ ID NO: 188557
  derived and/or modified sequence opt5 from hemagglutinin__InfluenzaA__ADN89963

SEQ ID NO: 189052 - RNA, 1701 nt, Artificial Sequence
  derived and/or modified sequence opt5 from hemagglutinin__InfluenzaA__ADN89974
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaauuuuaaguauccugcccuuaacgucaccaugcccaacaaugagcaguucgacaagcuguacauuuggggcgugcaccauccugggacggauaaagaccagaucuuucucuaugcgcaagccucuggacgcauuacaguuuccaccaagagaagccagcaggcugugaucccgaacauuggcucccggccccgcgucagaaauaucccuucucggaucagcauuuacuggacaaucgugaaacccggggauauucugcugaucaacuccaccggaaaucucauugccccucgcggcuacuucaagauccagagcgggaaaucuuccaucaugagaagcgacgcucccauuggaaaguguaacucugaaugcaucaccccgaauggcagcauuccuaacgacaagcccuuucaaaaugugaaccggaucacauauggcgccuguccucgcuacgucaaacaguccacgcugaagcuggcgaccgggaugagaaauguucccgagaaacagacacggggaauuuucggcgccaucgcuggguuuaucgaaaacggaugggagggcaugguggaugggugguauggauuccgccaccaaaauucugagggcagaggccaggccgcugaccuuaagagcacccaggccgccauugaucagaucaacgggaaacucaaucggcugauuggaaagacaaacgaaaaauuccaccaaaucgagaaggaauuuuccgagguggaaggccgcauucaggaccuugagaaguacgucgaggauaccaaaaucgaccuguggagcuauaacgcugaacuccugguggcgcuggagaaucagcauacgauugaucucacagacucugaaaugaacaagcuguucgagaaaaccaagaaacagcuuagagaaaaugccgaggauauggggaacggaugcuuuaccaucuaccacaagugugacaaugcuugcaucggcuccauucggaacgggacauaugaucauaauguuuacagagacgaggcccugaacaaucgcuuccaaaucaagggcguggaacucaaaagcggauacaaggacuggauucuguggaucucuuuugccauuuccugcuuccuucugugugucgcucuccugggcuuuaucaugugggccugccagaaagggaacauccgguguaauauuugcaucuga

SEQ ID NO: 189053 - RNA, 1701 nt, Artificial Sequence; identical to SEQ ID NO: 188557
  derived and/or modified sequence opt5 from hemagglutinin__InfluenzaA__ADN89985

SEQ ID NO: 189054 - RNA, 1701 nt, Artificial Sequence; identical to SEQ ID NO: 188557
  derived and/or modified sequence opt5 from hemagglutinin__InfluenzaA__ADN89996

SEQ ID NO: 189055 - RNA, 1701 nt, Artificial Sequence; identical to SEQ ID NO: 188557
  derived and/or modified sequence opt5 from hemagglutinin__InfluenzaA__ADN90007

SEQ ID NO: 189056 - RNA, 1701 nt, Artificial Sequence; identical to SEQ ID NO: 188557
  derived and/or modified sequence opt5 from hemagglutinin__InfluenzaA__ADN90018

SEQ ID NO: 189057 - RNA, 1701 nt, Artificial Sequence; identical to SEQ ID NO: 188557
  derived and/or modified sequence opt5 from hemagglutinin__InfluenzaA__ADN90040

SEQ ID NO: 189058 - RNA, 1701 nt, Artificial Sequence; identical to SEQ ID NO: 188557
  derived and/or modified sequence opt5 from hemagglutinin__InfluenzaA__ADN90051

SEQ ID NO: 189059 - RNA, 1701 nt, Artificial Sequence; identical to SEQ ID NO: 188557
  derived and/or modified sequence opt5 from hemagglutinin__InfluenzaA__ADN90062

SEQ ID NO: 189060 - RNA, 1701 nt, Artificial Sequence; identical to SEQ ID NO: 188557
  derived and/or modified sequence opt5 from hemagglutinin__InfluenzaA__ADN90073

SEQ ID NO: 189061 - RNA, 1701 nt, Artificial Sequence; identical to SEQ ID NO: 188557
  derived and/or modified sequence opt5 from hemagglutinin__InfluenzaA__ADN90084

SEQ ID NO: 189062 - RNA, 1701 nt, Artificial Sequence; identical to SEQ ID NO: 188557
  derived and/or modified sequence opt5 from hemagglutinin__InfluenzaA__ADN90095

SEQ ID NO: 189063 - RNA, 1701 nt, Artificial Sequence; identical to SEQ ID NO: 188557
  derived and/or modified sequence opt5 from hemagglutinin__InfluenzaA__ADN90106

SEQ ID NO: 189064 - RNA, 1701 nt, Artificial Sequence; identical to SEQ ID NO: 188557
  derived and/or modified sequence opt5 from hemagglutinin__InfluenzaA__ADN90117

SEQ ID NO: 189065 - RNA, 1701 nt, Artificial Sequence; identical to SEQ ID NO: 188557
  derived and/or modified sequence opt5 from hemagglutinin__InfluenzaA__ADN90128

SEQ ID NO: 189066 - RNA, 1701 nt, Artificial Sequence; identical to SEQ ID NO: 188557
  derived and/or modified sequence opt5 from hemagglutinin__InfluenzaA__ADN90139

SEQ ID NO: 189067 - RNA, 1701 nt, Artificial Sequence; identical to SEQ ID NO: 188557
  derived and/or modified sequence opt5 from hemagglutinin__InfluenzaA__ADN90150

SEQ ID NO: 189068 - RNA, 1701 nt, Artificial Sequence; identical to SEQ ID NO: 188557
  derived and/or modified sequence opt5 from hemagglutinin__InfluenzaA__ADN90161

SEQ ID NO: 189069 - RNA, 1701 nt, Artificial Sequence; identical to SEQ ID NO: 188557
  derived and/or modified sequence opt5 from hemagglutinin__InfluenzaA__ADN90172

SEQ ID NO: 189070 - RNA, 1701 nt, Artificial Sequence; identical to SEQ ID NO: 188557
  derived and/or modified sequence opt5 from hemagglutinin__InfluenzaA__ADN90183

SEQ ID NO: 189071 - RNA, 1701 nt, Artificial Sequence; identical to SEQ ID NO: 188557
  derived and/or modified sequence opt5 from hemagglutinin__InfluenzaA__ADN90194

SEQ ID NO: 189072 - RNA, 1701 nt, Artificial Sequence; identical to SEQ ID NO: 188557
  derived and/or modified sequence opt5 from hemagglutinin__InfluenzaA__ADN90205

SEQ ID NO: 189073 - RNA, 1701 nt, Artificial Sequence; identical to SEQ ID NO: 188557
  derived and/or modified sequence opt5 from hemagglutinin__InfluenzaA__ADN90216

SEQ ID NO: 189074 - RNA, 1701 nt, Artificial Sequence; identical to SEQ ID NO: 186454
  derived and/or modified sequence opt5 from hemagglutinin__InfluenzaA__ADN92467

SEQ ID NO: 189075 - RNA, 1701 nt, Artificial Sequence
  derived and/or modified sequence opt5 from hemagglutinin__InfluenzaA__ADN92478
augaagaccaucauugcccugagccacauccucugccugguguucgcucagaaacuucccggcaacgacaauuccacagccacgcugugucucgggcaucacgcggucccuaacggaaccauuguuaagacaaucaccaaugaucaaauugaggugacaaacgcuaccgaacuggugcagucuagcuccacaggcgagaucugcgacucuccgcaucagauccuugaugggaaaaauuguacccugauugacgcccuccugggagauccccagugcgacggcuuucaaaacaagaaaugggaucuguucgucgaaagaagcaaggccuacuccaauuguuauccuuacgacgugcccgauuaugcuucucuccggagccugguugccuccagcgggacgcuugaguuuaacaaugaaucuuucaacuggaccggagugacacagaauggcaccuccagcgcuugcauccgcagaucuaagaacuccuuuuucagccggcugaauuggcucacacaccugaacuuuaaauaccaggcccuuaaugucaccaugccuaacaacgagcaguucgacaagcuguauauuuggggcgugcaucaccccgggacggauaaagaccaaaucuuucucuacgcgcaggccucuggacgcauuacaguuuccaccaagagaagccagcagacagugaucccuaauauuggcucccggccgcgcgucagaaacauccccucucggaucagcauuuauuggaccaucgugaaaccuggggauauucugcugaucaauuccaccggaaaccucauugcuccccgcggcuacuucaagauccaaagcgggaagucuuccaucaugagaagcgacgccccuauuggaaaauguaauucugagugcaucacacccaacggcagcauuccgaaugacaagccuuuucagaacgugaaucggaucacguacggcgcuuguccccgcuaugucaaacagaacacccugaaacuugccacagggaugagaaauguuccugaaaaacaaacccggggaauuuucggcgcgaucgccggguuuaucgagaacggaugggaaggcaugguggaugggugguacggauuccgccaccaaaauuccgagggcagaggccaggcugccgaccugaagucuacacaggcugccauugaucagaucaacgggaaacucaaucggcugauuggaaagaccaacgagaaguuccaucagaucgaaaaagaguuuagcgaaguggagggccgcauucaggaccuugaaaaguaugucgaggauacgaaaaucgaccugugguccuacaacgccgagcuccugguggcucuggaaaaucagcacacaauugaucucaccgacagcgagaugaacaagcuguucgaaaagaccaagaagcaacuuagagagaaugcggaagauauggggaacggaugcuuuaaaaucuaucauaagugugacaaugccugcaucggcucuauucggaacgggacauacgaucacgacguuuauagagacgaggcucugaauaaccgcuuccagaucaaaggcguggagcucaaguccggauacaaagauuggauucuguggaucagcuuugccauuucuugcuuccuucugugugucgcccuccugggcuuuaucaugugggcuugccagaaggggaauauccgguguaacauuugcaucuga

SEQ ID NO: 189076 - RNA, 1701 nt, Artificial Sequence
  derived and/or modified sequence opt5 from hemagglutinin__InfluenzaA__ADN92489
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaaacuucaauuggaccggagugacacagaacggcaccucuuccgcuugcauccgcagaagcaagaauagcuuuuucucccggcugaacuggcucacacaucugaauuuuaaauaucaggcccuuaacgucaccaugccuaacaaugagcaguucgacaagcuguacauuuggggcgugcaccaucccgggacggauaaagaccaaaucuuucucuaugcgcaggccagcggacgcauuacaguuucuaccaagagaucccagcagacagugaucccuaacauuggcagccggccgcgcgucagaaauauccccucccggaucucuauuuacuggaccaucgugaaaccuggggauauucugcugaucaacagcaccggaaaucucauugcuccccgcggcuacuucaagauccaauccgggaagucuucuaucaugagauccgacgccccuauuggaaaauguaacagcgagugcaucacacccaauggcucuauuccgaacgacaagccuuuucagaaugugaaccggaucacguauggcgcuuguccccgcuacgucaaacagaauacccugaaacuugccacagggaugagaaacguuccugaaaaacaaacccggggaauuuucggcgcgaucgccggguuuaucgagaauggaugggaaggcaugguggaugggugguauggauuccgccaccagaacagcgagggcagaggccaggcugccgaccugaaguccacacaggcugccauugaucaaaucaaugggaaacucaaccggcugauuggaaagaccaacgagaaguuccaccagaucgaaaaagaguuuucugaaguggagggccgcauucaggaccuugaaaaguacgucgaggauacgaaaaucgaccuguggagcuauaaugccgagcuccugguggcucuggaaaaccagcauacaauugaucucaccgacuccgagaugaauaagcuguucgaaaagaccaagaagcaacuuagagagaacgcggaagauauggggaauggaugcuuuaaaaucuaccacaagugugacaacgccugcaucggcagcauucggaaugggacauaugaucaugacguuuacagagacgaggcucugaacaaucgcuuccagaucaaaggcguggagcucaagucuggauacaaagauuggauucuguggaucuccuuugccauuagcugcuuccuucugugugucgcccuccugggcuuuaucaugugggcuugccagaaggggaacauccgguguaauauuugcaucuga

SEQ ID NO: 189077 - RNA, 1701 nt, Artificial Sequence; identical to SEQ ID NO: 186454
  derived and/or modified sequence opt5 from hemagglutinin__InfluenzaA__ADN92500

SEQ ID NO: 189078 - RNA, 1701 nt, Artificial Sequence; identical to SEQ ID NO: 185693
  derived and/or modified sequence opt5 from hemagglutinin__InfluenzaA__ADN92510

SEQ ID NO: 189079 - RNA, 1701 nt, Artificial Sequence; identical to SEQ ID NO: 185693
  derived and/or modified sequence opt5 from hemagglutinin__InfluenzaA__ADN92520

SEQ ID NO: 189080 - RNA, 1701 nt, Artificial Sequence; identical to SEQ ID NO: 186795
  derived and/or modified sequence opt5 from hemagglutinin__InfluenzaA__ADN92530

SEQ ID NO: 189081 - RNA, 1701 nt, Artificial Sequence; identical to SEQ ID NO: 185935
  derived and/or modified sequence opt5 from hemagglutinin__InfluenzaA__ADN92540

SEQ ID NO: 189082 - RNA, 1701 nt, Artificial Sequence; identical to SEQ ID NO: 185693
  derived and/or modified sequence opt5 from hemagglutinin__InfluenzaA__ADN92550

SEQ ID NO: 189083 - RNA, 1701 nt, Artificial Sequence; identical to SEQ ID NO: 185693
  derived and/or modified sequence opt5 from hemagglutinin__InfluenzaA__ADN92560

SEQ ID NO: 189084 - RNA, 1701 nt, Artificial Sequence
  derived and/or modified sequence opt5 from hemagglutinin__InfluenzaA__ADO00730
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugaguguggcucucucagcacagccuccucuuggagcuacaucguggaaaccuccucuagcgacaacgggacgugcuauccgggagauuuuauugacuacgaggaacugcgggagcagcuuuccagcgucucuuccuucgagcgcuuugaaaucuuccccaagaccagcucuuggccuaaucacgauuccaacaagggcgugacagccgcuuguccccaugccggcgcgaaaucuuuuuauaagaaucugaucuggcucguuaaaaaggggaacagcuacccuaaacuguccaagagcuauauuaaugacaagggaaaagaggugcuuguccuguggggcauccaccaccccuccaccucugccgaucaacagagccucuaccagaacgcugacgccuacguguucguggggacauccagauauagcaagaaauuuaagccugaaauugcuauccggccgaaaguccgcgaucaggagggaagaaugaauuacuauuggacccugguugagcccggcgacaagauuacguucgaagccacagggaaccugguggugccucgguacgcguuugccauggagcgcaacgcuggaucuggcaucauuaucuccgauacccccguccaugacugcaauacaaccugucaaaccccuaaaggcgccaucaacacaagccuccccuuccagaauauucacccgaucacgauugggaagugcccuaaguaugugaaaucuaccaagcugagacuugcuacaggacugcggaacguucccagcauccagucccgcggccucuuuggggccauugccggauucaucgaaggcggguggaccggaaugguggacggcugguacggcuaucaucaccagaaugagcaagggucuggauacgcugcggaucugaaaagcacacagaacgccaucgacggcauuaccaauaaggucaacuccgugaucgaaaagaugaauacgcaguuuacagcuguugggaaggaguucaaccaccuugagaagagaauugaaaaucugaacaaaaagguggaugacggauuccucgauaucuggaccuacaaugccgagcugcugguccuccuggaaaacgagcggacccuugacuaucaugauagcaaugugaaaaaccuguacgaaaagguccgcucucagcucaaaaacaaugccaaggagauuggcaacggguguuuugaguucuaucacaagugcgacaauacauguauggaauccgugaaaaacggcaccuacgauuauccuaaguacagcgaggaagcuaaacugaauagagaggaaaucgacggaguuaaacuugagucuacacggaucuaucaaauucuggccaucuacuccacgguggcgagcucccucguccuggugguuucucugggcgcuauuagcuuuuggaugugcuccaacgggucucuccagugccgcaucuguauuuga

SEQ ID NO: 189085 - RNA, 1701 nt, Artificial Sequence; identical to SEQ ID NO: 187113
  derived and/or modified sequence opt5 from hemagglutinin__InfluenzaA__ADO00740

SEQ ID NO: 189086 - RNA, 1701 nt, Artificial Sequence; identical to SEQ ID NO: 186857
  derived and/or modified sequence opt5 from hemagglutinin__InfluenzaA__ADO00750

SEQ ID NO: 189087 - RNA, 1701 nt, Artificial Sequence; identical to SEQ ID NO: 185693
  derived and/or modified sequence opt5 from hemagglutinin__InfluenzaA__ADO12143

SEQ ID NO: 189088 - RNA, 1701 nt, Artificial Sequence; identical to SEQ ID NO: 185693
  derived and/or modified sequence opt5 from hemagglutinin__InfluenzaA__ADO12153

SEQ ID NO: 189089 - RNA, 1701 nt, Artificial Sequence; identical to SEQ ID NO: 185693
  derived and/or modified sequence opt5 from hemagglutinin__InfluenzaA__ADO12163

SEQ ID NO: 189090 - RNA, 1701 nt, Artificial Sequence; identical to SEQ ID NO: 185693
  derived and/or modified sequence opt5 from hemagglutinin__InfluenzaA__ADO12173

SEQ ID NO: 189091 - RNA, 1701 nt, Artificial Sequence; identical to SEQ ID NO: 185693
  derived and/or modified sequence opt5 from hemagglutinin__InfluenzaA__ADO12183

SEQ ID NO: 189092 - RNA, 1701 nt, Artificial Sequence; identical to SEQ ID NO: 185693
  derived and/or modified sequence opt5 from hemagglutinin__InfluenzaA__ADO12193

SEQ ID NO: 189093 - RNA, 1701 nt, Artificial Sequence; identical to SEQ ID NO: 185693
  derived and/or modified sequence opt5 from hemagglutinin__InfluenzaA__ADO12203

SEQ ID NO: 189094 - RNA, 1701 nt, Artificial Sequence; identical to SEQ ID NO: 185693
  derived and/or modified sequence opt5 from hemagglutinin__InfluenzaA__ADO12213

SEQ ID NO: 189095 - RNA, 1701 nt, Artificial Sequence; identical to SEQ ID NO: 185693
  derived and/or modified sequence opt5 from hemagglutinin__InfluenzaA__ADO12223

SEQ ID NO: 189096 - RNA, 1701 nt, Artificial Sequence; identical to SEQ ID NO: 185693
  derived and/or modified sequence opt5 from hemagglutinin__InfluenzaA__ADO12233

SEQ ID NO: 189097 - RNA, 1701 nt, Artificial Sequence; identical to SEQ ID NO: 185693
  derived and/or modified sequence opt5 from hemagglutinin__InfluenzaA__ADO12243

SEQ ID NO: 189098 - RNA, 1701 nt, Artificial Sequence; identical to SEQ ID NO: 185693
  derived and/or modified sequence opt5 from hemagglutinin__InfluenzaA__ADO12253

SEQ ID NO: 189099 - RNA, 1701 nt, Artificial Sequence; identical to SEQ ID NO: 185693
  derived and/or modified sequence opt5 from hemagglutinin__InfluenzaA__ADO12263

SEQ ID NO: 189100 - RNA, 1701 nt, Artificial Sequence; identical to SEQ ID NO: 185693
  derived and/or modified sequence opt5 from hemagglutinin__InfluenzaA__ADO12273

SEQ ID NO: 189101 - RNA, 1701 nt, Artificial Sequence; identical to SEQ ID NO: 185693
  derived and/or modified sequence opt5 from hemagglutinin__InfluenzaA__ADO12283

SEQ ID NO: 189102 - RNA, 1701 nt, Artificial Sequence; identical to SEQ ID NO: 185693
  derived and/or modified sequence opt5 from hemagglutinin__InfluenzaA__ADO12293

SEQ ID NO: 189103 - RNA, 1701 nt, Artificial Sequence; identical to SEQ ID NO: 185693
  derived and/or modified sequence opt5 from hemagglutinin__InfluenzaA__ADO12303

SEQ ID NO: 189104 - RNA, 1701 nt, Artificial Sequence; identical to SEQ ID NO: 185693
  derived and/or modified sequence opt5 from hemagglutinin__InfluenzaA__ADO12313

SEQ ID NO: 189105 - RNA, 1701 nt, Artificial Sequence; identical to SEQ ID NO: 185693
  derived and/or modified sequence opt5 from hemagglutinin__InfluenzaA__ADO12323

SEQ ID NO: 189106 - RNA, 1701 nt, Artificial Sequence; identical to SEQ ID NO: 185693
  derived and/or modified sequence opt5 from hemagglutinin__InfluenzaA__ADO12333

SEQ ID NO: 189107 - RNA, 1701 nt, Artificial Sequence; identical to SEQ ID NO: 185693
  derived and/or modified sequence opt5 from hemagglutinin__InfluenzaA__ADO12343

SEQ ID NO: 189108 - RNA, 1701 nt, Artificial Sequence; identical to SEQ ID NO: 185693
  derived and/or modified sequence opt5 from hemagglutinin__InfluenzaA__ADO12353

SEQ ID NO: 189109 - RNA, 1701 nt, Artificial Sequence; identical to SEQ ID NO: 185693
  derived and/or modified sequence opt5 from hemagglutinin__InfluenzaA__ADO12363

SEQ ID NO: 189110 - RNA, 1701 nt, Artificial Sequence
  derived and/or modified sequence opt5 from hemagglutinin__InfluenzaA__ADO12373
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaauaacaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaccugguggugccucgguacgcguuugccauggaacgcaaugcugggucuggaaucauuaucuccgacacccccguccaugauugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggacggaugguacggcuaucaucaccagaacgaacaaggcucuggguacgcugcggaccugaaaagcacacagaaugccaucgaugagauuaccaacaaggucaauuccgugaucgagaaaaugaacacgcaguuuacagcuguuggaaaggaguucaaucaccuugagaagagaauugaaaaccugaauaaaaagguggacgauggcuuccucgacaucuggaccuacaacgccgagcugcugguccuccuggaaaaugagcggacccuugauuaucaugacagcaacgugaaaaaccuguacgagaagguccgcucucagcucaaaaauaacgccaaggaaauugggaauggauguuuugaguucuaucacaagugcgauaacacauguauggaauccgugaaaaauggcaccuacgacuauccuaaguacagcgaggaagcuaaacugaacagagaggagaucgaugggguuaaacuugaaucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 189111 - RNA, 1701 nt, Artificial Sequence; identical to SEQ ID NO: 187178
  derived and/or modified sequence opt5 from hemagglutinin__InfluenzaA__ADO12383

SEQ ID NO: 189112 - RNA, 1701 nt, Artificial Sequence
  derived and/or modified sequence opt5 from hemagglutinin__InfluenzaA__ADO12403
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaaugugcacccgauuacgaucggcaagugcccuaaguauguuaaaucuaccaagcugagacuugcuacagggcugcggaacgugcccagcauucagucccgcggacucuuuggcgccaucgccggguucauugagggaggcuggaccgggauggucgacggaugguacggcuaucaucaccagaaugaacaaggcucuggguacgcugcggaucugaaaagcacacagaacgccaucgacgagaucaccaauaaggugaacuccguuauugagaaaaugaauacgcaguuuacagcugugggaaaggaguucaaccaccuugagaagagaaucgaaaaucugaacaaaaaggucgaugacggcuuccucgauauuuggaccuacaaugccgagcugcuggugcuccuggaaaacgagcggacccuugacuaucaugauagcaaugucaaaaaccuguacgagaaggugcgcucucagcucaaaaacaaugccaaggaaaucgggaacggauguuuugaguucuaucacaagugcgacaauacauguauggaauccguuaaaaacggcaccuacgauuauccuaaguacagcgaggaagcuaaacugaauagagaggagauugacggggugaaacuugaaucuacacggaucuaucaaauccuggccauuuacuccacggucgcgagcucccucgugcugguugugucucugggcgcuaucagcuuuuggaugugcuccaacggaucucuccagugccgcauuuguaucuga

SEQ ID NO: 189113 - RNA, 1701 nt, Artificial Sequence; identical to SEQ ID NO: 187329
  derived and/or modified sequence opt5 from hemagglutinin__InfluenzaA__ADO12413

SEQ ID NO: 189114 - RNA, 1701 nt, Artificial Sequence; identical to SEQ ID NO: 185693
  derived and/or modified sequence opt5 from hemagglutinin__InfluenzaA__ADO12423

SEQ ID NO: 189115 - RNA, 1701 nt, Artificial Sequence; identical to SEQ ID NO: 185693
  derived and/or modified sequence opt5 from hemagglutinin__InfluenzaA__ADO12433

SEQ ID NO: 189116 - RNA, 1701 nt, Artificial Sequence; identical to SEQ ID NO: 185693
  derived and/or modified sequence opt5 from hemagglutinin__InfluenzaA__ADO12443

SEQ ID NO: 189117 - RNA, 1701 nt, Artificial Sequence; identical to SEQ ID NO: 185693
  derived and/or modified sequence opt5 from hemagglutinin__InfluenzaA__ADO12453

SEQ ID NO: 189118 - RNA, 1701 nt, Artificial Sequence; identical to SEQ ID NO: 185693
  derived and/or modified sequence opt5 from hemagglutinin__InfluenzaA__ADO12463

SEQ ID NO: 189119 - RNA, 1701 nt, Artificial Sequence
  derived and/or modified sequence opt5 from hemagglutinin__InfluenzaA__ADO12473
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcagaaugggaaacuuuguaagcugagaggaguugcuccccuccaccugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcaacuuuccagcgucucuuccuucgaacgcuuugagaucuuccccaagaccagcucuuggccuaaucaugauuccaacaagggagugacagccgcuuguccccacgccggcgcgaaaucuuuuuauaagaaucugaucuggcucguuaaaaagggcaacagcuacccuaaacuguccaagagcuauauuaaugacaaggggaaagaagugcuuguccuguggggaauccaucaccccuccaccucugccgaucagcagagccucuaccagaacgcugacgccuacguguucgugggcacauccagauauagcaagaaauuuaagccugagauugcuauccggccgaaaguccgcgaucaagaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccacgacugcaauacaaccugucagaccccuaaaggcgccaucaacacaagccuccccuuccagaauauucauccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaccaucaaaaugaacagggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucacgauagcaaugugaaaaaccuguacgagaagguccgcucucaacucaaaaacaaugccaaggaaauugggaacggauguuuugaguucuaucauaagugcgacaauacauguauggaauccgugaaaaacggcaccuacgauuauccuaaguacagcgaggaagcuaaacugaauagagaggagaucgacgggguuaaacuugaaucuacacggaucuaucagauucuggccaucuacuccacgguggcgagcucccucguccuggugguuucucugggcgcuauuagcuuuuggaugugcuccaacggaucucuccagugccgcaucuguauuuga

SEQ ID NO: 189120 - RNA, 1701 nt, Artificial Sequence; identical to SEQ ID NO: 185693
  derived and/or modified sequence opt5 from hemagglutinin__InfluenzaA__ADO12493

SEQ ID NO: 189121 - RNA, 1701 nt, Artificial Sequence
  derived and/or modified sequence opt5 from hemagglutinin__InfluenzaA__ADO12503
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggaucuaucaaauucuggccaucuacuccacgguggcgagcucccucguccuggugguuucucugggcgcuauuaacuuuuggaugugcagcaauggaucccuccagugccgcaucuguauuuga

SEQ ID NO: 189122 - RNA, 1701 nt, Artificial Sequence
  derived and/or modified sequence opt5 from hemagglutinin__InfluenzaA__ADO12513
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagagagguugcuccccuccaucugggaaaaugcaacaucgccggcuggauucuggggaauccugaaugugagucucucagcacagccuccucuuggagcuacaucguggaaaccuccucuagcgacaacggaacgugcuauccgggcgauuuuauugacuacgaggagcugcgggaacagcuuuccagcgucucuuccuucgagcgcuuugaaaucuuccccaagaccagcucuuggccuaaucacgauuccaacaagggggugacagccgcuuguccccaugccggagcgaaaucuuuuuauaagaaucugaucuggcucguuaaaaagggcaacagcuacccuaaacuguccaagagcuauauuaaugacaagggcaaagaggugcuuguccugugggggauccaccaccccuccaccucugccgaucaacagagccucuaccagaacgcugacgccuacguguucgugggaacauccagauauagcaagaaauuuaagccugagauugcuauccggccgaaaguccgcgaucaggaaggcagaaugaauuacuauuggacccugguugagcccggggacaagauuacguucgaagccacaggaaaccugguggugccucgguacgcguuugccauggagcgcaacgcuggcucugggaucauuaucuccgauacccccguccaugacugcaauacaaccugucaaaccccuaaaggagccaucaacacaagccuccccuuccagaauauucacccgaucacgauuggcaagugcccuaaguaugugaaaucuaccaagcugagacuugcuacaggccugcggaacguucccagcauccagucccgcgggcucuuuggagccauugccggcuucaucgaagggggauggaccggcaugguggacgggugguacggauaucaucaccagaaugagcaaggcucuggcuacgcugcggaucugaaaagcacacagaacgccaucgacgagauuaccaauaaggucaacuccgugaucgaaaagaugaauacgcaguuuacagcuguugggaaggaguucaaccaccuugaaaagagaauugagaaucugaacaaaaagguggaugacggauuccucgauaucuggaccuacaaugccgaacugcugguccuccuggagaacgagcggacccuugacuaucaugauagcaaugugaaaaaccuguacgaaaagguccgcucucagcucaaaaacaaugccaaggagauuggcaacggguguuuugaguucuaucacaagugcgacaauacauguauggaauccgugaaaaacggaaccuacgauuauccuaaguacagcgaagaggcuaaacugaauagagaggaaaucgacggcguuaaacuugagucuacacggaucuaucaaauucuggccaucuacuccacgguggcgagcucccucguccuggugguuucucugggggcuauuagcuuuuggaugugcuccaacggcucucuccagugccgcaucuguauuuga

SEQ ID NO: 189123 - RNA, 1701 nt, Artificial Sequence; identical to SEQ ID NO: 185693
  derived and/or modified sequence opt5 from hemagglutinin__InfluenzaA__ADO12523

SEQ ID NO: 189124 - RNA, 1701 nt, Artificial Sequence
  derived and/or modified sequence opt5 from hemagglutinin__InfluenzaA__ADO12533
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccagacugcggcuugcuacagggcugcgcaacguucccagcauccaguccagaggacucuuuggcgccauugccggguucaucgagggaggcuggaccgggaugguggacggaugguacggcuaucaucaccagaaugaacaaggcucuggguacgcugcggaucuuaagagcacacagaacgccaucgacgagauuaccaauaaagucaacuccgugaucgagaagaugaauacgcaguuuacagcuguuggaaaagaguucaaccaccuggagaagcggauugaaaaucugaacaagaaaguggaugacggcuuccucgauaucuggaccuacaaugccgagcugcugguccuccuggaaaacgagcgcacccuugacuaucaugauagcaaugugaagaaccuguacgagaaagucagaucucagcucaagaacaaugccaaagaaauugggaacggauguuuugaguucuaucacaagugcgacaauacauguauggaauccgugaagaacggcaccuacgauuauccuaaauacagcgaggaagcuaagcugaaucgggaggagaucgacgggguuaaacuugaaucuacacgcaucuaucaaauucuggccaucuacuccacgguggcgagcucccucguccuggugguuucucugggcgcuauuagcuuuuggaugugcuccaacggaucucuccagugcagaaucuguauuuga

SEQ ID NO: 189125 - RNA, 1701 nt, Artificial Sequence; identical to SEQ ID NO: 185693
  derived and/or modified sequence opt5 from hemagglutinin__InfluenzaA__ADO12543

SEQ ID NO: 189126 - RNA, 1701 nt, Artificial Sequence; identical to SEQ ID NO: 185693
  derived and/or modified sequence opt5 from hemagglutinin__InfluenzaA__ADO12553

SEQ ID NO: 189127 - RNA, 1701 nt, Artificial Sequence; identical to SEQ ID NO: 185693
  derived and/or modified sequence opt5 from hemagglutinin__InfluenzaA__ADO12563

SEQ ID NO: 189128 - RNA, 1701 nt, Artificial Sequence; identical to SEQ ID NO: 185693
  derived and/or modified sequence opt5 from hemagglutinin__InfluenzaA__ADO12573

SEQ ID NO: 189129 - RNA, 1701 nt, Artificial Sequence
  derived and/or modified sequence opt5 from hemagglutinin__InfluenzaA__ADO12593
augaaggccauccuggugguccuccuguacaccuucgcuacagccaacgcggacacgcuuugcauuggcuaucacgcuaauaacagcaccgauaucguugacacagugcuggagaagaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacauccucuagcgacaacggaaccugcuauccgggggauuuuaucgacuacgaagaacugcgggagcagcuuuccagcgucucuuccuucgaacgcuuugagaucuuccccaagacgagcucuuggccuaaucacgauuccaacaagggagugaccgccgcuuguccccaugccggcgcgaaaucuuuuuauaagaaucugauuuggcucguuaaaaagggcaacagcuacccuaaacuguccaagagcuauaucaaugacaaggggaaagaagugcuuguccuguggggcauucaccaccccuccacaucugccgaucaacagagccucuaccagaacgcugacgccuacguguucgugggcaccuccagauauagcaagaaauuuaagccugagaucgcuauucggccgaaaguccgcgaucaggaggggagaaugaauuacuauuggacacugguugaacccggagacaagaucaccuucgaggccacgggcaaccugguggugccucgguacgcguuugccauggaacgcaacgcugggucuggaauuaucaucuccgauacacccguccaugacugcaauaccacaugucaaaccccuaaaggcgccauuaacaccagccuccccuuccagaauauccacccgauuacaaucggcaagugcccuaaguaugugaaaucuacgaagcugagacuugcuaccgggcugcggaacguucccagcauucagucccgcggacucuuuggcgccaucgccggguucaucgagggaggcuggacagggaugguggacggaugguacggcuaucaucaccagaaugaacaaggcucuggguacgcugcggaucugaaaagcacccagaacgccauugacgagaucacaaauaaggucaacuccgugauugagaaaaugaauacccaguuuacggcuguuggaaaggaguucaaccaccuugagaagagaaucgaaaaucugaacaaaaagguggaugacggcuuccucgauauuuggacauacaaugccgagcugcugguccuccuggaaaacgagcggacccuugacuaucaugauagcaaugugaaaaaccuguacgagaagguccgcucucagcucaaaaacaaugccaaggaaaucgggaacggauguuuugaguucuaucacaagugcgacaauaccuguauggaauccgugaaaaacggcacauacgauuauccuaaguacagcgaggaagcuaaacugaauagagaggagaucgacgggguuaaacuugaaucuacccggauuuaucaaauccuggccauuuacuccacaguggcgagcucccucguccuggugguuucucugggcgcuaucagcuuuuggaugugcuccaacggaucucuccagugccgcauuuguaucuga

SEQ ID NO: 189130 - RNA, 1701 nt, Artificial Sequence; identical to SEQ ID NO: 185693
  derived and/or modified sequence opt5 from hemagglutinin__InfluenzaA__ADO12603

SEQ ID NO: 189131 - RNA, 1701 nt, Artificial Sequence; identical to SEQ ID NO: 185693
  derived and/or modified sequence opt5 from hemagglutinin__InfluenzaA__ADO12613

SEQ ID NO: 189132 - RNA, 1701 nt, Artificial Sequence; identical to SEQ ID NO: 185693
  derived and/or modified sequence opt5 from hemagglutinin__InfluenzaA__ADO12623

SEQ ID NO: 189133 - RNA, 1701 nt, Artificial Sequence
  derived and/or modified sequence opt5 from hemagglutinin__InfluenzaA__ADO14349
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaagggaaacuuuguaagcugagaggaguugcuccccuccaucugggcaagugcaauaucgccggguggauucugggaaacccugagugugaaucucucagcacagccuccucuuggagcuacaucguggagaccuccucuagcgacaagggcacgugcuauccgggggauuuuauugacuacgaagaacugcgggagcagcuuuccagcgucucuuccuucgaacgcuuugagaucuuccccaaaaccagcucuuggccuaaucacgauuccaacaagggagugacagccgcuuguccccaugccggcgcgaaaucuuuuuauaagaaucugaucuggcucguuaaaaagggcaacagcuacccuaagcuguccaaaagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaaugcugggucuggaaucauuaucuccgauacccccguccaugacugcaacacaaccugucaaaccccuaagggcgccaucaacacaagccuccccuuccagaauauucacccgaucacgauuggcaaaugcccuaaguaugugaaaucuaccaagcugagacuugcuacagggcugcggaacauccccagcauucagucccgcggacucuuuggcgccaucgccggguucaucgagggaggcuggaccgggaugguugacggaugguacggcuaucaucaccagaaugaacaaggcucuggguacgcugcggaucugaaaagcacacagaacgccauugacgagaucaccaauaaggugaacuccgucauugagaagaugaauacgcaguuuacagcugugggaaaagaguucaaccaccuugagaagagaaucgaaaaucugaacaaaaagguugaugacggcuuccucgauauuuggaccuacaaugccgagcugcuggugcuccuggaaaacgagcggacccuugacuaucaugauagcaaugucaaaaaccuguacgagaaggugcgcucucagcucaagaauaacgccaaagaaaucgggaacggauguuuugaguucuaucacaagugcgacaauacauguauggaauccgucaaaaacggcaccuacgauuauccuaaguacagcgaggaagcuaaacugaauagagaggagaucgacggggugaaacuugaaucuacacggauuuaucaaauccuggccauuuacuccacgguugcgagcucccucgugcuggucgugucucugggcgcuaucagcuuuuggaugugcuccaacggaucucuccagugccgcauuuguaucuga

SEQ ID NO: 189134 - RNA, 1701 nt, Artificial Sequence; identical to SEQ ID NO: 187957
  derived and/or modified sequence opt5 from hemagglutinin__InfluenzaA__ADO14351

SEQ ID NO: 189135 - RNA, 1701 nt, Artificial Sequence
  derived and/or modified sequence opt5 from hemagglutinin__InfluenzaA__ADO14353
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccgaagcgaaaucuuuuuauaagaaucugaucuggcucguuaaaaagggcaacagcuacccuaaacuguccaagagcuauauuaaugacaagggcaaagaggugcuuguccugugggggauccaccaccccuccaccucugccgaucaacagagccucuaccagaacgcugacgccuacguguucgugggaacauccagauauagcaagaaauuuaagccugagauugcuauccggccgaaaguccgcgaucaggaaggcagaaugaauuacuauuggacccugguugagcccggggacaagauuacguucgaagccacaggaaaccugguggugccucgguacgcguuugccauggagcgcaacgcuggcucugggaucauuaucuccgauacccccguccaugacugcaauacaaccugucaaaccccuaaaggagccaucaacacaagccuccccuuccagaauauucacccgaucacgauuggcaagugcccuaaguaugugaaaucuaccaagcugagacuugcuacaggccugcggaacauccccagcauucagucccgcgggcucuuuggagccaucgccggcuucaucgaagggggauggaccggcaugguugacgggugguacggauaucaucaccagaaugagcaaggcucuggcuacgcugcggaucugaaaagcacacagaacgccauugacgagaucaccaauaaggugaacuccgucauugaaaagaugaauacgcaguuuacagcuguggggaaggaguucaaccaccuugaaaagagaaucgagaaucugaacaaaaagguugaugacggauuccucgauauuuggaccuacaaugccgaacugcuggugcuccuggagaacgagcggacccuugacuaucaugauagcaaugucaaaaaccuguacgaaaaggugcgcucucagcucaaaaacaaugccaaggagaucggcaacggguguuuugaguucuaucacaagugcgacaauacauguauggaguccgucaaaaacggaaccuacgauuauccuaaguacagcgaagaggcuaaacugaauagagaggaaaucgacggcgugaaacuugagucuacacggauuuaucaaauccuggccauuuacuccacgguugcgagcucccucgugcuggucgugucucugggggcuaucagcuuuuggaugugcuccaacggcucucuccagugccgcauuuguaucuga

SEQ ID NO: 189136 - RNA, 1701 nt, Artificial Sequence
  derived and/or modified sequence opt5 from hemagglutinin__InfluenzaA__ADO14354
augaaggccauccuggugguccuccuguacaccuucgcuacagccaacgcggacacgcuuugcaugggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacauugccggguggauccugggaaauccugagugugaaucucucagcacagccuccucuuggagcuacauuguggagaccuccucuagcgacaacggcacgugcuauccgggggauuuuaucgacuacgaagaacugcgggagcagcuuuccagcgucucuuccuucgaacgcuuugagauuuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauaucaaugacaaggggaaagaagugcuuguccuguggggcauucaccaccccuccaccucugccgaucaacagagccucuaccagaacgcugacgccuacguguucgugggaacauccagauauagcaagaaauuuaagccugagaucgcuauucggccgaaaguccgcgagcaggaagggagaaugaauuacuauuggacccugguugagcccggagauaagaucacguucgaagccacaggcaaccugguggugccucgguacgcguuugccauggagcgcaacgcugggucuggaauuaucauuuccgacacccccguccaugauugcaauacaaccugucaaaccccuaaaggcgccaucaacacaagccuccccuuccagaauauccacccgauuacgaucggcaagugcccuaaguaugugaaaucuaccaagcugagacuugcuacagggcugcggaacguucccagcauucagucccgcggacucuuuggcgccaucgccggguucauugaaggaggcuggaccgggaugguggacggaugguacggcuaucaucaccagaaugagcaaggcucuggguacgcugcggaccugaaaagcacacagaacgccaucgaugagaucaccaauaaggucaacuccgugauugaaaagaugaauacgcaguuuacagcuguuggaaaggaguucaaccaccuugaaaagagaaucgagaaucugaacaaaaagguggacgauggcuuccucgacauuuggaccuacaaugccgaacugcugguccuccuggagaacgagcggacccuugauuaucaugacagcaaugugaaaaaccuguacgaaaagguccgcucucagcucaaaaacaaugccaaggagaucgggaacggauguuuugaguucuaucacaagugcgauaauacauguauggaguccgugaaaaacggcaccuacgacuauccuaaguacagcgaagaggcuaaacugaauagagaggaaauugaugggguuaaacuugagucuacacggaucuaucaaauccuggccauuuacuccacgguggcgagcucccucguccuggugguuucucugggcgcuaucagcuuuuggaugugcuccaacggaucucuccagugccgcauuuguaucuga

SEQ ID NO: 189137 - RNA, 1701 nt, Artificial Sequence
  derived and/or modified sequence opt5 from hemagglutinin__InfluenzaA__ADO14356
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgggcaggagggaagaaugaauuacuauuggacccugguugaacccggcgauaagauuacguucgaggccacagggaaccugguggugccucgguacgcguuugccauggaacgcaacgcuggaucuggcaucauuaucuccgacacccccguccaugauugcaauacaaccugucaaaccccuaaaggcgccaucaacacaagccuccccuuccagaauauucacccgaucacgauugggaagugcccuaaguaugugaaaucuaccaagcugagacuugcuacaggacugcggaacauccccagcauucagucccgcggccucuuuggggccaucgccggauucaucgagggcggguggaccggaaugguugacggcugguacggcuaucaucaccagaaugaacaagggucuggauacgcugcggaccugaaaagcacacagaacgccauugaugagaucaccaauaaggugaacuccgucauugagaaaaugaauacgcaguuuacagcugugggcaaggaguucaaccaccuugagaagagaaucgaaaaucugaacaaaaagguugacgauggguuccucgacauuuggaccuacaaugccgagcugcuggugcuccuggaaaacgagcggacccuugauuaucaugacagcaaugucaaaaaccuguacgagaaggugcgcucucagcucaaaaacaaugccaaggaaaucggaaacggcuguuuugaguucuaucacaagugcgauaauacauguauggaauccgucaaaaacgggaccuacgacuauccugaguacagcgaagaggcuaagcugaauagagaggaaaucgauggcgugaaacuugagucuacacggauuuaucaaauccuggccauuuacuccacgguugcgagcucccucgugcuggucgugucucugggagcuaucagcuuuuggaugugcuccaacggcucucuccagugccgcauuuguaucuga

SEQ ID NO: 189138 - RNA, 1701 nt, Artificial Sequence; identical to SEQ ID NO: 187957
  derived and/or modified sequence opt5 from hemagglutinin__InfluenzaA__ADO14357

SEQ ID NO: 189139 - RNA, 1701 nt, Artificial Sequence
  derived and/or modified sequence opt5 from hemagglutinin__InfluenzaA__ADO14359
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaucccccuaccuccgccgaucaacagucucucuaccagaacgcugacgccuacguguucgugggcacaagcagauauuccaagaaauuuaagccggagauugcuauccggcccaaaguccgcgaucaggaggggagaaugaauuacuauuggacccugguugaaccuggagacaagauuacguucgaggccacaggcaaccugguggugccccgguacgcguuugccauggaacgcaacgcugggagcggaaucauuaucucugauaccccuguccacgacugcaauacaaccugucaaacccccaaaggcgccaucaacacaucccucccguuccagaauauucacccuaucacgauuggcaagugccccaaguaugugaaaagcaccaagcugagacuugcuacagggcugcggaacguuccuucuauccagagccgcggacucuuuggcgccauugccggguucaucgagggaggcuggaccgggaugguggacggaugguacggcuaucaucaccagaaugaacaaggcuccggguacgcugcggaucugaaaucuacacagaacgccaucgacaagauuaccaauaaagucaacagcgugaucgagaagaugaauacgcaguuuacagcuguuggaaaggaguucaaccaccuugagaaaagaauugagaaucugaacaagaaaguggaugacggcuuccucgauaucuggaccuacaaugccgaacugcugguccuccuggagaacgaacggacccuugacuaucaugauuccaaugugaagaaccuguacgagaaaguccgcagccagcucaagaacaaugccaaggagauugggaacggauguuuugaguucuaucacaaaugcgacaauacauguauggaaucugugaagaacggcaccuacgauuaucccaaauacuccgaagaggcuaagcugaauagagaagagaucgacgggguuaaacuugagagcacacggaucuaucaaauucuggccaucuacucuacgguggcguccagccucguccuggugguuucccugggcgcuauuucuuuuuggaugugcagcaacggaucccuccagugccgcaucuguauuuga

SEQ ID NO: 189140 - RNA, 1701 nt, Artificial Sequence
  derived and/or modified sequence opt5 from hemagglutinin__InfluenzaA__ADO14361
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaaaugcaacaucgccggguggauucugggaaauccugagugugaaucucucagcacagcuuccucuuggagcuacaucguggagaccuccucuagcgacaagggcacgugcuauccgggggauuuuauugacuacgaagaacugcgggagcagcuuuccagcgucucuuccuucgaacgcuuugagaucuuccccaagaccagcucuuggccuaaccacgauuccaauaaaggagugacagccgcuuguccccaugccggcgccaagagcuuuuauaaaaaccugaucuggcucguuaagaaaggcaauucuuacccuaagcuguccaagagcuauauuaacgacaaagggaaggaagugcuuguccuguggggaauccaccaccccuccaccucugccgaucaacagagccucuaccagaaugcugacgccuacguguucgugggcacauccagauauagcaaaaaguuuaaaccugagauugcuauccggccgaagguccgcgaucaggaggggagaaugaacuacuauuggacccugguugaacccggagacaaaauuacguucgaggccacaggcaaucugguggugccucgguacgcguuugccauggaacgcaacgcugggucuggaaucauuaucuccgauacccccguccaugacugcaacacaaccugucaaaccccuaagggcgccaucaauacaagccuccccuuccagaacauucacccgaucacgauuggcaagugcccuaaauaugugaagucuaccaaacugagacuugcuacagggcugcggaauauccccagcauucagucccgcggacucuuuggcgccaucgccggguucaucgagggaggcuggaccgggaugguugacggaugguacggcuaucaucaccagaacgaacaaggcucuggguacgcugcggaucugaaguccacacagaaugccauugacgagaucaccaacaaagugaauagcgucauugagaagaugaacacgcaguuuacagcugugggaaaggaguucaaucaccuugagaaaagaaucgaaaaccugaauaagaaaguugaugacggcuuccucgauauuuggaccuacaacgccgagcugcuggugcuccuggaaaaugagcggacccuugacuaucaugauagcaacgucaagaaucuguacgagaaagugcgcucucagcucaagaacaacgccaaggaaaucgggaauggauguuuugaguucuaucacaaaugcgacaacacauguauggaauccgucaagaauggcaccuacgauuauccuaaauacagcgaggaagcuaagcugaacagagaggagaucgacggggugaaacuugaaucuacacggauuuaucaaauccuggccauuuacuccacgguugcgagcucccucgugcuggucgugucucugggcgcuaucagcuuuuggaugugcuccaauggaucucuccagugccgcauuuguaucuga

SEQ ID NO: 189141 - RNA, 1701 nt, Artificial Sequence
  derived and/or modified sequence opt5 from hemagglutinin__InfluenzaA__ADO14362
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaacucugccgaucaacagagccucuaccagaaugcugacgccuacguguucgugggcaccuccagauauagcaagaaauuuaagccugagauugcuauccggccgaaaguccgcgaucaggaggggagaaugaacuacuauuggacacugguugaacccggagacaagauuaccuucgaggccacgggcaaccugguggugccucgguacgcguuugccauggaacgcaaugcugggucuggaaucauuaucuccgauacacccguccaugacugcaacaccacaugucaaaccccuaaaggcgccaucaauaccagccuccccuuccagaacauucacccgaucacaauuggcaagugcccuaaguaugugaaaucuacgaagcugagacuugcuaccgggcugcggaauguucccagcauccagucccgcggacucuuuggcgccauugccggguucaucgagggaggcuggacagggaugguggacggaugguacggcuaucaucaccagaacgaacaaggcucuggguacgcugcggaucugaaaagcacccagaaugccaucgacgagauuacaaacaaggucaauuccgugaucgagaaaaugaacacccaguuuacggcuguuggaaaggaguucaaucaccuugagaagagaauugaaaaccugaauaaaaagguggaugacggcuuccucgauaucuggacauacaacgccgagcugcugguccuccuggaaaaugagcggacccuugacuaucaugauagcaacgugaaaaaccuguacgagaagguccgcucucagcucaaaaauaacgccaaggaaauugggaauggauguuuugaguucuaucacaagugcgacaacaccuguauggaauccgugaaaaauggcacauacgauuauccuaaguacagcgaggaagcuaaacugaacagagaggagaucgacgggguuaaacuugaaucuacccggaucuaucaaauucuggccaucuacuccacaguggcgagcucccucguccuggugguuucucugggcgcuauuagcuuuuggaugugcuccaauggaucucuccagugccgcaucuguauuuga

SEQ ID NO: 189142 - RNA, 1683 nt, Artificial Sequence
  derived and/or modified sequence opt5 from hemagglutinin__InfluenzaA__ADO21015
auggagguggucagccugaucaccauucuccugcuuguuacaguguccaacgccgacaagaucugcauuggcuaccagucuacgaauagcaccgaaacaguggauacccugacagagaacaauguccccguggcucacgccaaagaacuccugcauaccgagcacaacgggaugcuuugugcgacaaaucugggacauccucucauccuggauaccugcacgauugaaggccugaucuaugggaacccguccugugaccuccugcuuggaggcagagaguggucuuacaucguugagcggcccagcgcugugaaugggcugugcuauccuggaaacgucgaaaaucucgaggaacugcgcucccuuuucucuagcgccuccagcuaccaacggauucagaucuuucccggcaccauuuggaacgugucuuauggcgggacauccaaggccuguagcgacucuuucuacaaauccaugagauggcugacccagaagaauaacgcuuauccuauccaggaugcccaauacacaaauaaccgcgggaaaaauauucucuuuauguggggcaucaaccaucccccuaccgacacgacacagaccaaccuguacacaagaaccgauaccacaacgagcguugcuaccgaggacauuaaucggacauucaagccgcugaucgggccccgcccucucgugaacggacagcagggcagaaucgauuauuacuggucuguccugaagcccgggcaaacccuucgggugcgcuccaauggaaaccugauugccccuugguauggccacauccucagcggcgagucccacgggcggauucugaaaacagaccuuaauucuggaaacugcgugguccagugucagaccgaaagaggcgggcugaauacgacacuccccuuucacaacguuagcaaguacgcguucggaaauugcccgaaauaugugggcgugaagucccugaaacuggccgucgggcuccgcaacgugccugcuagaagcucucggggacuguuuggcgccaucgcuggcuucauugagggaggaugguccggccuuguugccgggugguacggauuucagcauagcaaugaucaaggcguggggauggcggccgaccgcgauucuacccagaaggcuaucgacaagaucaccagcaaagucaacaauauuguggacaagaugaacaaacaguaugaaaucauugaucacgaguucuccgaaguugagacaagacugaauaugaucaacaacaagauugacgaucaaauccaggacaucugggccuacaaugcugagcuccuggugcuucuggaaaaccagaaaacccucgaugagcaugacgccaaugucaacaaucuguacaacaaggugaaacgggcccugggcucuaaugcugucgaagauggaaagggcuguuuugagcucuaucacaagugcgacgaucaguguauggaaacaauuagaaacgggacguacaaucgccggaaauauaaggaggagagcagacuggaacgccaaaagaucgagggagugaaacuugaauccgagggcaccuacaaaauucugacaaucuauagcaccguugcgucuucccucgugauugccaugggguucgcugccuuucuguucugggccaugagcaacggaucuugccggugcaauaucuguauuuga

SEQ ID NO: 189143 - RNA, 1683 nt, Artificial Sequence
  derived and/or modified sequence opt5 from hemagglutinin__InfluenzaA__ADO21026
auggagguggucagccugaucaccauucuccugcuuguuacaguguccaacgccgacaagaucugcauuggcuaccagucuacgaauagcaccgaaacaguggauacccugacagagaacaauguccccguggcucacgccaaagaacuccugcauaccgagcacaacgggaugcuuugugcgacaaaucugggacauccucucauccuggauaccugcacgauugaaggccugaucuaugggaacccguccugugaccuccugcuuggaggcagagaguggucuuacaucguugagcggcccagcgcugugaaugggcugugcuauccuggaaacgucgaaaaucucgaggaacugcgcucccuuuucucuagcgccuccagcuaccaacggauucagaucuuucccggcaccauuuggaacgugucuuauggcgggacauccaaggccuguagcgacucuuucuacaaauccaugagauggcugacccagaagaauaacgcuuauccuauccaggaugcccaauacacaaauaaccgcgggaaaaauauucucuuuauguggggcaucaaccaucccccuaccgacacgacacagaccaaccuguacacaagaaccgauaccacaacgagcguugcuaccgaggacauuaaucggacauucaacccgcugaucgggccccgcccucucgugaauggacagcagggcagaaucgauuauuacuggucuguccugaagcccgggcaaacccuucgggugcgcuccaacggaaaucugauugccccuugguauggccacauccucagcggcgagucccacgggcggauucugaagacagaccuuaacucuggaaauugcgugguccagugucagaccgaaagaggcgggcugaacacgacacuccccuuucacaauguuagcaaauacgcguucggaaacugcccgaaguaugugggcgugaaaucccugaagcuggccgucgggcuccgcaaugugccugcuagaagcucucggggacuguuuggcgccaucgcuggcuucauugagggaggaugguccggccuuguugccgggugguacggauuucagcauagcaacgaucaaggcguggggauggcggccgaccgcgauucuacccagaaagcuaucgacaagaucaccagcaaggucaauaacauuguggacaaaaugaauaagcaguaugaaaucauugaucacgaguucuccgaaguugagacaagacugaacaucauuaacaauaaaaucgacgaucaaauccaggacauuugggccuacaacgcugagcuccuggugcuucuggaaaaucagaagacccucgaugagcaugacgccaacgucaauaaccuguacaauaaagugaagcgggcccugggcucuaacgcugucgaagauggaaaaggcuguuuugagcucuaucacaagugcgacgaucaguguauggaaacaaucagaaaugggacguacaaccgccggaaguauaaagaggagagcagacuggaacgccaaaagauugagggagugaaacuugaauccgagggcaccuacaagauccugacaauuuauagcaccguugcgucuucccucgugaucgccaugggguucgcugccuuucuguucugggccaugagcaauggaucuugccggugcaacauuuguaucuga

SEQ ID NO: 189144 - RNA, 1683 nt, Artificial Sequence
  derived and/or modified sequence opt5 from hemagglutinin__InfluenzaA__ADO21037
auggagguggucagccugaucaccauucuccugcuuguuacaguguccaacgccgacaagaucugcauuggcuaccagucuacgaauagcaccgaaacaguggauacccugacagagaacaauguccccguggcucacgccaaagaacuccugcauaccgagcacaacgggaugcuuugugcgacaaaucugggacauccucucauccuggauaccugcacgauugaaggccugaucuaugggaacccguccugugaccuccugcuuggaggcagagaguggucuuacaucguugagcggcccagcgcugugaaugggcugugcuauccuggaaacgucgaaaaucucgaggaacugcgcucccuuuucucuagcgccuccagcuaccaacggauucagaucuuucccggcaccauuuggaacgugucuuauggcgggacauccaaggccuguagcgacucuuucuacaaauccaugagauggcugacccagaagaauaacgcuuauccuauccaggaugcccaauacacaaauaaccgcgggaaaaauauucucuuuauguggggcaucaaccaucccccuaccgacacgacacagaccaaccuguacacaagaaccgauaccacaacgagcguugcuaccgaggacauuaaucggacauucaagccguauaucgggccccgcccucuggugaacggacagcagggcagaaucgauuacuauuggucuguccucaagcccgggcaaacccugcgggugcgcuccaauggaaaccuuauugccccuugguacggccacauccugagcggcgagucccacgggcggauucucaaaacagaccuuaauucuggaaacugcgugguccagugucagaccgaaagaggcgggcugaauacgacacugcccuuucacaacguuagcaaguaugcguucggaaauugcccgaaauacgugggcgugaagucccucaaacuggccgucgggcugcgcaacgugccugcuagaagcucucggggacucuuuggcgccaucgcuggcuucauugagggaggaugguccggccugguugccgggugguauggauuucagcauagcaaugaucaaggcguggggauggcggccgaccgcgaucuuacccagaaggcuaucgacaagaucaccucuaaagucaacaauauuguggacaagaugaacaaacaguacgaaaucauugaucacgaguucagcgaaguugagacaagacugaauaugaucaacaacaagauugacgaucaaauccaggacaucugggccuacaaugcugagcuccuggugcuucuggaaaaccagaaaacccucgaugagcaugacgccaaugucaacaaucuguauaacaaggugaaacgggcccugggcuccaaugcugucgaagauggaaagggcuguuuugagcucuaccacaagugcgacgaucaguguauggaaacaauuagaaacgggacguauaaucgccggaaauacaaggaggagucuagacuggaacgccaaaagaucgagggagugaaacuugaaagcgagggcaccuauaaaauucugacaaucuacuccaccguugcgagcucucucgugauugccaugggguucgcugccuuucuguucugggccauguccaacggaagcugccggugcaauaucuguauuuga

SEQ ID NO: 189145 - RNA, 1683 nt, Artificial Sequence
  derived and/or modified sequence opt5 from hemagglutinin__InfluenzaA__ADO21048
auggagguggucagccugaucaccauucuccugcuuguuacaguguccaacgccgacaagaucugcauuggcuaccaaucuacgaauagcaccgaaacaguggauacccugacagagaacaauguccccguggcucacgccaaagaacuccugcauaccgagcacaacgggaugcuuugugcgacaaaucugggacauccucucauccuggauaccugcacgauugaaggccugaucuaugggaacccguccugugaccuccugcuuggaggcagagaguggucuuacaucguugagcggcccagcgcugugaaugggcugugcuauccuggaaacgucgaaaaucucgaggaacugcgcucccuuuucucuagcgccuccagcuaccaacggauucagaucuuucccggcaccauuuggaacgugucuuauggcgggacauccaaggccuguagcgacucuuucuacaaauccaugagauggcugacccagaagaauaacgcuuauccuauccaggaugcccaauacacaaauaaccgcgggaaaaauauucacuuuauguggggcaucaaccaucccccuaccgacacgacacagaccaaccucuacacaagaaccgauaccacaacgagcguugcuaccgaggacauuaaucggacauucaagccgcugaucgggccccgcccucuggugaacggacagcagggcagaaucgauuauuacuggucuguccucaagcccgggcaaacccugcgggugcgcuccaauggaaaccuuauugccccuugguauggccacauccugagcggcgagucccacgggcggauucucaaaacagaccuuaauucuggaaacugcgugguccagugucagaccgaaagaggcgggcugaauacgacacugcccuuucauaacguuagcaaguacgcguucggaaauugcccgaaauaugugggcgugaagucccucaaacuggccgucgggcugcgcaacgugccugcuagaagcucucggggacucuuuggcgccaucgcuggcuucauugagggaggaugguccggccugguugccgggugguacggauuucagcacagcaaugaucaaggcguggggauggcggccgaccgcgucucuacccagaaggcuaucgauaagaucaccagcaaagugaacaauauuguugacaagaugaacaaacaguaugaaaucauugaccaugaguucuccgaaguggagacaagacuuaauaugaucaacaacaagauugaugaccaaauccaggauaucugggccuacaaugcugagcugcucguccugcuugaaaaccagaaaacccuggacgagcacgaugccaaugugaacaaucucuacaacaaggucaaacgggcccugggcucuaaugcuguggaagacggaaagggcuguuuugagcuguaucacaagugcgaugaccaguguauggaaacaauuagaaacgggacguacaaucgccggaaauauaaggaggagagcagacucgaacgccagaaaaucgagggaguuaagcuggaauccgagggcaccuacaaaauucuuacaaucuauagcaccguggcgucuucccuggucauugccaugggguucgcugccuuucucuucugggccaugagcaacggaucuugccggugcaauaucuguauuuga

SEQ ID NO: 189146 - RNA, 1701 nt, Artificial Sequence
  derived and/or modified sequence opt5 from hemagglutinin__InfluenzaA__ADO25092
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaauccuuuuauaagaaucugaucuggcucguuaaaaagggcaacucuuacccuaaacuguccaauagcuauauuaacgacaaggggaaggaagugcuuguccuguggggaauccaccaccccuccaccucugccgaucaacagagccucuaccagaaugcugacgccuacguguucgugggcacauccagauauagcaaaaaguuuaaaccugagauugcuauccggccgaagguccgcgaucaggaggggagaaugaacuacuauuggacccugguugaacccggagacaaaauuacguucgaggccacaggcaaccugguggugccucgguacgcguuugccauggaacgcaaugcugggucuggaaucauuaucuccgauacccccgcccaugacugcaacacaaccugucaaaccccuaagggcgcuaucaauacaagccuccccuuccagaacauucacccgaucacgauuggcaaaugcccuaaguaugucaagucuaccaaacugagacuugccacagggcugcggaaugugcccagcauccagucccgcggacucuuuggcgccauugcuggguucaucgagggaggcuggaccgggaugguugacggaugguacggcuaucaucaccagaacgaacaaggcucuggguacgcggccgaucuuaagagcacacagaaugcuaucgacgagauuaccaacaaagugaauagcgucaucgagaagaugaacacgcaguuuacagccgugggaaaagaguucaaucaccuggagaagagaauugaaaaccugaauaagaaaguugaugacggcuuccucgauaucuggaccuacaacgccgagcugcuggugcuccuggaaaaugagcggacccuugacuaucaugauagcaacgucaagaaccuguacgagaaagugcgcucucagcucaagaauaacgcuaaagaaauugggaauggauguuuugaguucuaucacaagugcgacaacacauguauggaauccgucaagaauggcaccuacgauuauccuaaauacagcgaggaagccaagcugaacagagaggagaucgacggggugaaacuugaaucuacacggaucuaucaaauucuggcgaucuacuccacgguugcuagcucccucgugcuggucgugucucugggcgccauuagcuuuuggaugugcuccaauggaucucuccagugccgcaucuguauuuga

SEQ ID NO: 189147 - RNA, 1701 nt, Artificial Sequence; identical to SEQ ID NO: 187565
  derived and/or modified sequence opt5 from hemagglutinin__InfluenzaA__ADO25112

SEQ ID NO: 189148 - RNA, 1701 nt, Artificial Sequence; identical to SEQ ID NO: 187565
  derived and/or modified sequence opt5 from hemagglutinin__InfluenzaA__ADO25122

SEQ ID NO: 189149 - RNA, 1701 nt, Artificial Sequence
  derived and/or modified sequence opt5 from hemagglutinin__InfluenzaA__ADO25132
augaacgccauccuggugguccuccuguacaccuucgcuacagccaaugcggacacgcuuugcauuggcuaucacgcuaacaauagcaccgauacaguugacacccugcucgagaagaacgugacagugacccauuccgucaaucugcuugaagauaaacacaacgggaagcuguguaaacucagaggaguggcgccccugcaucugggcaagugcaauaucgccggguggauucucggaaacccugagugugaaucucugagcacagcuuccucuuggagcuacaucguugagaccuccucuagcgacaauggcacgugcuauccgggggauuuuauugacuacgaggagcuucgggagcagcuguccagcgugucuuccuucgaacgcuuugagaucuuccccaaaaccagcucuuggccuaaccacgauuccaauaagggagucacagccgcuuguccccaugccggcgccaagagcuuuuauaaaaaccucaucuggcuggugaagaaaggcaauucuuacccuaaacuuuccaagagcuauauuaacgacaaggggaaggaaguucuggugcucuggggaauccaccaccccuccaccucugccgaucaacagagccuguaccagaaugcugacgccuacgucuucgugggcacauccagauauagcaaaaaguuuaaaccugagauugcuauccggccgaaggugcgcgaucaggaggggagaaugaacuacuauuggacccuggucgaacccggagacaaaauuacguucgaggccacaggcaaccucguugugccucgguacgcguuugccauggaacgcaaugcugggucugauaucauuaucuccgacacccccgugcaugacugcaacacaaccugucaaaccccuaagggagccaucaauacaagccugcccuuccagaacauucacccgaucacgauuggcaaaugcccuaaguaugucaagucuaccaaacuuagacuggcuacaggccuccggaaugugcccagcauccagucccgcgggcuguuuggagccauugccggcuucaucgaagggggauggaccggcaugguugaugggugguacggauaucaucaccagaacgaacaaggcucuggcuacgcugcggaccuuaagagcacacagaaugccaucgaugagauuaccaacaaaaucaauuccgugauugagaagaugaacacgcaguuuacagcugucgggaaagaguucaaucaccuggaaaagagaaucgaaaaccucaauaagaaaguggacgauggauuccuggacauuuggaccuacaacgccgagcugcucguucugcuugaaaaugagcggacccuggauuaucaugacagcaacgugaagaaccucuacgagaaaguccgcucucagcugaagaauaacgccaaagaaaucggcaauggguguuuugaguucuaucacaagugcgauaacacauguauggaauccgugaagaauggaaccuacgacuauccuaaauacagcgaggaagcuaaacuuaacagagaggagaucgauggcgucaagcuggaaucuacacggauuuaucaaauccucgccauuuacuccacgguggcgagcucccugguucugguggucucucucggggcuaucagcuuuuggaugugcuccaauggcucucugcagugccgcauuuguaucuga

SEQ ID NO: 189150 - RNA, 1701 nt, Artificial Sequence; identical to SEQ ID NO: 187306
  derived and/or modified sequence opt5 from hemagglutinin__InfluenzaA__ADO25142

SEQ ID NO: 189151 - RNA, 1701 nt, Artificial Sequence
  derived and/or modified sequence opt5 from hemagglutinin__InfluenzaA__ADO25152
augaaggccauccuggugguccuccuguacaccuucgcugccgcgaacgcugacacacuuugcauuggcuaucacgccaauaacagcacggauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacauccucuagcgacaacgggaccugcuauccgggcgauuuuauuaauuacgaagaacugcgggagcagcuuuccagcgucucucuguucgaacgcuuugagaucuuccccaagacguccagcuggccuaaccacgacucuaauaagggagugaccgcugccuguccccaugcgggcgccaaauccuuuuauaagaaccucaucuggcugguuaaaaagggcaauagcuacccuaaacuuucuaaguccuauauuaacgauaaggggaaagaagugcugguccucuggggaauccaccaccccagcacauccgcugaccaacagucucuguaccagaaugccgaugcuuacguguucgugggcaccagcagauauuccaagaaauuuaagccugagauugccauccggccgaaaguccgcgaccaggaggggagaaugaacuacuauuggacacugguugaacccggagauaagauuaccuucgaggcgacgggcaaccucguggugccucgguacgccuuugcuauggaacgcaaugccgggagcggaaucauuaucucugacacacccguccaugauugcaacaccacaugucaaaccccuaaaggcgcuaucaauaccucccugcccuuccagaacauucacccgaucacaauuggcaagugcccuaaguaugugaaaagcacgaaacuuagacuggccaccgggcuccggaauguucccucuauccagagccgcggacuguuuggcgccauugcuggguucaucgagggaggcuggacagggaugguggacggaugguacggcuaucaucaccagaacgaacaaggcuccggguacgcggccgaccuuaaaucuacccagaaugcuaucgauaagauuacaaacaaagucaauagcgugaucgagaagaugaacacccaguuuacggccguuggaaaggaguucaaucaccuggaaaagagaauugagaaccucaauaagaaaguggacgauggcuuccuggacaucuggacauacaacgccgaacugcucguccugcuugagaaugaacggacccuggauuaucaugacuccaacgugaagaaccucuacgagaaaguccgcagccagcugaagaauaacgcuaaggagauugggaauggauguuuugaguucuaucacaaaugcgauaacaccuguauggagucugugaagaauggcacauacgacuauccuaaauacuccgaagaggccaaacuuaacagagaagagaucgaugggguuaagcuggagagcacccggaucuaucaaauucucgcgaucuacucuacaguggcuuccagccugguccuggugguuucccucggcgccauuucuuuuuggaugugcagcaauggaucccugcagugccgcaucuguauuuga

SEQ ID NO: 189152 - RNA, 1701 nt, Artificial Sequence; identical to SEQ ID NO: 187245
  derived and/or modified sequence opt5 from hemagglutinin__InfluenzaA__ADO25162

SEQ ID NO: 189153 - RNA, 1701 nt, Artificial Sequence; identical to SEQ ID NO: 187245
  derived and/or modified sequence opt5 from hemagglutinin__InfluenzaA__ADO25172

SEQ ID NO: 189154 - RNA, 1701 nt, Artificial Sequence; identical to SEQ ID NO: 187245
  derived and/or modified sequence opt5 from hemagglutinin__InfluenzaA__ADO25182

SEQ ID NO: 189155 - RNA, 1701 nt, Artificial Sequence; identical to SEQ ID NO: 185693
  derived and/or modified sequence opt5 from hemagglutinin__InfluenzaA__ADO25192

SEQ ID NO: 189156 - RNA, 1701 nt, Artificial Sequence; identical to SEQ ID NO: 185693
  derived and/or modified sequence opt5 from hemagglutinin__InfluenzaA__ADO25202

SEQ ID NO: 189157 - RNA, 1701 nt, Artificial Sequence
  derived and/or modified sequence opt5 from hemagglutinin__InfluenzaA__ADO25212
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaagagaaaagaagugcuuguccugugggggauccaccaccccuccaccucugccgaucaacagagccucuaccagaacgcugacuccuacguguucgugggaacaagccgguauucuaagaaauuuaagccugagauugccauccgcccgaaagucagagaucaggagggccggaugaauuacuauuggacccugguugaacccggggacaagauuacguucgaggcuacaggaaaccugguggugccucgcuacgccuuugcgauggaaagaaacgccggcuccgggaucauuaucagcgauacccccguccaugacugcaauacaaccugucaaaccccugagggagcuaucaacacaucucuccccuuccagaauauucacccgaucacgauuggcaaaugcccuaaguauguuaagagcaccaaacugcggcuugccacaggccugcgcaacgugcccuccauccagucuagagggcucuuuggagcuauugccggcuucaucgaagggggauggaccggcaugguggacgggugguacggauaucaucaccagaaugagcaaggcagcggcuacgccgcugaucugaaguccacacagaacgcgaucgacgagauuaccaauaaagucaacagcgugaucgaaaagaugaauacgcaguuuacagccguugggaaagaguucaaccaccuugaaaagcggauugagaaucugaacaagaaaguggaugacggauuccucgauaucuggaccuacaaugcugaacugcugguccuccuggagaacgagcgcacccuugacuaucaugauucuaaugugaagaaccuguacgaaaaagucagaucccagcucaagaacaaugccaaagagauuggcaacggguguuuugaguucuaucacaagugcgacaauacauguauggagagcgugaagaacggaaccuacgauuauccuaaauacucugaagaggccaagcugaaucgggaggaaaucgacggcguuaaacuugaguccacacgcaucuaucaaauucuggcuaucuacagcacgguggccuccucucucguccuggugguuagccugggggcgauuuccuuuuggaugugcucuaacggcagccuccagugcagaaucuguauuuga

SEQ ID NO: 189158 - RNA, 1701 nt, Artificial Sequence
  derived and/or modified sequence opt5 from hemagglutinin__InfluenzaA__ADO25222
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacugaauaaguccuauauuaacgacaaggggaaagaagugcuuguccuguggggaauccaccaccccagcaccuccgccgaucaacagucucucuaccagaaugcugacgccuacguguucgugggcacaagcagauauuccaagaaauuuaagccugagauugcuauccggccgaaaguccgcgaucaggaggggagaaugaacuacuauuggacccugguugaacccggagacaagauuacguucgaggccacaggcaaccugguggugccucgguacgcguuugccauggaacgcaaugcugggagcggaaucauuaucucugauacccccguccaugacugcaacacaaccugucaaaccccuaaaggcgccaucaauacaucccuccccuuccagaacauucacccgaucacgauuggcaagugcccuaaguaugugaaaagcaccaagcugagacuugcuacagggcugcggaauguucccucuauccagagccgcggacucuuuggcgccauugccggguucaucgagggaggcuggaccgggaugguggacggaugguacggcuaucaucaccagaacgaacaaggcuccggguacgcugcggaucugaaaucuacacagaaugccaucgacaagauuaccaacaaagucaauagcgugaucgagaagaugaacacgcaguuuacagcuguuggaaaggaguucaaucaccuugagaaaagaauugagaaccugaauaagaaaguggaugacggcuuccucgauaucuggaccuacaacgccgaacugcugguccuccuggagaaugaacggacccuugacuaucaugauuccaacgugaagaaccuguacgagaaaguccgcagccagcucaagaauaacgccaaggagauugggaauggauguuuugaguucuaucacaaaugcgacaacacauguauggaaucugugaagaauggcaccuacgauuauccuaaauacuccgaagaggcuaagcugaacagagaagagaucgacgggguuaaacuugagagcacacggaucuaucaaauucuggccaucuacucuacgguggcguccagccucguccuggugguuucccugggcgcuauuucuuuuuggaugugcagcaauggaucccuccagugccgcaucuguauuuga

SEQ ID NO: 189159 - RNA, 1701 nt, Artificial Sequence; identical to SEQ ID NO: 187306
  derived and/or modified sequence opt5 from hemagglutinin__InfluenzaA__ADO25232

SEQ ID NO: 189160 - RNA, 1701 nt, Artificial Sequence; identical to SEQ ID NO: 187245
  derived and/or modified sequence opt5 from hemagglutinin__InfluenzaA__ADO25242

SEQ ID NO: 189161 - RNA, 1701 nt, Artificial Sequence; identical to SEQ ID NO: 187323
  derived and/or modified sequence opt5 from hemagglutinin__InfluenzaA__ADO25252

SEQ ID NO: 189162 - RNA, 1701 nt, Artificial Sequence; identical to SEQ ID NO: 187565
  derived and/or modified sequence opt5 from hemagglutinin__InfluenzaA__ADO25262

SEQ ID NO: 189163 - RNA, 1701 nt, Artificial Sequence
  derived and/or modified sequence opt5 from hemagglutinin__InfluenzaA__ADO25272
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagauguuccccaagaccagcucuuggccuaaucacgauuccaacaagggagugacagccgcuuguccccaugccggcguuaagagcuuuuauaagaaucugaucuggcucgugaaaaagggcaacucuuacccuaaacuguccaagagcuauaucaaugacaaggggaaagaaguccuugugcuguggggcauucaccaccccuccaccucugcggaucaacagagccucuaccagaacgccgacgcuuacguguucgucggaacauccagauauagcaagaaauuuaagccugagaucgccauucggccgaaaguucgcgaucaggaggggagaaugaauuacuauuggacccugguggaacccggagacaagaucacguucgaggcuacaggcaaccugguggucccucgguacgccuuugcgauggaacgcaacgccgggucuggaauuaucauuuccgauacccccgugcaugacugcaauacaaccugucaaaccccuaaaggcgcuaucaacacaagccuccccuuccagaauauccacccgauuacgaucggcaagugcccuaaguauguuaaaucuaccaagcugagacuugccacagggcugcggaacgugcccagcauucagucccgcggacucuuuggcgcuaucgccggguucauugagggaggcuggaccgggauggucgacggaugguacggcuaucaucaccagaaugaacaaggcucuggguacgccgcugaucugaaaagcacacagaacgcgaucgacgagaucaccaauaaggugaacuccguuauugagaaaaugaauacgcaguuuacagccgugggaaaggaguucaaccaccuugagaagagaaucgaaaaucugaacaaaaaggucgaugacggcuuccucgauauuuggaccuacaaugcugagcugcuggugcuccuggaaaacgagcggacccuugacuaucaugauagcaaugucaaaaaccuguacgagaaggugcgcucucagcucaaaaacaaugccaaggaaaucgggaacggauguuuugaguucuaucacaagugcgacaauacauguauggaauccguuaaaaacggcaccuacgauuauccuaaguacagcgaggaagccaaacugaauagagaggagauugacggggugaaacuugaaucuacacggaucuaucaaauccuggcuauuuacuccacggucgccagcucccucgugcugguugugucucugggcgcgaucagcuuuuggaugugcuccaacggaucucuccagugccgcauuuguaucuga

SEQ ID NO: 189164 - RNA, 1701 nt, Artificial Sequence; identical to SEQ ID NO: 187306
  derived and/or modified sequence opt5 from hemagglutinin__InfluenzaA__ADO25282

SEQ ID NO: 189165 - RNA, 1698 nt, Artificial Sequence; identical to SEQ ID NO: 185512
  derived and/or modified sequence opt5 from hemagglutinin__InfluenzaA__ADO27622

SEQ ID NO: 189166 - RNA, 1701 nt, Artificial Sequence; identical to SEQ ID NO: 185693
  derived and/or modified sequence opt5 from hemagglutinin__InfluenzaA__ADO29887

SEQ ID NO: 189167 - RNA, 1701 nt, Artificial Sequence
  derived and/or modified sequence opt5 from hemagglutinin__InfluenzaA__ADO29888
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguagacugcggggaguugcuccccuccaucugggcaagugcaacaucgccggguggauucugggaaauccugagugugaaucucucagcacagccuccucuuggagcuacaucguggagaccuccucuagcgacaacggcacgugcuauccgggggauuuuauugacuacgaagaacugcgcgagcagcuuuccagcgucucuuccuucgaaagauuugagaucuuccccaaaaccagcucuuggccuaaucacgaucccaacaagggagugacagccgcuuguccucaugccggcgcgaaguccuuuuauaaaaaucugaucuggcucguuaagaaaggcaacagcuaccccaagcugucuaaauccuauauuaaugacaaggggaaggaagugcuuguccuguggggaauccaccacccuagcaccuccgccgaucaacagucucucuaccagaacgcugacgccuacguguucgugggcacaagccgguauuccaaaaaguuuaaaccggagauugcuauccgccccaaggucagagaucaggaggggcggaugaauuacuauuggacccugguugaaccuggagacaaaauuacguucgaggccacaggcaaccugguggugccccgcuacgcguuugccauggaaagaaacgcugggagcggaaucauuaucucugauaccccuguccaugacugcaauacaaccugucaaacccccaagggcgccaucaacacaucccucccguuccagaauauucacccuaucacgauuggcaaaugccccaaguauguuaagagcaccaaacugcggcuugcuacagggcugcgcaacgugccuucuauccagagcagaggacucuuuggcgccauugccggguucaucgagggaggcuggaccgggaugguggacggaugguacggcuaucaucaccagaaugaacaaggcuccggguacgcugcggaucugaagucuacacagaacgccaucgacgagauuaccaauaaagucaacagcgugaucgagaagaugaauacgcaguuuacagcuguuggaaaagaguucaaccaccuugagaagcggauugaaaaucugaacaagaaaguggaugacggcuuccucgauaucuggaccuacaaugccgagcugcugguccuccuggaaaacgagcgcacccuugacuaucaugauuccaaugugaagaaccuguacgagaaagucagaagccagcucaagaacaaugccaaagaaauugggaacggauguuuugaguucuaucacaagugcgacaauacauguauggaaucugugaagaacggcaccuacgauuaucccaaauacuccgaggaagcuaagcugaaucgggaggagaucgacgggguuaaacuugaaagcacacgcaucuaucaaauucuggccaucuacucuacgguggcguccagccucguccuggugguuucccugggcgcuauuucuuuuuggaugugcagcaacggaucccuccagugcagaaucuguauuuga

SEQ ID NO: 189168 - RNA, 1701 nt, Artificial Sequence
  derived and/or modified sequence opt5 from hemagglutinin__InfluenzaA__ADO29889
augaaggccauccuggugguccuccuguacaccuucgcuacagccaacgcggacauucuuugcaucggcuaucacgcuaauaacagcacggauaccguugacacagugcuggagaaaaaugugaccgucacacauuccgugaaccuccuggaagauaagcacaaugggaaacuuuguaagcugagaggaguugcuccccuccaucugggcaaaugcaacauugccggguggauccugggaaauccugagugugaaucuuuuagcaccuccucuagcugguccuacauuguggagacaucuagcuccgacaacggaaccugcuauccgggggauuucaucgacuacgaagaacuccgggagcagcugagcucugucuccagcuuugaacgcuucgagaucuuucccaagacgucuuccuggccuaaucacgauagcaacaagggagugaccgccgccuguccccaugcuggcgccaaaucuuucuauaagaaucuuauuuggcugguuaaaaagggcaacuccuacccuaaacucagcaaguccuauaucaaugacaaggggaaagaagugcugguccuuuggggcauucaccaccccucuacaagcgcggaucaacagucccuguaccagaacgccgacgcuuacguguuugugggcaccagcagauauucuaagaaauucaagccugagaucgccauucggccgaaaguccgcgaucaggaggggagaaugaauuacuauuggacacucguugaacccggagacaagaucaccuuugaggcuacgggcaaccugguggugccucgguacgccuucgcgauggaacgcaacgccggguccggaauuaucaucagcgauacacccguccaugacugcaauaccacaugucaaaccccuaaaggcgcuauuaacaccucucugcccuuucagaauauccacccgauuacaaucggcaagugcccuaaguaugugaaaagcacgaagcucagacuggccaccgggcuucggaacguucccuccauucagucucgcggacuguucggcgcuaucgccggguuuaucgagggaggcuggacagggaugguggacggaugguacggcuaucaucaccagaaugaacaaggcagcggguacgccgcugaucucaaauccacccagaacgcgauugacgagaucacaaauaaggucaacagcgugauugagaaaaugaauacccaguucacggccguuggaaaggaguucaaccaccuggagaagagaaucgaaaaucuuaacaaaaagguggaugacggcuuucuggauauuuggacauacaaugcugagcuccugguccugcucgaaaacgagcggacccuggacuaucaugauucuaaugugaaaaaccuuuacgagaagguccgcucccagcugaaaaacaaugccaaggaaaucgggaacggauguuucgaguuuuaucacaagugcgacaauaccuguauggaaagcgugaaaaacggcacauacgauuauccuaaguacucugaggaagccaaacucaauagagaggagaucgacgggguuaagcuggaauccacccggauuuaucaaauccuugcuauuuacagcacaguggccuccucucugguccucgugguuagccugggcgcgaucuccuucuggaugugcucuaacggaagccugcagugccgcauuuguaucuga

SEQ ID NO: 189169 - RNA, 1701 nt, Artificial Sequence
  derived and/or modified sequence opt5 from hemagglutinin__InfluenzaA__ADO29890
augaaggccauccuggugguccuccuguacaccuucgcuacagccaaagcggacacgcuuugcauuggcuaucacgcuaacaauagcgccgauaccguugacacagugcuggagaagaacgugaccgucacacauuccgugaaucuccuggaagauaaacacaacgggaaacuuuguaagcugagaggaguugcuccccuccaucugggcaagugcaauaucgccggguggauucugggaaacccugagugugaaucucucagcaccgccuccucuuggagcuacaucguggagacauccucuagcgacaaugggaccugcuauccgggcgauuuuauugacuacgaagaacugcgggagcagcuuuccagcgucucuuccuucgaacgcuuugagaucuuccccaagacgagcucuuggccuaaccacgaucccaauaaaggagugaccgcugccuguccucaugcgggcgccaaguccuuuuauaaaaaccugaucuggcucguuaagaaaggcaauagcuaccccaagcugucuaaguccuauauuaacgacaaagggaaggaagugcuuguccuguggggaauccaccacccuagcacauccguggaucaacagucucucuaccagaaugcugacgccuacguguucgucggcaccagcagauauuccaaaaaguuuaaaccggagauugcuauccggcccaagguucgcgaucaggaggggagaaugaacuacuauuggacacugguggaaccuggagacaaaauuaccuucgaggccacgggcaaucugguggucccccgguacgcguuugccauggaacgcaacgcugggagcggaaucauuaucucugauacaccugugcaugacugcaacaccacaugucaaacccccaagggcgccaucaauaccucccucccguuccagaacauucacccuaucacaauuggcaagugccccaaauauguuaagagcacgaaacugagacuugcuaccgggcugcggaaugugccuucuauccagagccgcggacucuuuggcgccauugccggguucaucgagggaggcuggacagggauggucgacggaugguacggcuaucaucaccagaacgaacaaggcuccggguacgcugcggaucugaagucuacccagaaugccaucgacgagauuacaaacaaagugaauagcguuaucgagaagaugaacacccaguuuacggcugugggaaaggaguucaaucaccuugagaaaagaauugaaaaccugaauaagaaagucgaugacggcuuccucgauaucuggacauacaacgccgagcugcuggugcuccuggaaaaugagcggacccuugacuaucaugauuccaacgucaagaaucuguacgagaaagugcgcagccagcucaagaacaacgccaaggaaauugggaauggauguuuugaguucuaucacaaaugcgacaacaccuguauggaaucuguuaagaauggcacauacgauuaucccaaauacuccgaggaagcuaagcugaacagagaggagaucgacggggugaaacuugaaagcacccggaucuaucaaauucuggccaucuacucuacagucgcguccagccucgugcugguugugucccugggcgcuauuucuuuuuggaugugcagcaauggaucccuccagugccgcaucuguauuuga

SEQ ID NO: 189170 - RNA, 1701 nt, Artificial Sequence
  derived and/or modified sequence opt5 from hemagglutinin__InfluenzaA__ADO29891
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagacgacauucgaggccaccggcaaccugguggugccucgguacgcguuugccauggaacgcaacgcugggucuggaauuaucauuuccgauacacccguccaugacugcaauaccaccugucaaacaccuaaaggcgccaucaacacgagccuccccuuccagaauauccacccgauuaccaucggcaagugcccuaaguaugugaaaucuacaaagcugagacuugcuaccgggcugcggaacguucccagcauucagucccgcggacucuuuggcgccaucgccggguucauugagggaggcuggacagggaugguggacggaugguacggcuaucaucaccagaaugaacaaggcucuggguacgcugcggaucugaaaagcacccagaacgccaucgacaagaucacgaauaaagucaacuccgugauugagaagaugaauacacaguuuaccgcuguuggaaaggaguucaaccaccuugagaaaagaaucgagaaucugaacaagaaaguggaugacggcuuccucgauauuuggaccuacaaugccgaacugcugguccucagcgagaacgaacggacacuggacuaucaugauucuaaugugaagaaccuuuacgagaaaguccgcucccagcugaagaacaaugccaaggagaucgggaacggauguuuugaguucuaucacaaaugcgacaauaccuguauggaaagcgugaagaacggcacauacgauuauccuaaauacucugaagaggcuaagcucaauagagaagagauugacgggguuaaacuggaguccacgcggaucuaucaaauccuugccauuuacagcaccguggcguccucucugguccucgugguuagccugggcgcuaucuccuuuuggaugugcucuaacggaagccugcagugccgcauuuguaucuga

SEQ ID NO: 189171 - RNA, 1701 nt, Artificial Sequence
  derived and/or modified sequence opt5 from hemagglutinin__InfluenzaA__ADO29892
augaaggccauccuggugguccuccuguacaccuucgcuacagccaaagcggacacgcuuugcauuggcuaucacgcuaacaauagcaccgauacaguugacaccgugcuggagaagaacgugacagucacccauuccgugaaucuccuggaagauaaacacaacgggaaacuuuguaagcugagaggaguugcuccccuccaucugggcaagugcaauaucgccgggcggauucugggaaacccugagugugaaucucucagcacagccuccucuuggagcuacaucguggagaccuccucuagcgacaauggcacgugcuauccgggggauuuuauugacuacgaagaacugcgcgagcagcuuuccagcgucucuuccuucgaaagauuugagaucuuccccaagaccagcucuuggccuaaccacgaucccaauaaaggagugacagccgcuuguccucaugccggcgcgaaguccuuuuauaaaaaccugaucuggcucguuaagaaaggcaauagcuaccccaagcugucuaaguccuauauuaacgacaaagggaaggaagugcuuguccuguggggaauccaccacccuagcaccuccguggaucaacagucucucuaccagaaugccgacgcuuacguguucgucggcacaagccgguauuccaaaaaguuuaaaccggagauugccauccgccccaagguuagagaucaggaggggcggaugaacuacuauuggacccugguggaaccuggagacaaaauuacguucgaggcuacaggcaaucugguggucccccgcuacgccuuugcgauggaaagaaacgccgggagcggaaucauuaucucugauaccccugugcaugacugcaacacaaccugucaaacccccaagggcgcuaucaauacaucccucccguuccagaacauucacccuaucacgauuggcaagugccccaaauauguuaagagcaccaaacugcggcuugccacagggcugcgcaaugugccuucuauccagagcagaggacucuuuggcgcuauugccggguucaucgagggaggcuggaccgggauggucgacggaugguacggcuaucaucaccagaacgaacaaggcuccggguacgccgcugaucugaagucuacacagaaugcgaucgacgagauuaccaacaaagugaauagcguuaucgagaagaugaacacgcaguuuacagccgugggaaaggaguucaaucaccuugagaaacggauugaaaaccugaauaagaaagucgaugacggcuuccucgauaucuggaccuacaacgcugagcugcuggugcuccuggaaaaugagcgcacccuugacuaucaugauuccaacgucaagaaucuguacgagaaagugagaagccagcucaagaacaacgccaaggaaauugggaauggauguuuugaguucuaucacaaaugcgacaacacauguauggaaucuguuaagaauggcaccuacgauuaucccaaauacuccgaggaagccaagcugaaccgggaggagaucgacggggugaaacuugaaagcacacgcaucuaucaaauucuggcuaucuacucuacggucgccuccagccucgugcugguugugucccugggcgcgauuucuuuuuggaugugcagcaauggaucccuccagugcagaaucuguauuuga

SEQ ID NO: 189172 - RNA, 1701 nt, Artificial Sequence; identical to SEQ ID NO: 186491
  derived and/or modified sequence opt5 from hemagglutinin__InfluenzaA__ADO29893

SEQ ID NO: 189173 - RNA, 1701 nt, Artificial Sequence
  derived and/or modified sequence opt5 from hemagglutinin__InfluenzaA__ADO29894
augaaggccauccuggugguccuccuguacaccuucgcuacagccaacgcggacacgcuuugcauuggcuaucacgcuaauaacagcaccgauacaguugacaccgugcuggagaugaaugugacagucacccauuccgugaaccuccuggaagauaaacacaaugggaaacuuuguaagcugagaggaguugcuccccuccaucugggcaagugcaacaucgccggguggauucugggaaauccugagugugaaucuuuuagcacauccucuagcugguccuacaucguggagaccucuagcuccgacaacggcacgugcuauccgggggauuucauugacuacgaagaacuccgggagcagcugagcucugucuccagcuuugaacgcuucgagaucuuucccaaaaccucuuccuggccuaaucacgauagcaacaagggagugacagccgccuguccccaugcuggcgccaagucuuucuauaaaaaucuuaucuggcugguuaagaaaggcuccagcuacccuaagcucuccaaaucuuauauuaacgacaaggggaaggaagugcugguccuuuggggaauccaccaccccagcaccuccgcggaucaacagagccuguaccagaaugccgacgcuuacguguuugugggcacaucuagauauuccaaaaaguucaaaccugagauugccauccggccgaagguccgcgaucaggaggggagaaugaacuacuauuggacccucguugaacccggagacaaaauuacguuugaggcuacaggcaaucugguggugccucgguacgccuucgcgauggaacgcaacgccgggagcggaaucauuaucucugauacccccguccaugacugcaacacaaccugucaaaccccuaagggcgcuaucaauacaagccugcccuuucagaacauucacccgaucacgauuggcaaaugcccuaaguaugugaaguccaccaaacucagacuggccacagggcuucggaauguucccucuauccagagccgcggacuguucggcgcuauugccggguuuaucgagggaggcuggaccgggaugguggacggaugguacggcuaucaucaccagaacgaacaaggcuccggguacgccgcugaucucaagagcacacagaaugcgaucgacgagauuaccaacaaagucaauucugugaucgagaagaugaacacgcaguucacagccguuggaaaagaguucaaucaccuggagaagagaauugaaaaccuuaauaagaaaguggaugacggcuuucuggauaucuggaccuacaacgcugagcuccugguccugcucgaaaaugagcggacccuggacuaucaugauuccaacgugaagaaucuuuacgagaaaguccgcagccagcugaagaacaacgccaaagaaauugggaauggauguuucgaguuuuaucacaagugcgacaacacauguauggaaucugugaagaauggcaccuacgauuauccuaaauacuccgaggaagccaagcucaacagagaggagaucgacgggguuaaacuggaaagcacacggaucuaucaaauucuugcuaucuacuccacgguggccucuagccugguccucgugguuucccugggcgcgauuucuuucuggaugugcagcaauggaucccugcagugccgcaucuguauuuga

SEQ ID NO: 189174 - RNA, 1701 nt, Artificial Sequence
  derived and/or modified sequence opt5 from hemagglutinin__InfluenzaA__ADO29895
augaaggccauccugguggcucuccuguacaccuucgccacagcgaacgcugacacgcuuugcauuggcuaucacgccaauaacagcaccgauacagucgacaccguucuggagaaaaaugugacagugacccauuccgucaaccuccuggaagauaagcacaaugggaaacuuuguaagcugagaggaguggcuccccuccaucugggcaaaugcaacaucgccggguggauucugggaaauccugagugugaaucuuuuagcacauccucuagcugguccuacaucguugagaccucuagcuccgacaacggcacgugcuauccgggggauuucauugacuacgaagaacuccgggagcagcugagcucuguguccagcuuugaacgcuucgagaucuuucccaagaccucuuccuggccuaaucacgauagcaacaagggagucacagccgcuuguccccaugccggcgcgaaaucuuucuauaagaaucuuaucuggcuggugaaaaagggcuccagcuacccuaaacucuccaagucuuauauuaacgacaaggggaaagaaguucuggugcuuuggggaauccaccaccccagcaccuccgccgaucaacagagccuguaccagaaugcugacgccuacgucuuugugggcacaucuagauauuccaagaaauucaagccugagauugcuauccggccgaaagugcgcgaucaggaggggagaaugaacuacuauuggacccucgucgaacccggagacaagauuacguuugaggccacaggcaaucugguugugccucgguacgcguucgccauggaacgcaacgcugggagcggaaucauuaucucugauacccccgugcaugacugcaacacaaccugucaaaccccuaaaggcgccaucaauacaagccugcccuuucagaacauucacccgaucacgauuggcaagugcccuaaguaugucaaagggaccaagcucagacuggcuacaggacuucggaaugugcccuccauccagucucgcggccuguucggggccauugccggauuuaucgagggcggguggaccggaaugguugacggcugguacggcuaucaucaccagaacgaacaagggagcggauacgcugcggaucucaaauccacacagaaugccaucgacgagauuaccaacaaggugaauagcgucaucgagaaaaugaacacgcaguucacagcugugggcaaggaguucaaucaccuggagaagagaauugaaaaccuuaauaaaaagguugaugacggguuucuggauaucuggaccuacaacgccgagcuccuggugcugcucgaaaaugagcggacccuggacuaucaugauucuaacgucaaaaaucuuuacgagaaggugcgcucccagcugaaaaacaacgccaaggaaauuggaaauggcuguuucgaguuuuaucacaagugcgacaacacauguauggaaagagucaaaaaugggaccuacgauuauccuaaguacagcgaggaagcuaaacucaaccgggaggagaucgacggcgugaagcuggaaucuacacgcaucuaucaaauucuugccaucuacuccacgguugcgagcucccuggugcucgucgugucucugggagcuauuagcuucuggaugugcuccaauggcucucugcagugcagaaucuguauuuga

SEQ ID NO: 189175 - RNA, 1701 nt, Artificial Sequence
  derived and/or modified sequence opt5 from hemagglutinin__InfluenzaA__ADO29897
augaaggccauccuggugguccuccuguacaccuucgcuacagccaacgcggacauucuuugcaucggcuaucacgcuaauaacagcacggauaccguugacacagugcuggagaaaaaugugaccgucacacauuccgugaaccuccuggaagauaagcacaaugggaaacuuuguaagcugagaggaguugcuccccuccaucugggcaaaugcaacauugccggguggauccugggaaauccugagugugaaucuuuuagcaccuccucuagcugguccuacauuguggagacaucuagcuccgacaacggcaagugcuauccgggggauuucaucgacuacgaagaacuccgggagcagcugagcucugucuccagcuuugaacgcuucgagaucuuucccaagaccucuuccuggccuaaucacgauagcaacaaaggagugacgaccgccuguccccaugccggcgcuaagucuuucuauaaaaaucuuauuuggcugguuaagaaaggcaacuccuacccuagacucagcaaguccuauaucaaugacaaggggaaagaagugcugguccuuuggggcauucaccaccccucuacaagcgccgaucaacagucccuguaccagaacgcggacgccuacguguuugugggaaccagccgguauucuaagaaauucaagccugagaucgcuauucgcccgaaagucagagaucaggaggggcggaugaauuacuauuggacacucguugaacccggagacaagaucaccuuugaggccacgggcaaccugguggugccucgcuacgcuuucgccauggaaagaaacgcgggguccggaauuaucaucagcgauacacccguccauggcugcaauaccacaugucaaaccccuaaaggcgccauuaacaccucucugcccuuucagaauauccacccgauuacaaucgggaagugcccuaaguaugugaaaagcacgaagcuccggcuggcuaccggacuucgcaacguucccuccauucagucuagaggccuguucggggccguggcuggauuuaucgagggcggguggacaggaauggucgacggcugguacggcuaucaucaccagaaugaacaagggagcggauacgccgccgaccucaaauccacccagaacgcuaucgaugagauuacaaauaaggugaacagcguuaucgagaaaaugaauacccaguucacggcggugggcaaggaguucaaccaccuggagaagcggauugaaaaucuuaacaaaaaggucgacgauggguuucuggacaucuggacauacaaugccgagcuccuggugcugcucgaaaacgagcgcacccuggauuaucaugacucuaaugucaaaaaccuuuacgagaaggugagaucccagcugaaaaacaaugcuaaggaaauuggaaacggcuguuucgaguuuuaucacaagugcgauaauaccuguauggaaagcguuaaaaacgggacauacgacuauccuaaguacucugaggaagccaaacucaaucgggaggagaucgauggcgugaagcuggaauccacccgcaucuaucaaauucuugccaucuacagcacagucgcuuccucucuggugcucguugugagccugggagccauuuccuucuggaugugcucuaacggcagccugcagugcagaaucuguauuuga

SEQ ID NO: 189176 - RNA, 1701 nt, Artificial Sequence; identical to SEQ ID NO: 186491
  derived and/or modified sequence opt5 from hemagglutinin__InfluenzaA__ADO29898

SEQ ID NO: 189177 - RNA, 1701 nt, Artificial Sequence
  derived and/or modified sequence opt5 from hemagglutinin__InfluenzaA__ADO29899
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacaagauuaccaauaaagucaacuccgugaucgagaagaugaauacgcaguuuacagcuguuggaaaggaguucaaccaccuugagaaaagaauugagaaucugaacaagaaaguggaugacggcuuccucgauaucuggaccuacaaugccgaacugcugguccuccuggagaacgaacggacccuugacuaucaugauagcaaugugaagaaccuguacgagaaaguccgcucucagcucaagaacaaugccaaggagauugggaacggauguuuugaguucuaucacaaaugcgacaauacauguauggaauccgugaagaacggcaccuacgauuauccuaaauacagcgaagaggcuaagcugaauagagaagagaucgacgggguuaaacuugagucuacacggaucuaucaaauucuggccaucuacuccacgguggcgagcucccucguccuggugguuucucugggcgcuauuagcuuuuggaugugcuccaacggaucucuccagugccgcaccuguaucuga

SEQ ID NO: 189178 - RNA, 1701 nt, Artificial Sequence
  derived and/or modified sequence opt5 from hemagglutinin__InfluenzaA__ADO29900
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggaucugauugacuacgaagaacuucgggagcagcuguccagcgucucuuccuuugaacgcuucgagaucuuucccaagaccagcucuuggccuaaucacgaucucaacaagggagugacagccgcuuguccccaugccggcgcgaaauccuucuauaagaaucugaucuggcuuguuaaaaagggcaacagcuacccuaaacugucuaaguccuauauuaaugacaaggggaaagaagugcucguccuguggggaauccaccaccccagcaccuccgccgaucaacagucucuguaccagaacgcugacgccuacguguuugugggcacaagcagauauuccaagaaaagcaagccugagauugcuauccggccgaaaguccgcgaucaggaggggagaaugaauuacuauuggacccucguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuucccuuccagaauauucacccgaucacgauuggcaagugcccuaaguaugugagaucuaccaaacugcggcucgcuacagggcugcgcaacguucccagcauccaguccagaggacuuuuuggcgccauugccggguucaucgagggaggcuggaccgggaugguggacggaugguacggcuaucaucaccagaaugaacaaggcucuggguacgcugcggaucucaagagcacacagaacgccaucgacgagauuaccaauaaagucaacuccgugaucgagaagaugaauacgcaguuuacagcuguuggaaaagaguucaaccaccuggagaagcggauugaaaaucugaacaagaaaguggaugacggcuuucuggauaucugggccuacaaugccgagcuccugguccuucuggaaaacgagcgcacccucgacuaucaugauagcaaugugaagaaccuguacgagaaagucagaucucagcuuaagaacaaugcuaaagaaauugggaacggauguuucgaguucuaucacaagugcgacaauaccuguauggaauccgugaagaacggcacauacgauuauccuaaauacagcgaggaagccaagcugaaucgggaggagaucgacgggguuaaacucgaaucuacccgcaucuaucaaauucuggcgaucuacuccacaguggcuagcucccugguccucgugguuucucugggcgccauuagcuuuuggaugugcuccaacggaucucuucagugcagaaucuguauuuga

SEQ ID NO: 189179 - RNA, 1701 nt, Artificial Sequence
  derived and/or modified sequence opt5 from hemagglutinin__InfluenzaA__ADO29901
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugagaaacuuuguaagcugagagggguugcuccccuccaucugggaaaaugcaacaucgccggcuggauucuggggaauccugaaugugagucucucagcacagccuccucuuggagcuacaucguggaaaccuccucuagcgacaacggaacgugcuauccgggcgauuuuauugacuacgaggagcugcgggaacagcuuuccagcgucucuuccuucgagcgcuuugaaaucuuccccaagaccagcucuuggccuaaucacgauuccaacaagggggugacagccgcuuguccccaugccggagcgaaaucuuuuuauaagaaucugaucuggcucgccaaaaagggcaacagcuacccuaaaguuuccaagagcuauauuaaugacaagggcaaagaggugcugguccuuugggggauccaccaccccuccaccucugcugaucaacagagccuguaccagaacgccgacgcuuacguguucgugggaacauccagauauagcaagaaauuuaagccugagauugccauccggccgaaaguccgcgaucaggaaggcagaaugaauuacuauuggacccucguugagcccggggacaagauuacguucgaagcgacaggaaaccugguggugccucgguacgccuuugcuauggagcgcaacgccggcucugggaucauuaucuccgauacccccguccaugacugcaauacaaccugucaaaccccuaaaggagcuaucaacacaagccugcccuuccagaauauucacccgaucacgauuggcaagugcccuaaguaugugaaaucuaccaagcucagacuggccacaggccuucggaacguucccagcauccagucccgcgggcuguuuggagccauugcuggcuucaucgaagggggauggaccggcaugguggacgggugguacggauaucaucaccagaaugagcaaggcucuggcuacgcggccgaucucaaaagcacacagaacgcuaucgacgagauuaccaauaaggucaacuccgugaucgaaaagaugaauacgcaguuuacagccguugggaaagaguucaaccaccuggaaaagagaauugagaaucuuaacaaaaagguggaugacggauuccuggauaucuggaccuacaaugccgaacuccugguccugcucgagaacgagcggacccuggacuaucaugauagcaaugugaaaaaccuuuacgaaaagguccgcucucagcugaaaaacaaugcuaaggagauuggcaacggguguuuugaguucuaucacaagugcgacaauacauguauggaauccgugaaaaacggaaccuacgauuauccuaaguacagcgaagaggccaaacucaauagagaggaaaucgacggcguuaagcuggagucuacacggaucuaucaaauucuugcgaucuacuccacgguggcuagcucccugguccucgugguuucucugggggccauuagcuuuuggaugugcuucaacggcucccugcagugccgcaucuguauuuga

SEQ ID NO: 189180 - RNA, 1701 nt, Artificial Sequence
  derived and/or modified sequence opt5 from hemagglutinin__InfluenzaA__ADO29902
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacaagauuaccaauaaagucaacuccgugaucgagaagaugaauacgcaguuuacagcuguuggaaaggaguucaaccaccuugagaaaagaauugagaaucugaacaagaaaguggaugacggcuuccucgauaucuggaccuacaaugccgaacugcugguccuccuggagaacgaacggacccuugacuaucaugauagcaaugugaagaaccuguacgagaaaguccgcucucagcucaagaacaaugccaaggagauugggaacggauguuuugaguucuaucacaaaugcgacaauacauguauggaaggcgugaagaacgggaccuacgauuauccuaaauacuccgaagaggcuaagcugaauagagaagagaucgacggcguuaaacuugagagcacacggaucuaucaaauucuggccaucuacucuacgguggcguccagccucguccuggugguuucccugggagcuauuucuuuuuggaugugcagcaacggcucccuccagugccgcaucuguauuuga

SEQ ID NO: 189181 - RNA, 1701 nt, Artificial Sequence
  derived and/or modified sequence opt5 from hemagglutinin__InfluenzaA__ADO29903
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacacagccggguggauccugggaaauccugagugugaaucucucagcaccgccuccucuuggagcuacauuguggagacguccucuagcgacaacggaaccugcuauccgggggauuuuaucgacuacgaagaacugcgggagcagcuuuccagcgucucuuccuucgaacgcuuugagauuuuccccaagacaagcucuuggccuaaucacgaucccaacaagggagugaccgccgcuuguccucaugccggcgcgaaauccuuuuauaagaaucugaucuggcucguuaaaaagggcaacagcuaccccaaacugucuaaguccuauaucaaugacaaggggaaagaagugcuuguccuguggggcauucaccacccuagcacauccgccgaucaacagucucucuaccagaacgcugacgccuacguguucgugggcaccagcagauauuccaagaaauuuaagccggagaucgcuauucggcccaaaguccgcgaucaggaggggagaaugaauuacuauuggacgcugguugaaccuggagacaagaucacauucgaggccaccggcaaccugguggugccccgguacgcguuugccauggaacgcaacgcugggagcggaauuaucauuucugauacaccuguccaugacugcaauaccaccugucaaacacccaaaggcgccaucaacacgucccucccguuccagaauauccacccuauuaccaucggcaagugccccaaguaugugaaaagcacaaagcugagacuugcuaccgggcugcggaacguuccuucuauucagagccgcggacucuuuggcgccaucgccggguucauugagggaggcuggacagggaugguggacggaugguacggcuaucaucaccagaaugaacaaggcuccggguacgcugcggaucugaaaucuacccagaacgccaucgacgagaucacgaauaaggucaacagcgugauugagaaaaugaauacacaguuuaccgcuguuggaaaggaguucaaccaccuugagaagagaaucgaaaaucugaacaaaaagguggaugacggcuuccucgauauuuggaccuacaaugccgagcugcugguccuccuggaaaacgagcggacacuugacuaucaugauuccaaugugaaaaaccuguacgagaagguccgcagccagcucaaaaacaaugccaaggaaaucgggaacggauguuuugaguucuaucacaagugcgacaauaccuguauggaaucugugaaaaacggcacauacgauuaucccaaguacuccgaggaagcuaaacugaauagagaggagauugacgggguuaaacuugaaagcacgcggaucuaucaaauccuggccauuuacucuaccguggcguccagccucguccuggugguuucccugggcgcuaucucuuuuuggaugugcagcaacggaucccuccagugccgcauuuguaucuga

SEQ ID NO: 189182 - RNA, 1701 nt, Artificial Sequence
  derived and/or modified sequence opt5 from hemagglutinin__InfluenzaA__ADO29904
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggccggugcaacaucgccggguggauucugggaaauccugagugugaaucucucagcacagccuccucuuggagcuacaucguggagaccuccucuagcgacaacggcacgugcuauccgggggauuuuauugacuacgaagaacugcgcgagcagcuuuccagcgucucuuccuucgaaagauuugagaucuuccccaaaaccagcucuuggccuaaucacgaucccaacaagggagugacagccgcuuguccucaugccggcgcgaaguccuuuuauaaaaaucugaucuggcucguuaagaaaggcaacagcuaccccaagcugucuaaauccuauauuaaugacaaggggaaggaagugcuuguccuguggggaauccaccggccuagcaccuccgccgaucaacagucucucuaccagaacgcugacgccuacguguucgugggcacaagccgcuauuccaaaaaguuuaaaccggagauugcuaucagacccaaggucggggaucaggagggacggaugaauuacuauuggacccugguugaaccuggcgacaaaauuacguucgaggccacagggaaccugguggugccccgcuacgcguuugccauggaaagaaacgcuggaagcggcaucauuaucucuaauaccccuguccacgauugcaacacaaccugucaaacccccaagggcgccaucaauacaucccucccguuccagaacauucauccuaucacgauugggaaaugccccaaguauguuaagagcaccaaacugcggcuugcuacaggacugcgcaaugugccuucuauccagagcagaggccucuuuggggccauugccggauucaucgagggcggguggaccggaaugguggacggcugguacggcuaucaccaucagaacgaacaaggguccggauacgcugcggaccugaagucuacacagaaugccaucgaugagauuaccaacaaagucaauagcgugaucgagaagaugaacacgcaguuuacagcuguuggcaaagaguucaaucaccuugagaagcggauugaaaaccugaauaagaaaguggacgauggguuccucgacaucuggaccuacaacgccgagcugcugguccuccuggaaaaugagcgcacccuugauuaucacgacuccaacgugaagaaccuguacgagaaagucagaagccagcucaagaauaacgccaaagaaauuggaaauggcuguuuugaguucuaucauaagugcgauaacacauguauggaaucugugaagaaugggaccuacgacuaucccaaauacuccgaggaagcuaagcugaaccgggaggagaucgauggcguuaaacuugaaagcacacgcaucuaucaaauucuggccaucuacucuacgguggcguccagccucguccuggugguuucccugggagcuauuucuuuuuggaugugcagcaauggcucccuccagugcagaaucuguauuuga

SEQ ID NO: 189183 - RNA, 1701 nt, Artificial Sequence
  derived and/or modified sequence opt5 from hemagglutinin__InfluenzaA__ADO29905
augaaggccauccuggugguccuccuguacaccuucgcuacagccaacgcggacacgcuuugcauuggcuaucacgcuaauaacagcaccgauacaguugacaccgugcuggagaagaaugugacagucaccagauccgugaaccuccuggaagauaagcauaaugggaaacuuuguaagcugcggggaguugcuccccuccaccugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgcgagcagcuuuccagcgucucuuccuucgaaagauuugagaucuuccccaagaccagcucuuggccuaaucaugaucccaacaagggagugacagccgcuuguccucacgccggcgcgaaauccuuuuauaagaaucugaucuggcucguuaaaaagggcaacagcuaccccaaacugucuaaguccuauauuaaugacaaggggaaagaagugcuuguccuguggggaauccaucacccuagcaccuccgccgaucaacagucucucuaccagaacgcugacgccuacguguucgugggcacaagccgguauuccaagaaauuuaagccggagauugcuauccgccccaaagucagagaucaggaggggcggaugaauuacuauuggacccugguugaaccuggagacaagauuacguucgaggccacaggcaaccugguggugccccgcuacgcguuugccauggaaagaaacgcugggagcggaaucauuaucucuaauaccccuguccacgauugcaacacaaccugucaaacccccaaaggcgccaucaauacaucccucccguuccagaacauucauccuaucacgauuggcaagugccccaaguaugugaaaagcaccaagcugcggcuugcuacagggcugcgcaauguuccuucuauccagagcagaggacucuuuggcgccauugccggguucaucgagggaggcuggaccgggaugguggacggaugguacggcuaucaccaucagaacgaacaaggcuccggguacgcugcggaccugaaaucuacacagaaugccaucgaugagauuaccaacaaggucaauagcgugaucgagaaaaugaacacgcaguuuacagcuguuggaaaggaguucaaucaccuugagaagcggauugaaaaccugaauaaaaagguggacgauggcuuccucgacaucuggaccuacaacgccgagcugcugguccuccuggaaaaugagcgcacccuugauuaucacgacuccaacgugaaaaaccuguacgagaaggucagaagccagcucaaaaauaacgccaaggaaauugggaauggauguuuugaguucuaucauaagugcgauaacacauguauggaaucugugaaaaauggcaccuacgacuaucccaaguacuccgaggaagcuaaacugaaccgggaggagaucgaugggguuaaacuugaaagcacacgcaucuaucaaauucuggccaucuacucuacgguggcguccagccucguccuggugguuucccugggcgcuauuucuuuuuggaugugcagcaauggaucccuccagugcagaaucuguauuuga

SEQ ID NO: 189184 - RNA, 1701 nt, Artificial Sequence
  derived and/or modified sequence opt5 from hemagglutinin__InfluenzaA__ADO29906
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaauagaaaacuuuguaagcugcgcgggguugcuccccuccaucugggaaaaugcaacaucgccggcuggauucuggggaauccugagugugaaucucucagcacagccuccucuuggagcuacaucguggagaccuccucuagcgacaacggaacgugcuauccgggcgauuuuauugacuacgaggagcugcgggagcagcuuuccagcgucucuuccuucgaaagauuugagaucuuccccaagaccagcucuuggccuaaucacgaucccaacaagggggugacagccgcuuguccucaugccggagcgaaauccuuuuauaagaaucugaucuggcucguuaaaaagggcaacagcuaccccaaacugucuaaguccuauauuaaugacaagggcaaagaagugcuuguccugugggggauccaccacccuagcaccuccgccgaucaacagucucucuaccagaacgcugacgccuacguguucgugggaacaagccgguauuccaagaaauuuaagccggagauugcuauccgccccaaagucagagaucaggagggccggaugaauuacuauuggacccugguugaaccuggggacaagauuacguucgaggccacaggaaaccugguggugccccgcuacgcguuugccauggaaagaaacgcuggcagcgggaucauuaucucugauaccccuguccaugacugcaauacaaccugucaaacccccaaaggagccaucaacacaucccucccguuccagaauauucacccuaucacgauuggcaagugccccaaguaugugaaaagcaccaagcugcggcuugcuacaggccugcgcaacguuccuucuauccagagcagagggcucuuuggagccauugccggcuucaucgaagggggauggaccggcaugguggacgggugguacggauaucaucaccagaaugaacaaggcuccggcuacgcugcggaucugaaaucuacacagaacgccaucgacgagauuaccaauaaggucaacagcgugaucgagaaaaugaauacgcaguuuacagcuguugggaaggaguucaaccaccuugaaaagcggauugaaaaucugaacaaaaagguggaugacggauuccucgauaucuggaccuacaaugccgagcugcugguccuccuggaaaacgagcgcacccuugacuaucaugauuccaaugugaaaaaccuguacgagaaggucagaagccagcucaaaaacaaugccaaggaaauuggcaacggguguuuugaguucuaucacaagugcgacaauacauguauggaaucugugaaaaacggaaccuacgauuaucccaaguacuccgaggaagcuaaacugaaucgggaggagaucgacggcguuaaacuugaaagcacacgcaucuaucaaauucuggccaucuacucuacgguggcguccagccucguccuggugguuucccugggggcuauuucuuuuuggaugugcagcaacggcucccuccagugcagaaucuguauuuga

SEQ ID NO: 189185 - RNA, 1701 nt, Artificial Sequence
  derived and/or modified sequence opt5 from hemagglutinin__InfluenzaA__ADO29907
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaggaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcagauauuccaagaaacugaagccggagauugcuauccggcccaaaguccgcgaucaggaggggagaaugaauuaccauuggacccugguugaaccuggagacaagauuacguuugaggccacaggcaaccucguggugccccgguaugcguucgccauggaacgcaacgcugggagcggaaucauuaucucugauaccccuguccacgacugcaauacaaccugucaaacccccaaaggcgccaucaacacaucccugccguuucagaauauucauccuaucacgauuggcaagugccccaaguacgugaaaagcaccaaacuuagacuggcuacagggcuccggaacguuccuucuauccagagccgcggacuguucggcgccauugccggguuuaucgagggaggcuggaccgggaugguggacggaugguauggcuaccaccaccagaaugaacaaggcuccggguaugcugcggaucuuaagucuacacagaacgccaucgacgagauuaccaauaaggucaacagcgugaucgagaaaaugaauacgcaguucacagcuguuggaaaggaauuuaaccaucuggagaagagaauugaaaaucucaacaaaaagguggaugacggcuuccuggauaucuggaccuacaaugccgagcugcucguccugcuugaaaacgagcggacccuggacuaccacgauuccaaugugaaaaaccucuaugagaagguccgcagccagcugaaaaacaaugccaaggaaauugggaacggauguuucgaguuuuaccauaagugcgacaauacauguauggaaucugugaaaaacggcaccuaugauuaccccaaguauuccgaggaagcuaaacuuaauagagaggagaucgacgggguuaagcuggaaagcacacggaucuaccaaauucucgccaucuauucuacgguggcguccagccugguccuggugguuucccucggcgcuauuucuuucuggaugugcagcaacggaucccugcagugccgcaucuguauuuga

SEQ ID NO: 189186 - RNA, 1701 nt, Artificial Sequence
  derived and/or modified sequence opt5 from hemagglutinin__InfluenzaA__ADO29908
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaggagcugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcagauauuccaagaaauuuaagccggagauugcuauccggcccaaaguccgcgaucaggaguggagaaugaauuacuauuggacccugguugaaccuggggacaagauuacguucgaggccacaggaaaccugguggugccccgguacgcguuugccauggaacgcaacgcuggcagcgggaucauuaucucugauaccccuguccaugacugcaauacaaccugucaaacccccaaaggagccaucaacacaucccucccguuccagaauauucacccuaucacgauuggcaagugccccaaguaugugaaaagcaccaagcugagacuugcuacaggccugcggaacguuccuucuauccagagccgcgggcucuuuggagccauugccggcuucaucgaagggggauggaccggcaugguggacgggugguacggauaucaucaccagaaugaacaaggcuccggcuacgcugcggaucugaaaucuacacagaacgccaucgacgagauuaccaauaaggucaacagcgugaucgagaaaaugaauacgcaguuuacagcuguugggaaggaguucaaccaccuugaaaagagaauugaaaaucugaacaaaaagguggaugacggauuccucgauaucuggaccuacaaugccgagcugcugguccuccuggaaaacgagcggacccuugacuaucaugauuccaaugugaaaaaccuguacgagaagguccgcagccagcucaaaaacaaugccaaggaaauuggcaacggguguuuugaguucuaucacaagugcgacaauacauguauggaaucugugaaaaacggaaccuacgauuaucccaaguacuccgaggaagcuaaacugaauagagaggagaucgacggcguuaaacuugaaagcacacggguguaucaaauccuggccacguacucuaccgucgcguccagccucgugcugguugugucccugggggcuauuucuuuuuggaugugcagcaacggcucccuccagugccgcaucuguauuuga

SEQ ID NO: 189187 - RNA, 1701 nt, Artificial Sequence
  derived and/or modified sequence opt5 from hemagglutinin__InfluenzaA__ADO29909
augaaggccauccuggugguccuccuguacaccuucgcuacagccaacgcggacacgcuuagaauuggcuaucacgcuaauaacagcaccgauacaguugacaccgugcuggagaagaaugugacagucacccauuccgugaaccuccuggaagauaagcacaaugggaaacuuugcaagcugcggggaguugcuccccuccaucugggcaaauguaacaucgccggguggauucugggaaauccugagugcgaaucucucagcacagccuccucuuggagcuacaucguggagaccuccucuagcgacaacggcacguguuauccgggggauuuuauugacuacgaagaacugcgcgagcagcuuuccagcgucucuuccuucgaaagauuugagaucuuccccaagaccagcucuuggccuaaucacgaucccaacaagggagugacagccgcuugcccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagccgguauuccaagaaauuuaagccggagauugcuauccgccccaaagucagagaucaggaggggcggaugaauuacuauuggacccugguugaaccuggagacaagauuacguucgaggccacaggcaaccugguggugccccgcuacgcguuugccauggaaagaaacgcugggagcggaaucauuaucucugauaccccuguccaugacuguaauacaaccugccaaacccccaaaggcgccaucaacacaucccucccguuccagaauauucacccuaucacgauuggcaagugucccaaguaugugaaaagcaccaagcugcggcuugcuacagggcugcgcaacguuccuucuauccagagcagaggacucuuuggcgccauugccggguucaucgagggaggcuggaccgggaugguggacggaugguacggcuaucaucaccagaaugaacaaggcuccggguacgcugcggaucugaaaucuauccagaacgccauugacgagaucacaaauaaggucaacagcgugauugagaaaaugaauacccaguuuacggcuguuggaaaggaguucaaccaccuugagaagcggaucgaaaaucugaacaaaaagguggaugacggcuuccucgauauuuggacauacaaugccgagcugcugguccuccuggaaaacgagcgcacccuugacuaucaugauuccaaugugaaaaaccuguacgagaaggucagaagccagcucaaaaacaaugccaaggaaaucgggaacggaugcuuugaguucuaucacaagugugacaauaccugcauggaaucugugaaaaacggcacauacgauuaucccaaguacuccgaggaagcuaaacugaaucgggaggagaucgacgggguuaaacuugaaagcacccgcauuuaucaaauccuggccauuuacucuacaguggcguccagccucauccuggucgugucccugggcgcuauuucuuuuuggauguguagcaacggaucccuccagugcagaaucugcauuuga

SEQ ID NO: 189188 - RNA, 1701 nt, Artificial Sequence
  derived and/or modified sequence opt5 from hemagglutinin__InfluenzaA__ADO29910
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcccagaggaguugccccucugcaucucggcaaaugcaacaucgccggguggauucugggaaauccggagugugaaucucugagcacagcuuccucuuggagcuacaucguggagaccuccucuagcgacaacggcacgugcuaucccggggauuuuauugacuacgaagaacuccgggagcagcuguccagcgucucuuccuucgaacgcuuugagaucuucccuaagaccagcucuuggcccaaucacgauccuaacaagggagugacagccgcuuguccccaugccggcgcgaaauccuuuuauaagaaucuuaucuggcugguuaaaaagggcaacagcuacccuaaacucucuaaguccuauauuaaugacaaggggaaagaagugcugguccuuuggggaauccaccacccgagcaccuccgccgaucaacagucucuguaccagaacgcugacgccuacguguucgugggcacaagcagauauuccaagaaauuuaagcccgagauugcuauccggccuaaaguccgcgaucaggaggggagaaugaauuacuauuggacccucguugaacccggagacaagauuacguucgaggccaucggcaaccugguggugccucgguacgcguuugccauggaacgcaacgcugggagcggaauuaucaucucugauacacccguccaugacugcaauaccacaugucaaaccccgaaaggcgccauuaacaccucccugccuuuccagaauauccaccccauuacaaucggcaagugcccuaaguaugugaaaagcacgaagcucagacuggcuaccgggcuucggaacguucccucuauucagagccgcggacuguuuggcgccaucgccggguucaucgagggaggcuggacagggaugguggacggaugguacggcuaucaucaccagaaugaacaaggcuccggguacgcugcggaucucaaaucuacccagaacgccauugacgagaucacaaauaaggucaacagcgugauugagaaaaugaauacccaguuuacggcuguuggaaaggaguucaaccaccuggagaagagaaucgaaaaucuuaacaaaaagguggaugacggcuuccuggauauuuggacauacaaugccgagcuccugguccugcucgaaaacgagcggacccuggacuaucaugauuccaaugugaaaaaccuuuacgagaagguccgcagccagcugaaaaacaaugccaaggaaaucgggaacggauguuuugaguucuaucacaagugcgacaauaccuguauggaaucugugaaaaacggcacauacgauuaucccaaguacuccgaggaagcuaaacucaauagaggggagaucgacggcguuaagcuggagagcacccggauuuaucaaauccuugccauuuacucuacaguggcguccagccugguccucgugguuucccugggagcuaucucuuuuuggaugugcagcaacggcucccugcagugccgcauuuguaucuga

SEQ ID NO: 189189 - RNA, 1701 nt, Artificial Sequence; identical to SEQ ID NO: 187415
  derived and/or modified sequence opt5 from hemagglutinin__InfluenzaA__ADO30407

SEQ ID NO: 189190 - RNA, 1701 nt, Artificial Sequence; identical to SEQ ID NO: 187306
  derived and/or modified sequence opt5 from hemagglutinin__InfluenzaA__ADO30417

SEQ ID NO: 189191 - RNA, 1701 nt, Artificial Sequence; identical to SEQ ID NO: 187028
  derived and/or modified sequence opt5 from hemagglutinin__InfluenzaA__ADO33202

SEQ ID NO: 189192 - RNA, 1701 nt, Artificial Sequence; identical to SEQ ID NO: 186536
  derived and/or modified sequence opt5 from hemagglutinin__InfluenzaA__ADO33240

SEQ ID NO: 189193 - RNA, 1701 nt, Artificial Sequence; identical to SEQ ID NO: 185693
  derived and/or modified sequence opt5 from hemagglutinin__InfluenzaA__ADO33247

SEQ ID NO: 189194 - RNA, 1701 nt, Artificial Sequence; identical to SEQ ID NO: 186536
  derived and/or modified sequence opt5 from hemagglutinin__InfluenzaA__ADO33254

SEQ ID NO: 189195 - RNA, 1701 nt, Artificial Sequence; identical to SEQ ID NO: 186536
  derived and/or modified sequence opt5 from hemagglutinin__InfluenzaA__ADO33261

SEQ ID NO: 189196 - RNA, 1701 nt, Artificial Sequence; identical to SEQ ID NO: 186536
  derived and/or modified sequence opt5 from hemagglutinin__InfluenzaA__ADO33269

SEQ ID NO: 189197 - RNA, 1701 nt, Artificial Sequence; identical to SEQ ID NO: 187028
  derived and/or modified sequence opt5 from hemagglutinin__InfluenzaA__ADO33277

SEQ ID NO: 189198 - RNA, 1701 nt, Artificial Sequence; identical to SEQ ID NO: 186536
  derived and/or modified sequence opt5 from hemagglutinin__InfluenzaA__ADO33285

SEQ ID NO: 189199 - RNA, 1701 nt, Artificial Sequence; identical to SEQ ID NO: 187028
  derived and/or modified sequence opt5 from hemagglutinin__InfluenzaA__ADO33293

SEQ ID NO: 189200 - RNA, 1701 nt, Artificial Sequence; identical to SEQ ID NO: 187028
  derived and/or modified sequence opt5 from hemagglutinin__InfluenzaA__ADO33307

SEQ ID NO: 189201 - RNA, 1701 nt, Artificial Sequence; identical to SEQ ID NO: 186536
  derived and/or modified sequence opt5 from hemagglutinin__InfluenzaA__ADO33313

SEQ ID NO: 189202 - RNA, 1701 nt, Artificial Sequence; identical to SEQ ID NO: 188786
  derived and/or modified sequence opt5 from hemagglutinin__InfluenzaA__ADO33329

SEQ ID NO: 189203 - RNA, 1701 nt, Artificial Sequence; identical to SEQ ID NO: 186536
  derived and/or modified sequence opt5 from hemagglutinin__InfluenzaA__ADO33337

SEQ ID NO: 189204 - RNA, 1701 nt, Artificial Sequence; identical to SEQ ID NO: 186536
  derived and/or modified sequence opt5 from hemagglutinin__InfluenzaA__ADO33345

SEQ ID NO: 189205 - RNA, 1701 nt, Artificial Sequence; identical to SEQ ID NO: 187028
  derived and/or modified sequence opt5 from hemagglutinin__InfluenzaA__ADO33352

SEQ ID NO: 189206 - RNA, 1701 nt, Artificial Sequence; identical to SEQ ID NO: 185693
  derived and/or modified sequence opt5 from hemagglutinin__InfluenzaA__ADO33360

SEQ ID NO: 189207 - RNA, 1701 nt, Artificial Sequence; identical to SEQ ID NO: 186536
  derived and/or modified sequence opt5 from hemagglutinin__InfluenzaA__ADO33368

SEQ ID NO: 189208 - RNA, 1701 nt, Artificial Sequence; identical to SEQ ID NO: 186536
  derived and/or modified sequence opt5 from hemagglutinin__InfluenzaA__ADO33376

SEQ ID NO: 189209 - RNA, 1701 nt, Artificial Sequence; identical to SEQ ID NO: 185680
  derived and/or modified sequence opt5 from hemagglutinin__InfluenzaA__ADO33384

SEQ ID NO: 189210 - RNA, 1701 nt, Artificial Sequence; identical to SEQ ID NO: 185693
  derived and/or modified sequence opt5 from hemagglutinin__InfluenzaA__ADO33391

SEQ ID NO: 189211 - RNA, 1701 nt, Artificial Sequence
  derived and/or modified sequence opt5 from hemagglutinin__InfluenzaA__ADO79917
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgauagagaggggcggaugaauuacuauuggacccugguugaacccggagacaagauuacguucgaggccacaggcaaccugguggugccucgcuacgcguuugccauggaaagaaacgcugggucuggaaucauuaucuccgauacccccguccauaauugcaacacaaccugucagaccccuaaaggcgccaucaauacaagccuccccuuccaaaacauucacccgaucacgauuggcaagugcccuaaguaugugaaaucuaccaagcugcggcuugcuacagggcugcgcaauguucccagcauccaguccagaggacucuuuggcgccauugccggguucaucgagggaggcuggaccgggaugguggacggaugguacggcuaucaucaccagaacgaacagggcucuggguacgcugcggaccugaaaagcacacaaaaugccaucgaugagauuaccaacaaggucaauuccgugaucgagaaaaugaacacgcaguuuacagcuguuggaaaggaguucaaucaccuugagaagcggauugaaaaccugaauaaaaagguggacgauggcuuccucgacaucuggaccuacaacgccgagcugcugguccuccuggaaaaugagcgcacccuugauuaucaugacagcaacgugaaaaaccuguacgagaaggucagaucucagcucaaaaauaacgccaaggaaauugggaauggauguuuugaguucuaucacaagugcgauaacacauguauggaauccgugaaaaauggcaccuacgacuauccuaaguacagcgaggaagcuaaacugaaccgggaggagaucgaugggguuaaacuugaaucuacacgcaucuaucagauucuggccaucuacuccacgguggcgagcucccucguccuggugguuucucugggcgcuauuagcuuuuggaugugcuccaauggaucucuccaaugcagaaucuguauuuga

SEQ ID NO: 189212 - RNA, 1701 nt, Artificial Sequence
  derived and/or modified sequence opt5 from hemagglutinin__InfluenzaA__ADO79923
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuacggacaaguggaccugcuauccgggcgauuuuauugacuacgaggaacugcgggagcagcuuagcuccgucagcucuuucgaacgcuuugagaucuuccccaagacauccagcuggccuaaccacgauucuaauaaaggggugaccgccgcuuguccccaugccggagcgaaguccuuuuauaaaaaccugaucuggcucguuaagaaaggcaauagcuacccuaagcugucuaaguccuauauuaacgacaaaggcaaggaagugcuuguccugugggggauccaccaccccagcacauccgccgaucaacagucucucuaccagaaugcugacgccuacguguucgugggaaccagcagauauuccaaaaaguuuaaaccugagauugcuauccggccgaagguccgcgaucaggagagacggaugaacuacuauuggacgcugguucaacccggcgacaaaauuacauuccaggccaccgggaaucugguggugccucgcuacgcguuugccauggaaagaaacgcuggaagcggcaucauuaucucugauacacccguccauaacugcaauaccaccugucagacaccuaagggggccaucaacacgucccuccccuuccagaauauucacccgaucaccauuggaaagugcccuaaauauguuaagagcacaaaacugcggcuugcuaccggccugcgcaacgugcccucuauccaaagcagaggccucuuuggggccauugccggauucaucgagggcggguggacaggaaugguggacggcugguacggguaucaucaccagaaugaacagggauccggcuacgcugcggaccugaagucuacccagaacgccaucgaugagauuacgaauaaagucaacagcgugaucgaaaagaugaauacacaauuuaccgcuguuggcaaggaguucaaccaccuugagaaacggauugaaaaucugaacaagaaaguggacgauggguuccucgacaucuggaccuacaaugccgagcugcugguccuccuggaaaacgagcgcacacuugauuaucaugacuccaaugugaagaaccuguacgaaaaagucagaagccagcucaagaacaaugccaaggagauuggaaacggcuguuuugaguucuaucacaaaugcgauaauaccuguauggaaucugugaagaacgggacauacgacuauccuaaauacuccgaggaagcuaagcugaaucgggaggaaaucgauggaguuaaacuugagagcacgcgcaucuaucagauucuggccaucuacucuaccguggcguccagccucguccuggugguuucccugggcgcuauuucuuuuuggaugugcagcaacgggucccuccaaugcagaaucuguauuuga

SEQ ID NO: 189213 - RNA, 1701 nt, Artificial Sequence
  derived and/or modified sequence opt5 from hemagglutinin__InfluenzaA__ADO79924
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuacggacaaguggaccugcuauccgggcgauuuuauugacuacgaggagcugcgggagcagcuuagcuccgucagcucuuucgaacgcuuugagaucuuccccaagacauccagcuggccuaaccacgauucuaauaaaggggugaccgccgcuuguccccaugccggagcgaaguccuuuuauaaaaaccugaucuggcucguuaagaaaggcaauagcuacccuaagcugucuaaguccuauauuaacgacaaaggcaaggaagugcuuguccugugggggauccaccaccccagcacauccgccgaucaacagucucucuaccagaaugcugacgccuacguguucgugggaaccagcagauauuccaaaaaguuuaaaccugagauugcuauccggccgaagguccgcgauagagagggccggaugaacuacuauuggacgcugauugaacccggggacaaaaucacauucgagccuaccggaaaucugguugugccccgcuacgccuuugcgauggaaagaaacgccggcagcgggauuaucaucucugauacaccugugcauaacugcaauaccaccugucagacacccaagggagcuauuaacacgucccucccguuccaaaauauccacccuauuaccaucggcaagugccccaaauaugucaagagcacaaaacugcggcuugccaccggccugcgcaacgugccuucuauucagagcagagggcucuuuggagcuaucgccggcuucaucgaagggggauggacaggcaugguugacgggugguacggauaucaucaccagaaugaacagggcuccggcuacgccgcugaccugaagucuacccaaaacgcgauugaugagaucacgaauaaagugaacagcgucauugagaagaugaauacacaguuuaccgccguggggaaggaguucaaccaccuugaaaaacggaucgaaaaucugaacaagaaaguugacgauggauuccucgacauuuggaccuacaaugcugagcugcuggugcuccuggaaaacgagcgcacacuugauuaucaugacuccaaugucaagaaccuguacgagaaagugagaagccagcucaagaacaaugccaaggaaaucggcaacggguguuuugaguucuaucacaaaugcgauaauaccuguauggaaucugucaagaacggaacauacgacuaucccaaauacuccgaggaagccaagcugaaucgggaggagaucgauggcgugaaacuugaaagcacgcgcauuuaucagauccuggcuauuuacucuaccguugccuccagccucgugcuggucgugucccugggggcgaucucuuuuuggaugugcagcaacggcucccuccaaugcagaauuuguaucuga

SEQ ID NO: 189214 - RNA, 1701 nt, Artificial Sequence
  derived and/or modified sequence opt5 from hemagglutinin__InfluenzaA__ADO79925
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuacgcacgaauggaccugcuauccgggcgacuuuauugauuacgaggagcugcgggaacagcuuagcuccgucagcucuuucgagcgcuuugaaaucuuccccaagacauccagcuggccuaaccaugacucuaauaagggggugaccgccgcuuguccccacgccggagcgaaauccuuuuauaagaaccugaucuggcucguuaaaaagggcaauagcuacccuaaacugucuaaguccuauauuaacgauaagggcaaagaggugcuuguccugugggggauccaccaucccagcacauccgccgaccaacagucucucuaccagaaugcugaugccuacguguucgugggaaccagcagauauuccaagaaauuuaagccugagauugcuauccggccgaaaguccgcgacagagaaggccggaugaacuacuauuggacgcugguugagcccggggauaagauuacauucgaagccccuggaaaucugguggugccccgcuacgcguuugccauggagagaaacgcuggcagcgggaucauuaucucugacaccccuguccacaacugcaauacaaccugucagacccccaaaggagccaucaacacaucccucccguuccaaaauauucauccuaucaagauuggcaagugcagcaaauaugugaagucuacgaaacugcggcuugcuaccggccugcgcaacguucccagcauccaguccagagggcucuuuggagccauugccggcuucaucgaagggggauggacaggcaugguggaugggugguacggauaucaccaccagaaugagcagggcucuggcuacgcugcggaccuuaagagcacccaaaacgccaucgacgagauuacaaauaaagucaacuccgugaucgaaaagaugaauacccaguuuacggcuguugggaaggaguucaaccaucuggaaaaacggauugagaaucugaacaagaaaguggaugacggauuccucgauaucuggacauacaaugccgaacugcugguccuccuggagaacgagcgcacccuugacuaucacgauagcaaugugaagaaccuguacgaaaaagucagaucucagcucaagaacaaugccaaggagauuggcaacggguguuuugaguucuaucauaaaugcgacaauaccuguauggaauccgugaagaacggaacauacgauuauccuaaauacagcgaagaggcuaagcugaaucgggaggaaaucgacggcguuaaacuugagucuacccgcaucuaucagauucuggccaucuacuccacaguggcgagcucccucguccuggugguuucucugggggcuauuagcuuuuggaugugcuccaacggcucucuccaaugcagaaucuguauuuga

SEQ ID NO: 189215 - RNA, 1701 nt, Artificial Sequence
  derived and/or modified sequence opt5 from hemagglutinin__InfluenzaA__ADO79926
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuacggacaaguggaccugcuauccgggcgauuuuauugacuacgaggagcugcgggagcagcuuagcuccgucagcucuuucgaacgcuuugagaucuuccccaagacauccagcuggccuaaccacgauucuaauaaaggggugaccgccgcuuguccccaugccggagcgaaguccuuuuauaaaaaccugaucuggcucguuaagaaaggcaauagcuucucuaagcuguccaagacauaccuuaacgacaaaggcaaggaagugcugguccucugggggauucaccacccuagcaccuccgccgaucaacagucucuguaucagaaugcugacgccuacguguuugugggaacgagcagauacuccaaaaaguucaaacccgagaucgcuauucggccuaagguccgcgaucaggagggcagaaugaacuauuacuggacacugguugaaccgggggacaaaaucaccuuugaggccacaggaaaucucguggugccccgguaugcguucgccauggaacgcaacgucggcagcgggauuaucauuucugauaccccugugcaugacugcaacaccacaugucaaacgcccaagggagcuaucaauaccucccugccuuuucagaacauccaccccauuacaaucggcaagugcccgaaauacguuaagagcaccaaacuuagacuggccacaggccuccggaaugugccuucuauucagagccgcgggcuguucggagcuaucgccggcuuuauugaagggggauggaccggcauggucgacgggugguauggauaccaucaccagaacgaacaaggcuccggcuaugccgcugaucuuaagucuacgcagaaugcgaucgacaaaaucacaaacaaggugaauagcguuauugagaagaugaacacccaguucaccgccguggggaaagaguucaaucaccuggaaaagagaaucgagaaccucaauaaaaaggucgaugacggauuucuggauauuuggacauacaacgcugaacugcucgugcugcuugagaaugaacggacccuggacuaccaugauuccaacgucaaaaaucucuaugagaaggugcgcagccagcugaagaacaacgccaaagagaugaagaauggcuguuucgaauuuuaccacaaaugcgacaacacauguauggagucuguuaagaaugggacguaugauuaccccaaauauuccgaagaggccaaacuuaacagagaagagaucgacggagugaagcuggagagcacccggauuuaccaaauccucgcuaucuauucuacagucgccuccagccuggugcugguugugucccucggcgcgauuucuuucuggaugugcagcaaugggucccugcagugccgcaucuguauuuga

SEQ ID NO: 189216 - RNA, 1701 nt, Artificial Sequence
  derived and/or modified sequence opt5 from hemagglutinin__InfluenzaA__ADO79927
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuacggacaaguggaccugcuauccgggcgauuuuauugacuacgaagaacugcgggagcagcuuagcuccgucagcucuuucgaacgcuuugagaucuuccccaagacauccagcuggccuaaccacgauucuaauaaaggggugaccgccgcuuguccccaugccgcggccaaguccuuuuauaaaaaccugaucuggcucguuaagaaaggaaauagcuacccuaagcugucuaaguccuauauuaacgacaaaggcaaggaagugcuuguccuguggggcauccaccaccccagcacauccgcugaucaacagucucucuaccagaaugccgacgcuuacguguucguggggaccagcagauauuccaaaaaguuuaaaccugagauugccauccggccgaagguccgcgaucaggagggaagaaugaacuacuauuggacgcugguugaacccggcgacaaaauuacauucgaggcgaccgggaaucugguggugccucgguacgccuuugcuauggaacgcaacgccggaagcggcaucauuaucucugauacacccguccaugacugcaacaccaccugucaaacaccuaagggggcuaucaauacgucccuccccuuccagaacauucacccgaucaccauuggaaagugcccuaaauauguuaagagcacaaaacugagacuugccaccggccugcggaauauccccucugugcagagccgcggccucuuuggggccauugcuggauucaucgagggcggguggacaggaaugguggacggcugguacggguaucaucaccagaacgaacaaggauccggcuacgcggccgaucugaagucuacccagaaugcuaucgacaaaauuacgaacaaggucaauagcgugaucgagaagaugaacacacaguuuaccgccguuggcaaagaguucaaucaccuugaaaagagaauugagaaccugaauaaaaagguggaugacggguuccucgauaucuggaccuacaacgccgaacugcugguccuccuggagaaugaacggacacuugacuaucaugauuccaacgugaaaaaucuguacgagaagguccgcagccagcucaagaacaacgcuaaagagaugaagaauggauguuuugaguucuaucacaaaugcgacaacaccuguauggagucugugaagaauggcacauacgauuauccuaaauacuccgaagaggccaagcugaacagagaagagauugacgggguuaaacuugagagcacgcggaucuaucaaauccuggcgauuuacucuaccguggcuuccagccucguccuggugguuucccugggagccaucucuuuuuggaugugcagcaauggcucccuccagugccgcauuuguaucuga

SEQ ID NO: 189217 - RNA, 1701 nt, Artificial Sequence
  derived and/or modified sequence opt5 from hemagglutinin__InfluenzaA__ADO79928
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuacggacaaguggaccugcuauccgggcgauuuuauugacuacgaggagcugcgggagcagcuuagcuccgucagcucuuucgaacgcuuugagaucuuccccaagacaaacuccuggccuaaucacgauagcaacaaaggggugaccgccgcuuguccccaugccggagcgaagucuuuuuauaaaaaucugaucuggcucguuaagaaaggcaacuccuacccuaagcugagcaagucuuauauuaaugacaaaggcaaggaagugcuuguccugugggggauccaccaccccuccacaagcgccgaucaacagucccucuaccagaacgcugacgccuacguguucgugggaaccucuaaauauagcaagaaauuuaagccugagauugcuaucagaccgaaaguccgggaucaggagggccgcaugaauuacuauuggacgcugguugaacccggggacaagauuacauucgaggccaccggaaaccugguggugccuagauacgcguuugccauggaacggaacgcuggcuccgggaucauuaucagcgauacacccguccaugacugcaauaccaccugucaaacaccuaagggagccaucaacacgucucuccccuuccagaauauucacccgaucaccauuggcaaaugcccuaaguaugugaaauccacaaagcugcgccuugcuaccggccugagaaacguucccagcauccagucucgggggcucuuuggagccauugccggcuucaucgaagggggauggacaggcaugguggacgggugguacggauaucaucaccagaaugaacaaggcagcggcuacgcugcggaucugaaauccacccagaacgccaucgacgagauuacgaauaaggucaacucugugaucgagaagaugaauacacaguuuaccgcuguugggaaagaguucaaccaccuugaaaagcgcauugaaaaucugaacaaaaagguggaugacggauuccucgauaucuggaccuacaaugccgagcugcugguccuccuggaaaacgagagaacacuugacuaucaugauagcaaugugaaaaaccuguacgagaagguccggucccagcucaagaacaaugccaaagaaauuggcaacggguguuuugaguucuaucacaagugcgacaauaccuguauggaaagcgugaaaaacggaacauacgauuauccuaaguacucugaggaagcuaaacugaaucgcgaggagaucgacggcguuaaacuugaauccacgagaaucuaucaaauucuggccaucuacagcaccguggcgucuucccucguccuggugguuagccugggggcuauuuccuuuuggaugugcucuaacggcagccuccagugccggaucuguauuuga

SEQ ID NO: 189218 - RNA, 1701 nt, Artificial Sequence
  derived and/or modified sequence opt5 from hemagglutinin__InfluenzaA__ADO79929
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuacggacaaguggaccugcuauccgggcgauuuuauugacuacgaagaacugcgggagcagcuuagcuccgucagcucuuucgaacgcuuugagaucuuccccaagacauccagcuggccuaaccacgauucuaauaaaggggugaccgccgcuuguccccaugccggagcgaaguccuuuuauaaaaaccugaucuggcucguuaagaaaggcaauagcuacccuaagcugucuaaguccuauauuaacgacaaaggcaaggaagugcuuguccugugggggauccaccaccccagcacauccgccgaucaacagucucucuaccagaaugcugacgccuacguguucgugggaaccagcagauauuccaaaaaguuuaaaccugagauugcuauccggccgaagguccgcggccaggaggggagaaugaacuacuauuggacgcugguugaacccggagauaaaauuacauucgaggccaccggcaaucugguggugccucgguacgcguuugccauggaacgcaacgcugggagcggaaucauuaucucugacacacccguccaugauugcaacaccaccugucaaacaccuaagggcgccaucaauacgucccuccccuuccagaacauucacccgaucaccauuggcaagugcccuaaauauguuaagagcacaaaacugagacuugcuaccgggcugcggaauauccccucuauucagagccgcggacucuuuggcgccaucgccggguucaucgagggaggcuggacagggaugguggacggaugguacggcuaucaucaccagaacgaacaaggcuccggguacgcugcggaccugaagucuacccagaaugccauugaugagaucacgaacaaagugaauagcgucauugagaagaugaacacacaguuuaccgcugugggaaaggaguucaaucaccuugagaaaagaaucgaaaaccugaauaagaaaguugacgauggcuuccucgacauuuggaccuacaacgccgagcugcuggugcuccuggaaaaugagcggacacuugauuaucaugacuccaacgucaagaaucuguacgagaaagugcgcagccagcucaagaacaacgccaaggaaaucgggaauggauguuuugaguucuaucacaaaugcgauaacaccuguauggaaucugucaagaauggcacauacgacuauccuaaauacuccgaggaagcuaagcugaacagagaggagaucgauggggugaaacuugaaagcacgcggauuuaucaaauccuggccauuuacucuaccguugcguccagccucgugcuggucgugucccugggcgcuaucucuuuuuggaugugcagcaauggaucccuccagugccgcauuuguaucuga

SEQ ID NO: 189219 - RNA, 1701 nt, Artificial Sequence
  derived and/or modified sequence opt5 from hemagglutinin__InfluenzaA__ADO79930
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuacggacaaguggaccugcuauccgggcgauuuuauugacuacgaggagcugcgggagcagcuuagcuccgucagcucuuucgaacgcuuugagaucuuccccaagacauccagcuggccuaaccacgauucuaauaaaggggugaccgccgcuuguccccaugccggagcgaaguccuuuuauaaaaaccugaucuggcucguuaagaaaggcaauagcuacccuaagcugucuaaguccuauauuaacgacaaaggcaaggaagugcuuguccugugggggauccaccaccccagcacauccgccgaucaacagucucucuaccagaaugcugacgccuacguguucgugggaaccagcagauauuccaaaaaguuuaaaccugagauugcuauccggccgaagguccgcgauagagagggccggaugaacuacuauuggacgcugguugaacccggggacaaaauuacauucgaggccaccggaaaucugguggugccucgcuacgcguuugccauggaaagaaacgcuggcagcgggaucauuaucucugauacacccguccauaacugcaauaccaccugucagacaccuaagggagccaucaacacgucccuccccuuccaaaauauucacccgaucaccauuggcaagugcccuaaauauguuaagagcacaaaacugcggcuugcuaccggccugcgcaacgugcccucuauccagagcagagggcucuuuggagccauugccggcuucaucgaagggggauggacaggcaugguggacgggugguacggauaucaucaccagaaugaacagggcuccggcuacgcugcggaccugaagucuacccaaaacgccaucgaugagauuacgaauaaagucaacagcgugaucgagaagaugaauacacaguuuaccgcuguugggaaggaguucaaccaccuugaaaaacggauugaaaaucugaacaagaaaguggacgauggauuccucgacaucuggaccuacaaugccgagcugcugguccuccuggaaaacgagcgcacacuugauuaucaugacuccaaugugaagaaccuguacgagaaagucagaagccagcucaagaacaaugccaaggaaauuggcaacggguguuuugaguucuaucacaaaugcgauaauaccuguauggaaucugugaagaacggaacauacgacuauccuaaauacuccgaggaagcuaagcugaaucgggaggagaucgauggcguuaaacuugaaagcacgcgcaucuaucagauucuggccaucuacucuaccguggcguccagccucguccuggugguuucccugggggcuauuucuuuuuggaugugcagcaacggcucccuccaaugcagaaucuguauuuga

SEQ ID NO: 189220 - RNA, 1701 nt, Artificial Sequence
  derived and/or modified sequence opt5 from hemagglutinin__InfluenzaA__ADO84715
augaaggccauccuggugguccuccuguacaccuucgcuacagccaacgcgggcacgcuuugcauuggguaucacgcuaauaacagcaccgacacaguugauaccgugcuggagaagaaugugacagucacccauuccgugaaccuccuggaagacaagcacaauggaaaacuuuguaagcugagaggcguugcuccccuccaucuggggaaaugcaacaucgccggauggauucugggcaauccugagugugaaucucucagcacagccuccucuuggagcuacaucguggagaccuuuuccucugauaacgggacgugcuauccgggagacuucauugauuacgaagaacugcgggagcagcuuagcuccgucagcucuuuugaacgcuucgagaucuuucccaagaccuccagcuggccuaaucacgacucuaacaagggcgugacagccgcuuguccccaugccggcgcgaaauccuucuauaagaaucugaucuggcucguuaaaaaggggaacagcuacccuaaacugucuaaguccuauauuaaugauaagggaaaagaagugcuuguccuguggggcauccaccaccccagcaccuccgccgaccaacagucucucuaccagaacgcugaugccuacguguuuguggggacaagcagauauuccaagaaauucaagccugagauugcuauccggccgaaaguccgcgaccaggagggaagaaugaauuacuauuggacccugguugaacccggcgauaagauuacguuugaggccacagggaaccugguggugccucgguacgcguucgccauggaacgcaacgcuggaagcggcaucauuaucucugacacccccguccaugauugcaauacaaccugucaaaccccuaaaggcgccaucaacacaucccuccccuuucagaauauucacccgaucacgauugggaagugcccuaaguaugugaaaagcaccaagcugagacuugcuacaggacugcggaacguucccucuauccagagccgcggccucuucggggccauugccggauuuaucgagggcggguggaccggaaugguggacggcugguacggcuaucaucaccagaaugaacaaggguccggauacgcugcggaccugaaaucuacacagaacgccaucgaugagauuaccaauaaggucaacagcgugaucgagaaaaugaauacgcaguucacagcuguuggcaaggaguucaaccaccuugagaagagaauugaaaaucugaacaaaaagguggacgauggguuucucgacaucuggaccuacaaugccgagcugcugguccuccuggaaaacgagcggacccuugauuaucaugacuccaaugugaaaaaccuguacgagaagguccgcagccagcucaaaaacaaugccaaggaaauuggaaacggcuguuucgaguuuuaucacaagugcgauaauacauguauggaaucugugaaaaacgggaccuacgacuauccuaaguacuccgaggaagcuaaacugaauagagaggagaucgauggcguuaaacuugaaagcacacggaucuaucaaauucuggccaucuacucuacgguggcguccagccucguccuggugguuucccugggagcuauuucuuucuggaugugcagcaacggcucccuccagugccgcaucuguauuuga

SEQ ID NO: 189221 - RNA, 1701 nt, Artificial Sequence; identical to SEQ ID NO: 185873
  derived and/or modified sequence opt5 from hemagglutinin__InfluenzaA__ADP95341

SEQ ID NO: 189222 - RNA, 1701 nt, Artificial Sequence; identical to SEQ ID NO: 185680
  derived and/or modified sequence opt5 from hemagglutinin__InfluenzaA__ADP95351

SEQ ID NO: 189223 - RNA, 1701 nt, Artificial Sequence; identical to SEQ ID NO: 185680
  derived and/or modified sequence opt5 from hemagglutinin__InfluenzaA__ADP95361

SEQ ID NO: 189224 - RNA, 1701 nt, Artificial Sequence; identical to SEQ ID NO: 185680
  derived and/or modified sequence opt5 from hemagglutinin__InfluenzaA__ADP95371

SEQ ID NO: 189225 - RNA, 1701 nt, Artificial Sequence; identical to SEQ ID NO: 185680
  derived and/or modified sequence opt5 from hemagglutinin__InfluenzaA__ADP95381

SEQ ID NO: 189226 - RNA, 1701 nt, Artificial Sequence; identical to SEQ ID NO: 185680
  derived and/or modified sequence opt5 from hemagglutinin__InfluenzaA__ADP95391

SEQ ID NO: 189227 - RNA, 1701 nt, Artificial Sequence; identical to SEQ ID NO: 185935
  derived and/or modified sequence opt5 from hemagglutinin__InfluenzaA__ADQ28007

SEQ ID NO: 189228 - RNA, 1701 nt, Artificial Sequence; identical to SEQ ID NO: 185693
  derived and/or modified sequence opt5 from hemagglutinin__InfluenzaA__ADQ28008

SEQ ID NO: 189229 - RNA, 1701 nt, Artificial Sequence; identical to SEQ ID NO: 187544
  derived and/or modified sequence opt5 from hemagglutinin__InfluenzaA__ADQ28009

SEQ ID NO: 189230 - RNA, 1701 nt, Artificial Sequence
  derived and/or modified sequence opt5 from hemagglutinin__InfluenzaA__ADQ28010
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagagccugaucuggcucguuaaaaagggcaacuccuacccuaaacugagcaaguccuauauuaaugauaaggggaaagaagugcuuguccuguggggaauccaccaccccucuaccagcgccgaccaacagucccucuaccagaacgcugaugccuacguguucgugggcacaagcagauauucuaagaaauuuaagccugagauugcuauccggccgaaaguccgcgaccaggaggggagaaugaauuacuauuggacccugguugaacccggagauaagauuacguucgaggccacaggcaaccugguggugccucgguacgcguuugccauggaacgcaacgcuggguccggaaucauuaucagcgacacccccguccaugauugcaauacaaccugucaaaccccuaaaggcgccaucaacacaucucuccccuuccagaauauucacccgaucacgauuggcaagugcccuaaguaugugaaaagcaccaagcugagacuugcuacagggcugcggaacguucccuccauccagucucgcggacucuuuggcgccauugccggguucaucgagggaggcuggaccgggaugguggacggaugguacggcuaucaucaccagaaugaacaaggcagcggguacgcugcggaccugaaauccacacagaacgccaucgaugagauuaccaauaaggucaacagcgugaucgagaaaaugaauacgcaguuuacagcuguuggaaaggaguucaaccaccuugagaagagaauugaaaaucugaacaaaaagguggacgauggcuuccucgacaucuggaccuacaaugccgagcugcugguccuccuggaaaacgagcggacccuugauuaucaugacucuaaugugaaaaaccuguacgagaagguccgcucccagcucaaaaacaaugccaaggaaauugggaacggauguuuugaguucuaucacaagugcgauaauacauguauggaaagcgugaaaaacggcaccuacgacuauccuaaguacucugaggaagcuaaacugaauagagaggagaucgaugggguuaaacuugaauccacacggaucuaucaaauucuggccaucuacagcacgguggcguccucucucguccuggugguuagccugggcgcuauuuccuuuuggaugugcucuaacggaagccuccagugccgcaucuguauuuga

SEQ ID NO: 189231 - RNA, 1701 nt, Artificial Sequence; identical to SEQ ID NO: 185693
  derived and/or modified sequence opt5 from hemagglutinin__InfluenzaA__ADQ28011

SEQ ID NO: 189232 - RNA, 1701 nt, Artificial Sequence; identical to SEQ ID NO: 185693
  derived and/or modified sequence opt5 from hemagglutinin__InfluenzaA__ADQ28012

SEQ ID NO: 189233 - RNA, 1701 nt, Artificial Sequence; identical to SEQ ID NO: 185693
  derived and/or modified sequence opt5 from hemagglutinin__InfluenzaA__ADQ28013

SEQ ID NO: 189234 - RNA, 1701 nt, Artificial Sequence; identical to SEQ ID NO: 185935
  derived and/or modified sequence opt5 from hemagglutinin__InfluenzaA__ADQ28014

SEQ ID NO: 189235 - RNA, 1701 nt, Artificial Sequence; identical to SEQ ID NO: 185935
  derived and/or modified sequence opt5 from hemagglutinin__InfluenzaA__ADQ28015

SEQ ID NO: 189236 - RNA, 1701 nt, Artificial Sequence; identical to SEQ ID NO: 185693
  derived and/or modified sequence opt5 from hemagglutinin__InfluenzaA__ADQ28016

SEQ ID NO: 189237 - RNA, 1701 nt, Artificial Sequence; identical to SEQ ID NO: 185693
  derived and/or modified sequence opt5 from hemagglutinin__InfluenzaA__ADQ28017

SEQ ID NO: 189238 - RNA, 1701 nt, Artificial Sequence; identical to SEQ ID NO: 187939
  derived and/or modified sequence opt5 from hemagglutinin__InfluenzaA__ADQ28018

SEQ ID NO: 189239 - RNA, 1701 nt, Artificial Sequence; identical to SEQ ID NO: 185935
  derived and/or modified sequence opt5 from hemagglutinin__InfluenzaA__ADQ28019

SEQ ID NO: 189240 - RNA, 1701 nt, Artificial Sequence
  derived and/or modified sequence opt5 from hemagglutinin__InfluenzaA__ADQ28020
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaagccggcgccaagagcuuuuauaaaaaucugaucuggcucguuaagaaaggcaacucuuacccuaagcuguccaaaagcuauauuaaugacaaggggaaggaggugcuuguccuguggggaauccaucaccccuccaccucugccgaucagcagagccucuaccagaacgcugacgccuacguguucgugggcuccagcagauauucuaaaaaguuuaaaccugagauugcuauccggccgaagguccgcgaucaagaagggagaaugaauuacuauuggacacugguugagcccggagacaaaauuaccuucgaagccacgggcaaccugguggugccucgguacgcguuugccauggagcgcaacgcuggguccggaaucauuaucagcgauacacccguccacgacugcaauaccacaugucagaccccuaagggcgccaucaacaccucucuccccuuccauaauauucacccgaucacaauuggcaaaugcccuaaguauguuaagagcacgaaacugagacuugcuaccgggcugcggaacgugcccuccauccagucucgcggacucuuuggcgccauugccggguucaucgaaggaggcuggacagggaugguggacggaugguacggcuaucaucaccagaaugagcaaggcagcggguacgcugcggaucugaaguccacccagaacgccaucgacgagauuacaaauaaagucaacagcgugaucgaaaagaugaauacccaguuuacggcuguuggaaaagaguucaaccaccuugaaaagagaauugagaaucugaacaagaaaguggaugacggcuuccucgauaucuggacauacaaugccgaacugcugguccuccuggagaacgagcggacccuugacuaucaugauucuaaugugaagaaccuguacgaaaaaguccgcucccagcucaagaacaaugccaaagagauugggaacggauguuuugaguucuaucacaagugcgacaauaccuguauggaaagcgugaagaacggcacauacgauuauccuaaauacucugaagaggcuaagcugaauagagaggaaaucgacgggguuaaacuugaguccacccggaucuaucaaauucuggccaucuacagcacaguggcguccucucucguccuggugguuagccugggcgcuauuuccuuuuggaugugcucuaacggaagccuccagugccgcaucuguauuuga

SEQ ID NO: 189241 - RNA, 1701 nt, Artificial Sequence; identical to SEQ ID NO: 186887
  derived and/or modified sequence opt5 from hemagglutinin__InfluenzaA__ADQ28021

SEQ ID NO: 189242 - RNA, 1701 nt, Artificial Sequence
  derived and/or modified sequence opt5 from hemagglutinin__InfluenzaA__ADQ28022
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccggggaauuuuauugauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgggcaggagggaagaaugaacuacuauuggacccugguugaacccggcgacaagauuacguucgaggccacagggaaccugguggugccucgguacgcguuugccauggaacgcaaugcuggaucuggcaucauuaucuccgauacccccguccaugacugcaacacaaccugucaaaccccuaaaggcgccaucaauacaagccuccccuuccagaacauucacccgaucacgauugggaagugcccuaaguaugugaaaucuaccaagcugagacuugcuacaggacugcggaauguucccagcauccagucccgcggccucuuuggggccauugccggauucaucgagggcggguggaccggaaugguggauggcugguacggcuaucaucaccagaacgaacaagggucuggauacgcugcggaccugaaaagcacacagaaugccaucgacgagauuaccaacaaggucaauuccgugaucgagaaaaugaacacgcaguuuacagcuguuggcaaggaguucaaucaccuugagaagagaauugaaaaccugaauaaaaagguggaugacggguuccucgauaucuggaccuacaacgccgagcugcugguccuccuggaaaaugagcggacccuugacuaucaugauagcaacgugaaaaaccuguacgagaagguccgcucucagcucaaaaauaacgccaaggaaauuggaaauggcuguuuugaguucuaucacaagugcgacaacacauguauggaauccgugaaaaaugggaccuacgauuauccuaaguacagcgaggaagcuaaacugaacagagaggagaucgacggcguuaaacuugaaucuacacggaucuaucaaauucuggccaucuacuccacgguggcgagcucccucguccuggugguuucucugggagcuauuagcuuuuggaugugcuccaauggcucucuccagugccgcaucuguauuuga

SEQ ID NO: 189243 - RNA, 1701 nt, Artificial Sequence; identical to SEQ ID NO: 185693
  derived and/or modified sequence opt5 from hemagglutinin__InfluenzaA__ADQ28023

SEQ ID NO: 189244 - RNA, 1701 nt, Artificial Sequence; identical to SEQ ID NO: 185935
  derived and/or modified sequence opt5 from hemagglutinin__InfluenzaA__ADQ28024

SEQ ID NO: 189245 - RNA, 1701 nt, Artificial Sequence; identical to SEQ ID NO: 185935
  derived and/or modified sequence opt5 from hemagglutinin__InfluenzaA__ADQ28025

SEQ ID NO: 189246 - RNA, 1701 nt, Artificial Sequence; identical to SEQ ID NO: 186438
  derived and/or modified sequence opt5 from hemagglutinin__InfluenzaA__ADQ28028

SEQ ID NO: 189247 - RNA, 1701 nt, Artificial Sequence; identical to SEQ ID NO: 187918
  derived and/or modified sequence opt5 from hemagglutinin__InfluenzaA__ADQ28029

SEQ ID NO: 189248 - RNA, 1701 nt, Artificial Sequence
  derived and/or modified sequence opt5 from hemagglutinin__InfluenzaA__ADQ28030
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggaaucacagccgcuuguccccaugccggcgcgaaauccuuuuauaagaaccugauuuggcucgugaaaaagggcaauucuuacccuaaacuguccaagagcuauaucaacgauaaggggaaagaaguucuugugcuguggggcauucaccaccccuccaccucugccgaccaacagagccucuaccagaaugcugaugccuacgucuucgugggaacauccagauauagcaagaaauuuaagccugagaucgcuauucggccgaaagugcgcgaccaggaggggagaaugaacuacuauuggacccuggucgaacccggagauaagaucacguucgaggccacaggcaaccugguugugccucgguacgcguuugccauggaacgcaaugcugggucuggaauuaucaucuccgacacccccgugcaugauugcaacacaaccugucaaaccccuaaaggcgccauuaauacaagccuccccuuccagaacauccacccgauuacgaucggcaagugcccuaaguaugucaaaucuaccaagcugagacuugcuacagggcugcggaaugugcccagcauucagucccgcggacucuuuggcgccaucgccggguucaucgagggaggcuggaccgggaugguugacggaugguacggcuaucaucaccagaacgaacaaggcucuggguacgcugcggaccugaaaagcacacagaaugccauugaugagaucaccaacaaggugaauagcgucauugagaaaaugaacacgcaguuuacagcugugggaaaggaguucaaucaccuugagaagagaaucgaaaaccugaauaaaaagguugacgauggcuuccucgacauuuggaccuacaacgccgagcugcuggugcuccuggaaaaugagcggacccuugauuaucaugacagcaacgucaaaaaccuguacgagaaggugcgcucucagcucaaaaauaacgccaaggaaaucgggaauggauguuuugaguucuaucacaagugcgauaacacauguauggaauccgucaaaaauggcaccuacgacuauccuaaguacagcgaggaagcuaaacugaacagagaggagaucgauggggugaaacuugaaucuacacggauuuaucaaauccuggccauuuacuccacgguugcgagcucccucgugcuggucgugucucugggcgcuaucagcuuuuggaugugcuccaauggaucucuccagugccgcauuuguaucuga

SEQ ID NO: 189249 - RNA, 1701 nt, Artificial Sequence; identical to SEQ ID NO: 186887
  derived and/or modified sequence opt5 from hemagglutinin__InfluenzaA__ADQ28031

SEQ ID NO: 189250 - RNA, 1701 nt, Artificial Sequence; identical to SEQ ID NO: 185935
  derived and/or modified sequence opt5 from hemagglutinin__InfluenzaA__ADQ28032

SEQ ID NO: 189251 - RNA, 1701 nt, Artificial Sequence
  derived and/or modified sequence opt5 from hemagglutinin__InfluenzaA__ADQ28034
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgggcaggagggaagaaugaacuacuauuggaccauuguugaacccggcgacaagaucacguucgaggccacagggaaccugguggugccucgguacgcguuugccauggaacgcaaugcuggaucuggcauuaucaucuccgauacccccguccaugacugcaacacaaccugucaaaccccuaaaggcgccauuaauacaagccugcccuuccagaacauccacccgauuacgaucgggaagugcccuaaguaugugaaaucuaccaagcucagacuggcuacaggacuucggaauguucccagcauucagucccgcggccuguuuggggccaucgccggauucaucgagggcggguggaccggaaugguggauggcugguacggcuaucaucaccagaacgaacaagggucuggauacgcugcggaccucaaaagcacacagaaugccauugacgagaucaccaacaaggucaauuccgugauugagaaaaugaacacgcaguuuacagcuguuggcaaggaguucaaucaccuggagaagagaaucgaaaaccuuaaucggaaaguggaugacggguuccuggauauuuggaccuacaacgccgagcuccugguccugcucgaaaaugagcgcacccuggacuaucaugauagcaacgugaagaaccuuuacgagaaagucagaucucagcugaagaauaacgccaaagaaaucggaaauggcuguuuugaguucuaucacaagugcgacaacacauguauggaauccgugaagaaugggaccuacgauuauccuaaauacagcgaggaagcuaagcucaaccgggaggagaucgacggcguuaaacuggaaucuacacgcauuuaucaaauccuugccauuuacuccacgguggcgagcucccugguccucgugguuucucugggagcuaucagcuuuuggaugugcuccaauggcucucugcagugcagaauuuguaucuga

SEQ ID NO: 189252 - RNA, 1701 nt, Artificial Sequence
  derived and/or modified sequence opt5 from hemagglutinin__InfluenzaA__ADQ28035
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguagacugcggggaguugcgccccuccaucugggcaagugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgcgagcagcuuuccagcgucucuuccuucgaaagauuugagaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaagugcuuguccuguggggaauccaccaccccuccaccucugccgaucaacagagccucuaccagaacgcugacgccuacguguucgugggcacaucccgguauagcaaaaaguuuaaaccugagauugcuauccgcccgaaggucagagggcaggagggacggaugaauuacuauuggacccugguugaacccggcgauaaaauuacguucgaggccacagggaaccugguggugccucgcuacgcguuugccauggaaagaaacgcuggaucuggcaucauuaucuccgacacccccguccaugauugcaauacaaccugucaaaccccuaagggcgccaucaacacaagccuccccuuccagaauauucacccgaucacgauugggaaaugcccuaaguaugugaagucuaccaaacugcggcuugcuacaggacugcgcaacguucccagcauccaguccagaggccucuuuggggccauugccggauucaucgagggcggguggaccggaaugguggacggcugguacggcuaucaucaccagaaugaacaagggucuggauacgcugcggaccuuaagagcacacagaacgccaucgaugagauuaccaauaaagucaacuccgugaucgagaagaugaauacgcaguuuacagcuguuggcaaagaguucaaccaccuggagaagcggauugaaaaucugaacaagaaaguggacgauggguuccucgacaucuggaccuacaaugccgagcugcugguccuccuggaaaacgagcgcacccuugauuaucaugacagcaaugugaagaaccuguacgagaaagucagaucucagcucaagaacaaugccaaagaaauuggaaacggcuguuuugaguucuaucacaagugcgauaauacauguauggaauccgugaagaacgggaccuacgacuauccuaaauacagcgaggaagcuaagcugaaucgggaggagaucgauggcguuaaacuugaaucuacacgcaucuaucaaauucuggccaucuacuccacgguggcgagcucccucguccuggugguuucucugggagcuauuagcuuuuggaugugcuccaacggcucucuccagugcagaaucuguauuuga

SEQ ID NO: 189253 - RNA, 1701 nt, Artificial Sequence; identical to SEQ ID NO: 185693
  derived and/or modified sequence opt5 from hemagglutinin__InfluenzaA__ADQ28036

SEQ ID NO: 189254 - RNA, 1701 nt, Artificial Sequence; identical to SEQ ID NO: 185693
  derived and/or modified sequence opt5 from hemagglutinin__InfluenzaA__ADQ28037

SEQ ID NO: 189255 - RNA, 1701 nt, Artificial Sequence; identical to SEQ ID NO: 185935
  derived and/or modified sequence opt5 from hemagglutinin__InfluenzaA__ADQ28038

SEQ ID NO: 189256 - RNA, 1701 nt, Artificial Sequence; identical to SEQ ID NO: 185693
  derived and/or modified sequence opt5 from hemagglutinin__InfluenzaA__ADQ28039

SEQ ID NO: 189257 - RNA, 1701 nt, Artificial Sequence; identical to SEQ ID NO: 185935
  derived and/or modified sequence opt5 from hemagglutinin__InfluenzaA__ADQ28040

SEQ ID NO: 189258 - RNA, 1701 nt, Artificial Sequence; identical to SEQ ID NO: 185935
  derived and/or modified sequence opt5 from hemagglutinin__InfluenzaA__ADQ28041

SEQ ID NO: 189259 - RNA, 1701 nt, Artificial Sequence
  derived and/or modified sequence opt5 from hemagglutinin__InfluenzaA__ADQ28043
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaagcugagaggaguugcuccccuccaucugggcaagugcaacaucgccggguggauucugggaaauccugaaugugagucucucagcacagccuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugacggcgccaagagcuuuuauaaaaaucugaucuggcucguuaagaaaggcaacucuuacccuaagcuguccaaaagcuauauuaaugauaaggggaaggaggugcuuguccuguggggaauccaccaccccuccaccucugcggaccaacagagccucuaccagaacgccgaugcuuacguguucgugggcuccagcagauauucuaaaaaguuuaaaccugagauugccauccggccgaagguccgcgaccaggaagggagaaugaauuacuauuggacacugguugagcccggagauaaaauuaccuucgaagcuacgggcaaccugguggugccucgguacgccuuugcgauggagcgcaacgccggguccggaaucauuaucagcgacacacccguccaugacugcaauaccacaugucaaaccccuaagggcgcuaucaacaccucucuccccuuccacaauauucauccgaucacaauuggcaaaugcccuaaguauguuaagagcacgaaacugagacuugccaccgggcugcggaacgugcccuccauccagucucgcggacucuuuggcgcuauugccggguucaucgaaggaggcuggacagggaugguggauggaugguacggcuaucaccaccagaaugagcagggcagcggguacgccgcugaccugaaguccacccaaaacgcgaucgaugagauuacaaauaaagucaacagcgugaucgaaaagaugaauacccaguuuacggccguuggaaaagaguucaaccaucuugaaaagagaauugagaaucugaacaagaaaguggacgauggcuuccucgacaucuggacauacaaugcugaacugcugguccuccuggagaacgagcggacccuugauuaucacgacucuaaugugaagaaccuguacgaaaaaguccgcucccagcucaagaacaaugccaaagagauugggaacggauguuuugaguucuaucauaagugcgauaauaccuguauggaaagcgugaagaacggcacauacgacuauccuaaauacucugaagaggccaagcugaauagagaggaaaucgaugggguuaaacuugaguccacccggaucuaucagauucuggcuaucuacagcacaguggccuccucucucguccuggugguuagccugggcgcgauuuccuuuuggaugugcucuaacggaagccuccaaugccgcaucuguauuuga

SEQ ID NO: 189260 - RNA, 1701 nt, Artificial Sequence; identical to SEQ ID NO: 185935
  derived and/or modified sequence opt5 from hemagglutinin__InfluenzaA__ADQ28044

SEQ ID NO: 189261 - RNA, 1701 nt, Artificial Sequence
  derived and/or modified sequence opt5 from hemagglutinin__InfluenzaA__ADQ28045
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguagccaugccggcgcgaaaucuuuuuauaagaaucugaucuggcucguuaaaaagggcaacuccuaccccaaacugagcaaguccuauauuaaugacaaggggaaagaagugcuuguccuguggggaauccaccacccuucuaccagcgccgaucaacagucccucuaccagaacgcugacgccuacguguucgugggcacaagcagauauucuaagaaauuuaagcccgagauugcuauccggccuaaaguccgcgaucaggaggggagaaugaauuacuauuggacccugguugaaccgggagacaagauuacguucgaggccacaggcaaccugguggugccccgguacgcguuugccauggaacgcaacgcuggguccggaaucauuaucagcgauaccccuguccaugacugcaauacaaccugucaaacccccaaaggcgccaucaacacaucucucccuuuccagaauauucaccccaucacgauuggcaagugcccgaaguaugugaaaagcaccaagcugagacuugcuacagggcugcggaacguuccuuccauccagucucgcggacucuuuggcgccauugccggguucaucgagggaggcuggaccgggaugguggacggaugguacggcuaucaucaccagaaugaacaaggcagcggguacgcugcggaucugaaauccacacagaacgccaucgacgagauuaccaauaaggucaacagcgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauucuaaugugaaaaaccuguacgagaagguccgcaaccagcucaaaaauaacgccaaggaaauugggaauggauguuuugaguucuaucacaagugcgacaacacauguauggaauccgugaaaaauggcaccuacgauuaucccaaguacagcgaggaagcuaaacugaacagagaggagaucgacgggguuaaacuugaaucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 189262 - RNA, 1701 nt, Artificial Sequence; identical to SEQ ID NO: 186163
  derived and/or modified sequence opt5 from hemagglutinin__InfluenzaA__ADQ28047

SEQ ID NO: 189263 - RNA, 1701 nt, Artificial Sequence; identical to SEQ ID NO: 185693
  derived and/or modified sequence opt5 from hemagglutinin__InfluenzaA__ADQ28048

SEQ ID NO: 189264 - RNA, 1701 nt, Artificial Sequence; identical to SEQ ID NO: 185935
  derived and/or modified sequence opt5 from hemagglutinin__InfluenzaA__ADQ28049

SEQ ID NO: 189265 - RNA, 1701 nt, Artificial Sequence; identical to SEQ ID NO: 185693
  derived and/or modified sequence opt5 from hemagglutinin__InfluenzaA__ADQ28050

SEQ ID NO: 189266 - RNA, 1701 nt, Artificial Sequence
  derived and/or modified sequence opt5 from hemagglutinin__InfluenzaA__ADQ28051
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacgacgggaaacuuuguaagcugagaggaguugcuccccuccaucugggcaaaugcaauaucgccggguggauucugggaaacccugagugugaaucucucagcacagccuccucuuggagcuacaucguggagaccuccucuagcgauaauggcacgugcuauccgggggacuuuauuaacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 189267 - RNA, 1701 nt, Artificial Sequence; identical to SEQ ID NO: 185693
  derived and/or modified sequence opt5 from hemagglutinin__InfluenzaA__ADQ28053

SEQ ID NO: 189268 - RNA, 1701 nt, Artificial Sequence; identical to SEQ ID NO: 185935
  derived and/or modified sequence opt5 from hemagglutinin__InfluenzaA__ADQ28055

SEQ ID NO: 189269 - RNA, 1701 nt, Artificial Sequence
  derived and/or modified sequence opt5 from hemagglutinin__InfluenzaA__ADQ28056
auggaggccauccuggugguccuccuguacaccuucgcuacagccgacgcggauacgcuuugcauuggcuaucacgcuaacaauagcaccgacacaguugauaccgugcuggaaaagaacgugacagucacccauuccgugaaucuccuggaggacaaacacaacgggaaacuuuguaagcugagaggaguugcgccccuccaucugggcaagugcaauaucgccggguggauucugggaaacccugaaugugagucucucagcacagcuuccucuuggagcuacaucguggaaaccuccucuagcgauaauggcacgugcuauccgggggacuuuauugauuacgaggagcugcgggaacagcuuuccagcgucucuuccuucgagcgcuuugaaaucuuccccaaaaccagcucuuggccuaaccacgacuccaauaagggagugacagccgcuuguccccaugccggcgccaagagcuuuuauaaaaaccugaucuggcucguuaagaaaggcaauucuuacccuaagcuguccaaaagcuauauuaacgauaaggggaaggaggugcuuguccuguggggaauccaccaccccuccaccucugccgaccaacagagccucuaccagaaugcugaugccuacguguucgugggcuccagcagauauucuaaaaaguuuaaaccugagauugcuauccggccgaagguccgcgaccaggaagggagaaugaacuacuauuggacacugguugagcccggagauaaaauuaccuucgaagccacgggcaaucugguggugccucgguacgcguuugccauggagcgcaacgcuggguccggaaucauuaucagcgacacacccguccaugacugcaacaccacaugucaaaccccuaagggcgccaucaauaccucucuccccuuccacaacauucauccgaucacaauuggcaaaugcccuaaguauguuaagagcacgaaacugagacuugcuaccgggcugcggaaugugcccuccauccagucucgcggacucuuuggcgccauugccggguucaucgaaggaggcuggacagggaugguggauggaugguacggcuaucaccaccagaacgagcagggcagcggguacgcugcggaccugaaguccacccaaaaugccaucgaugagauuacaaacaaagucaauagcgugaucgaaaagaugaacacccaguuuacggcuguuggaaaagaguucaaucaucuugaaaagagaauugagaaccugaauaagaaaguggacgauggcuuccucgacaucuggacauacaacgccgaacugcugguccuccuggagaaugagcggacccuugauuaucacgacucuaacgugaagaaucuguacgaaaaaguccgcucccagcucaagaacaacgccaaagagauugggaauggauguuuugaguucuaucauaagugcgauaacaccuguauggaaagcgugaagaauggcacauacgacuauccuaaauacucugaagaggcuaagcugaacagagaggaaaucgaugggguuaaacuugaguccacccggaucuaucagauucuggccaucuacagcacaguggcguccucucucguccuggugguuagccugggcgcuauuuccuuuuggaugugcucuaauggaagccuccaaugccgcaucuguauuuga

SEQ ID NO: 189270 - RNA, 1701 nt, Artificial Sequence; identical to SEQ ID NO: 185693
  derived and/or modified sequence opt5 from hemagglutinin__InfluenzaA__ADQ28057

SEQ ID NO: 189271 - RNA, 1701 nt, Artificial Sequence; identical to SEQ ID NO: 185693
  derived and/or modified sequence opt5 from hemagglutinin__InfluenzaA__ADQ28058

SEQ ID NO: 189272 - RNA, 1701 nt, Artificial Sequence
  derived and/or modified sequence opt5 from hemagglutinin__InfluenzaA__ADQ28059
augaaggccauccuggugguccuccuguacacccuugcuacagccaacgcggacacgcugugcauuggcuaucacgcuaauaacagcaccgauacaguugacaccgugcucgagaaaaaugugacagucacccauuccgugaaccugcuugaagauaagcacaaugggaaacuguguaagcucagaggaguugcuccccugcaucugggcaaaugcaacaucgccggguggauucucggaaauccugagugugaaucucugagcacagccuccucuuggagcuacaucguggagaccuccucuagcgacaacggcacgugcuauccgggggauuucauugacuacgaggaacuucgggagcagcuguccagcgucucuuccuuugaacgcuucgagaucuuucccaagaccagcucuuggccuaaucacgauuccaacaagggagugacagccgcuuguccccaugccggcgcgaaaucuuucuauaagaaucucaucuggcugguuaaaaagggcaacagcuacccuaaacuuuccaagagcuauauuaaugacaaggggaaagaagugcugguccucuggggaauccaccaccccuccaccucugccgaucaacagagccuguaccagaacgcugacgccuacguguuugugggcacauccaaguauagcaaaaaguucaaaccugagauugcuaucagaccgaagguccgggaucaggaggggcgcaugaauuacuauuggacccugguugaacccggagacaaaauuacguuugaggccacaggcaaccucguggugccuagauacgcguucgccauggaacggaacgcugggucuggaaucauuaucuccgauacccccguccaugacugcaauacaaccugucaaaccccuaagggcgccaucaacacaagccugcccuuucagaauauucacccgaucacgauuggcaagugcccuaaauaugugaagucuaccaaacuucgccuggcuacagggcucagaaacguucccagcauccagucccggggacuguucggcgccauugccggguuuaucgagggaggcuggaccgggaugguggacggaugguacggcuaucaucaccagaaugaacaaggcucuggguacgcugcggaucuuaagagcacacagaacgccaucgacgagauuaccaauaaagucaacuccgugaucgagaagaugaauacgcaguucacagcuguuggaaaggaauuuaaccaccuggagaaacgcauugaaaaucucaacaagaaaguggaugacggcuuccuggauaucuggaccuacaaugccgagcugcucguccugcuugaaaacgagagaacccuggacuaucaugauagcaaugugaagaaccucuacgagaaaguccggucucagcugaagaacaaugccaaggaaauugggaacggauguuucgaguuuuaucacaaaugcgacaauacauguauggaauccgugaagaacggcaccuacgauuauccuaaauacagcgaggaagcuaaacuuaaucgcgaggagaucgacgggguuaagcuggaaucuacaagaaucuaucaaauucucgccaucuacuccacgguggcgagcucccugguccuggugguuucucucggcgcuauuagcuucuggaugugcuccaacggaucucugcagugccggaucuguauuuga

SEQ ID NO: 189273 - RNA, 1701 nt, Artificial Sequence; identical to SEQ ID NO: 185693
  derived and/or modified sequence opt5 from hemagglutinin__InfluenzaA__ADQ28060

SEQ ID NO: 189274 - RNA, 1701 nt, Artificial Sequence
  derived and/or modified sequence opt5 from hemagglutinin__InfluenzaA__ADQ28061
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggccggugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgcgagcagcuuuccagcgucucuuccuucgaaagauuugagaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaagugcuuguccuguggggaauccaccaccccuccaccucugccgaucaacagagccucuaccagaacgcugacgccaauguguucgugggcacaucccgguacagcaaaaaguuuaaaccugagauugcuauccgcccgaaggucagagaucaggaggggcggaugaacuauuacuggacccugguugaacccggagacaaaauuacguucgaggccacaggcaaccugguggugccucgcuaugcguuugccauggaaagaaaugcugggucuggaaucauuaucuccgauacccccguccaugacugcaacacaaccugucaaaccccuaagggcgccaucaauacaagccuccccuuccagaacauucacccgaucacgauuggcaaaugcccuaaguacgugaagucuaccaaacugcggcuugcuacagggcugcgcaauguucccagcauccaguccagaggacucuuuggcgccauugccggguucaucgagggaggcuggaccgggaugguggacggaugguauggcuaccaucaccagaacgaacaaggcucuggguaugcugcggaucuuaagagcacacagaaugccaucgacgagauuaccaacaaagucaauuccgugaucgagaagaugaacacgcaguuuacagcuguuggaaaagaguucaaucaccuggagaagcggauugaaaaccugaauaagaaaguggaugacggcuuccucgauaucuggaccuacaacgccgagcugcugguccuccuggaaaaugagcgcacccuugacuaccaugauagcaacgugaagaaccuguaugagaaagucagaucucagcucaagaauaacgccaaagaaauugggaauggauguuuugaguucuaccacaagugcgacaacacauguauggaauccgugaagaauggcaccuaugauuacccuaaauauagcgaggaagcuaagcugaaccgggaggagaucgacgggguuaaacuugaaucuacacgcaucuaccaaauucuggccaucuauuccacgguggcgagcucccucguccuggugguuucucugggcgcuauuagcuuuuggaugugcuccaauggaucucuccagugcagaaucuguauuuga

SEQ ID NO: 189275 - RNA, 1701 nt, Artificial Sequence
  derived and/or modified sequence opt5 from hemagglutinin__InfluenzaA__ADQ28063
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcaaccaggaggggagaaugaacuaccauuggacccugguuaagcccggagacaaaauuacguucgaagccacaggcaaucugguggugccucgguaugcguuugccgucgagcgcaacgcugggucuggaaucauuaucuccgauacccccgugcacgacugcaauacaaccugucaaaccccuaagggcgccaucaacacaagccuccccuuccagaauauucauccgaucacgauuggcaagugcccuaaauacguuaagucuaccaaacugagacuugcuacagggcugcggaacgugcccagcauccagucccgcggacucuuuggcgccauugccggguucaucgaaggaggcuggaccgggauggucgauggaugguauggcuaccaccaccagaaugagcaaggcucuggguaugcugcggaccugaaaagcacacagaacgccaucgacgaaauuaccaauaaagugaacuccguuaucgagaagaugaauacgcaguuuacagcugugggaaaggaguucaaccaucuugaaaagagaauugagaaucugaacaagaaagucgaugacggcuuccucgauaucuggaccuacaaugccgaacugcuggugcuccuggagaacgaacggacccuugacuaccacgauagcaacgucaagaaucuguaugagaaagugcgcucucagcucaagaacaaugccaaggagauugggaacggauguuuugaguucuaccauaaaugcgacaauacauguauggaguccguuaagaacggcaccuaugauuacccuaaauauagcgaagaggcuaagcugaauagagaagagaucgacggggugaaacuugagucuacacggaucuaccaaauucuggccaucuauuccacggucgcgagcucccucgugcugguugugucucugggcgcuauuagcuuuuggaugugcuccaacggaucucuccagugccgcaucuguauuuga

SEQ ID NO: 189276 - RNA, 1701 nt, Artificial Sequence; identical to SEQ ID NO: 186441
  derived and/or modified sequence opt5 from hemagglutinin__InfluenzaA__ADQ28064

SEQ ID NO: 189277 - RNA, 1701 nt, Artificial Sequence
  derived and/or modified sequence opt5 from hemagglutinin__InfluenzaA__ADQ28065
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccggccaacagagccucuaccagaacgcugaugccuacguguucguggggacauccagauauagcaagaaauuuaagccugagauugcuauccggccgaaaguccgcgaccaggagggaagaaugaauuacuauuggacccugguugaacccggcgauaagauuacguucgaggccacagggaaccugguggugccucgguacgcguuugccauggaacgcaacgcuggaucuggcaucauuaucuccgacacccaaguccaugauugcaauacaaccugucagacccccaaaggcgccaucaacacaagccucccuuuccagaauauucaccccaucacgauugggaagugcccgaaguaugugaaaucuaccaagcugagacuugcuacaggacugcggaacguuccuagcauccagucccgcggccucuuuggggccauugccggauucaucgagggcggguggaccggaaugguggacggcugguacggcuaucaucaccaaaaugaacaggggucuggauacgcugcggaccugaaaagcacacagaacgccaucgauaagauuaccaauaaagucaacuccgugaucgagaagaugaauacgcaguuuacagcuguuggcaaggaguucaaccaccuugagaaaagaauugagaaucugaacaagaaaguggacgauggguuccucgacaucuggaccuacaaugccgaacugcugguccuccuggagaacgaacggacccuugauuaucaugacagcaaugugaagaaccuguacgagaaaguccgcucucaacucaagaacaaugccaaggagauuggaaacggcuguuuugaguucuaucacaaaugcgauaauacauguauggaauccgugaagaacgggaccuacgacuaucccaaauacagcgaagaggcuaagcugaauagagaagagaucgauggcguuaaacuugagucuacacggaucuaucagauucuggccaucuacuccacgguggcgagcucccucguccuggugguuucucugggagcuauuagcuuuuggaugugcuccaacggcucucuccagugccgcaucuguauuuga

SEQ ID NO: 189278 - RNA, 1701 nt, Artificial Sequence
  derived and/or modified sequence opt5 from hemagglutinin__InfluenzaA__ADQ28066
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgcgcgucagagaucaggaggggcggaugaauuacuauuggacccugguugaacccggagacaaaauuacguucgaggccacaggcaaccugguggugccucgcuacgcguuugccauggaaagaaacgcugggucuggaaucauuaucuccgauacccccguccaugacugcaauacaaccugucaaaccccuaagggcgccaucaacacaagccuccccuuccagaauauucacccgaucacgauuggcaaaugcccuaaguaugugaagucuaccaaacugcggcuugcuacagggcugcgcaacguucccagcauccaguccagaggacucuuuggcgccauugccggguucaucgagggaggcuggaccgggaugguggacggaugguacggcuaucaucaccagaaugaacaaggcucuggguacgcugcggaucuuaagagcacacagaacgccaucgacaaaauuaccaauaaggucaacuccgugaucgagaaaaugaauacgcaguuuacagcuguuggaaaggaguucaaccaccuugaaaagcggauugagaaucugaacaaaaagguggaugacggcuuccucgauaucuggaccuacaaugccgaacugcugguccuccuggagaacgaacgcacccuugacuaucaugauagcaaugugaaaaaccuguacgagaaggucagaucucagcucaaaaacaaugccaaggagauugggaacggauguuuugaguucuaucacaagugcgacaauacauguauggaguccgugaaaaacggcaccuacgauuauccuaaguacagcgaagaggcuaaacugaaucgggaagagaucgacgggguuaagcuggagucuacacgcaucuaucaaauucuggccaucuacuccacgguggcgagcucccucguccuggugguuucucugggcgcuauuagcuuuuggaugugcuccaacggaucucuccagugcagaaucuguauuuga

SEQ ID NO: 189279 - RNA, 1701 nt, Artificial Sequence
  derived and/or modified sequence opt5 from hemagglutinin__InfluenzaA__ADQ28067
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacaagauuaccaauaaagucaacuccgugaucgagaagaugaauacgcaguuuacagcuguuggaaaggaguucaaccaccuugagaaaagaauugagaaucugaacaagaaaguggaugacggcuuccucgauaucuggaccuacaaugccgaacugcugguccuccuggagaacgaacggacccuugacuaucaugauagcaaugugaagaaccuguacgagaaaguccgcucucagcucaagaacaaugccaaggagauugggaacggauguuuugaguucuaucacaaaugcgacaauacauguauggaauccgugaagaacggcaccuacgauuauccuaaauacagcgaagaggcuaagcugaauagagaagagaucaacgggguuaaacuugagucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 189280 - RNA, 1701 nt, Artificial Sequence
  derived and/or modified sequence opt5 from hemagglutinin__InfluenzaA__ADQ28068
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauuaauuacgaagaacugcgggagcagcuuuccagcgucucuuccuucgaacgcuuugagaucuuccccaagacaagcucuuggccuaaccacgacuccaauaagggagugaccgcugccuguccccaugcuggcgaaaagagcuuuuauaagaaccugaucuggcucguuaaaaagggcaauucuuacccuaaacuguccaagagcuauauuaacgauaaggggaaagaggugcuuguccuguggggaauccaccaccccuccacaucugccgaccaacagagccucuaccagaaugcggaugccuacguguucgugggcaccuccagauauagcaagaaauuuaagccugagauugcuauccggccgaaaguccgcgaccaggaagggagaaugaacuaccauuggacgcugguuaagcccggagauaaaauuacauucgaggccaccggcaaccugguggugccucgguaugcuuuugccauggaacgcaaugcggggucuggaaucauuaucuccgacacacccguccacgauugcaacaccaccugucaaacaccuaagggcgccaucaauacgagccuccccuuccagaacauucauccgaucaccauuggcaagugcccuaaauacgugaagucuacaaaacugagacuugcuaccgggcugcggaauguucccagcauccagucccgcggacucuuuggcgccauugcuggguucaucgagggaggcuggacagggaugguggacggaugguauggcuaccaccaccagaacgaacaaggcucuggguaugccgccgaccugaaaagcacccagaaugcuaucgaugagauuacgaacaaagucaauuccgugaucgagaagaugaacacacaguuuaccgcgguuggaaaggaguucaaucaucuugagaaaagaauugaaaaccugaauaagaaaguggacgauggcuuccucgacaucuggaccuacaacgccgagcugcugguccuccuggaaaaugagcggacacuugauuaccacgacagcaacgugaagaaccuguaugagaaaguccgcucucagcucaagaauaacgcuaaggaaauugggaauggauguuuugaguucuaccauaaaugcgauaacaccuguauggaauccgugaagaauggcacauaugacuacccuaaauauagcgaggaagccaagcugaacagagaggagaucgaugggguuaaacuugaaucuacgcggaucuaccaaauucuggccaucuauuccaccguggcuagcucccucguccuggugguuucucugggcgccauuagcuuuuggaugugcuccaauggaucucuccagugccgcaucuguauuuga

SEQ ID NO: 189281 - RNA, 1701 nt, Artificial Sequence; identical to SEQ ID NO: 189279
  derived and/or modified sequence opt5 from hemagglutinin__InfluenzaA__ADQ28069

SEQ ID NO: 189282 - RNA, 1701 nt, Artificial Sequence
  derived and/or modified sequence opt5 from hemagglutinin__InfluenzaA__ADQ28070
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacaagauuaccaauaaagucaacuccgugaucgagaagaugaauacgcaguuuacagcuguuggaaaggaguucaaccaccuugagaaaagaauugagaaucugaacaagaaaguggaugacggcuuccucgauaucuggaccuacaaugccgaacugcugguccuccuggagaacgaacggacccuugacuaucaugauagcaaugugaagaaccuguacgagaaaguccgcagacagcucaagaacaaugccaaggagauugggaacggauguuuugaguucuaucacaaaugcgacaauacauguauggaaucugugaagaacggcaccuacgauuauccuaaauacuccgaagaggcuaagcugaaucgggaagagaucgacgggguuaaacuugagagcacacgcaucuaucaaauucuggccaucuacucuacgguggcguccagccucguccuggugguuucccugggcgcuauuucuuuuuggaugugcagcaacggaucccuccagugcagaaucuguauuuga

SEQ ID NO: 189283 - RNA, 1701 nt, Artificial Sequence
  derived and/or modified sequence opt5 from hemagglutinin__InfluenzaA__ADQ28071
augaaggccauccuggugguccuccuguacacccuugcuacagccaacgcggacacgcugugcauuggcuaucacgcuaauaacagcaccgauacaguugacaccgugcucgagaaaaaugugacagucacccauuccgugaaccugcuugaagauaagcacaaugggaaacuguguaagcucagaggaguugcuccccugcaucugggcaaaugcaacaucgccggguggauucucggaaauccugagugugaaucucugagcacagccuccucuuggagcuacaucguggagaccuccucuagcgacaacggcacgugcuauccgggggauuucauugacuacgaggaacuucgggagcagcuguccagcgucucuuccuuugaacgcuucgagaucuuucccaagaccagcucuuggccuaaucacgauuccaacaagggagugacagccgcuuguccccaugccggcgcgaaaucuuucuauaagaaucucaucuggcugguuaaaaagggcaacagcuacccuaaacuuuccaagagcuauauuaaugacaaggggaaagaagugcugguccucuggggaauccaccaccccuccaccucugccgaucaacagagccuguaccagaacgcugacgccuacguguuugugggcacauccagauauagcaagaaauucaagccugagauugcuauccggccgaaaguccgcgaucaggaggggagaaugaauuacuauuggacccugguugaacccggagacaagauuacguuugaggccacaggcaaccucguggugccucgguacgcguucgccauggaacgcaacgcugggucuggaaucauuaucuccgauacccccguccaugacugcaauacaaccugucaaaccccuaaaggcgccaucaacacaagccugcccuuucagaauauucacccgaucacgauuggcaagugcccuaaguaugugaaaucuaccaaacuuagacuggcuacagggcuccggaacguucccagcauccagucccgcggacuguucggcgccauugccggguuuaucgagggaggcuggaccgggaugguggacggaugguacggcuaucaucaccagaaugaacaaggcucuggguacgcugcggaucuuaaaagcacacagaacgccaucgacaagauuaccaauaaagucaacuccgugaucgagaagaugaauacgcaguucacagcuguuggaaaggaguuuaaccaccuggaaaagagaauugagaaucucaacaagaaaguggaugacggcuuccuggauaucuggaccuacaaugccgaacugcucguccugcuugagaacgaacggacccuggacuaucaugauagcaaugugaagaaccucuacgagaaaguccgcucucagcugaagaacaaugccaaggagauugggaacggauguuucgaauuuuaucacaaaugcgacaauacauguauggaguccgugaagaacggcaccuacgauuauccuaaauacagcgaagaggcuaaacuuaauagagaagagaucgacgggguuaagcuggagucuacacggaucuaucaaauucucgccaucuacuccacgguggcgagcucccugguccuggugguuucucucggcgcuauuagcuucuggaugugcuccaacggaucucugcagugccgcaucuguauuuga

SEQ ID NO: 189284 - RNA, 1701 nt, Artificial Sequence; identical to SEQ ID NO: 186637
  derived and/or modified sequence opt5 from hemagglutinin__InfluenzaA__ADR32361

SEQ ID NO: 189285 - RNA, 1689 nt, Artificial Sequence
  derived and/or modified sequence opt5 from hemagglutinin__InfluenzaA__ADT78887
auggcccugaucuaccucauucugcuuuucaccagcgugagaggcgaccagaucugcauuggguaucacgcuaacaauuccacagagaaggucgauacgauccuggaacggaacguuaccgugacacaugccaaagacauucucgagaagacccacaauggaaaacuguguaaacuuaacggcauucccccucuggaacucggggauugcucuaucgcgggauggcugcugggcaauccggagugugaccgccuccugagagugcccgaauggagcuacaucauggagaaggagaacccuaaguauucccuuugcuaccccgggucuuuuaaugauuaugaggaacugaagcaucucaucagcuccgucaaacacuucgaaaaggugaaaauucugccuaaggacggauggacacaacauaccacaaccggcggcucucgggcuugugccguuagcgggaaccccuccuuuuuccgcaauaugguguggcuuacgaaaaagggaccuaacuacccggucgccaagggcagcuauaauaacaccucuggggagcagaugcugaucauuuggggagugcaccaccccaaugaugaggcugaacagagagcccucuaccagaaaguuggcacauacguguccgcuagcaccucuacacugaacaagcgguccaccccugagaucgccgcgcgccccgaagucaaugggcugggaagcagaauggaguuuucuuggacgcuccuggacaugugggauacaauuaacuucgaauccaccggcaaccuuguggccccugaguauggcuuuaaaaucagcaagcggggguccucuggagugaugaaaacagagggcacccuggaaaauugcgagaccaagugucaaacaccccucggggcuaucaacacgacccugccguuccauaauguccacccucuuacaauuggagaaugccccaaauacguuaagagcgagaagcuggugcucgccaccggccugcgcaacgugccucagaucgaauccagagggcuguuuggagcuauugccggcuucaucgagggcggguggcagggaauggucgacggcugguauggguaccaucacagcaaugaucagggaucuggcuaugcggccgacaaagaguccacacaaaaggcuuuugaugggauuaccaacaaagugaauagcguuaucgaaaagaugaacacgcaguucgaggccgugggcaaagaauuuucuaaucucgagaagcggcuggaaaaccuuaauaagaaaauggaggacggauuccuggacgucuggacauacaacgcugagcuccuggugcuuauggaaaaugagcgcacccuggauuuccacgacagcaacguuaagaaucucuaugauaaagugagaaugcagcugcgggacaacgucaaggaacugggcaacggguguuuugaguucuaccauaaaugcgaugacgaguguauggauuccgugaagaauggaaccuacgacuaucccaaguacgaagaggaaucuaaacucaaccgcaaugagaucaagggcgucaaacugagcuccauggggguguaucagauucuugccaucuacgccacaguugcuggaagccugucucucgcgauuaugauggccggcaucuccuuuuggaugugcagcaacgggucucugcaaugcagaauuuguaucuga

SEQ ID NO: 189286 - RNA, 1701 nt, Artificial Sequence
  derived and/or modified sequence opt5 from hemagglutinin__InfluenzaA__ADT78908
augaaggccaaacugcucauccugcuuugcgcucugagcgccaccgacgcggauacaauuuguaucggcuaccacgcuaacaauuccacggacaccguggauacaguccucgagaagaacguuaccgugacacauucugugaaucugcuugaagacagccacaacgggaaacugugcagacucaagggaaaagcuccccugcagcugggcaaguguaauauugccggguggguccucggaaacccugagugcgaaucccugcuuucuaaucggagcugguccuauaucgccgagaccccgaacucugaaaauggcacauguuaccccggggauuucgccgacuaugaggagcugcgcgaacaacucagcuccgugagcucuuuugagagauucgaaauuuuuccuaaggagcgguccuggcccaaacauaacaccacgcgcggaguuaccgcugccugcagccacgcgagaaagucuuccuucuacaaaaaucugguguggcuuacagaggccaacggcagcuauccuaaucugucuaaguccuacgucaacaaucaggaaaaagaggugcucguucuguggggcgugcaucaccccagcaacaucgaagaucagcggacccuguaucgcaaggacaacgcuuacgucuccguggugucuagcaauuacaacagacgguuuacaccugagaucgccaagcgcccgaaagucagagaucagcccgggcggaugaauuauuacuggacccuccuggaaccuggagacacgauuaucuucgaggcuacaggcaaccuuauugcccccugguaugcguuugcccugucccgcgggccuggaagcggcaucauuaccucuaaugcucccauggaugagugugacacaaagugccaaaccccgcagggggccaucaacuccagccucccuuuccagaauauucaccccguuaccaucggagaauguccuaaauacgugagaucuacaaagcugcggauggugacgggccuucgcaacauccccagcauucaguccagaggccuguuuggggcuaucgccggauucauugagggcggguggaccggaaugauggauggcugguauggguaccaucaccaaaaugaacagggaucuggcuaugccgcugaccagaaaagcacacagaacgcgaucaauggcauuaccaacaaggucaauuccgugaucgagaaaaugaacacacaauuuaccgccguugggaaggaguucaauaagcucgaaaaacggauggagaaccugaacaagaaaguggacgauggauuucuggacaucuggacguacaaugcugaacuccugguccuucuggagaacgaaagaacacucgauuuccaugacagcaaugugaagaaccuguacgagaaaguuaagaaucagcuucgcaacaaugccaaggaacugggcaacgggugcuucgaguuuuaucacaaaugugauaaugagugcauggaaucugugaagaacggaaccuacgacuaucccaaauacuccgaggaaagcaagcucaaucgggagaaaauugauggcgucaagcuggagucuauggggguguauagaauccuggccauuuacuccaccgucgcuagcucccucgugcugcuuguuucucugggcgccaucagcuucuggaugugcuccaacggaucucuccagugucgcauuugcaucuga

SEQ ID NO: 189287 - RNA, 1701 nt, Artificial Sequence
  derived and/or modified sequence opt5 from hemagglutinin__InfluenzaA__ADT78929
augaaggccaaacugcucauccugcuuugcgcucugagcgccaccgacgcggauacaauuuguaucggcuaccacgcuaacaauuccacggacaccguggauacaguccucgagaagaacguuaccgugacacauucugugaaucugcuugaagacagccacaacgggaaacugugcagacucaagggaauugccccgcugcagcugggcaaauguaauaucgccggguggauucucggaaacccugagugcgaaucccugcuuucuaagcggagcugguccuauaucgcugagacccccaauucugaaaacggcacauguuaccccggggauuucgccgacuaugaggagcugcgcgaacaacucagcuccgucagcucuuuugagagauucgaaaucuuuccuaaggagcgguccuggcccaaacauaauauuacccgcggagugacggcugccugcagccacgcgggcaagucuuccuucuacaaaaaccugcuuuggcugaccgagacaaagggcagcuauccuaaucucucuaaauccuacguuaacaauaaggaaaaggaggugcugguccuguggggagugcaucaccccagcaacaucgaagaucagaaaacccucuauagaaaggagaaugccuacguuuccguggucucuagcaacuacaaccggcgcuuuacaccugaaauugcugagagaccgaaagugcgggggcaggccggccgcaugaauuauuacuggacccugcuugagcccggggacacgaucauuuucgaagcuaacggaaaucugaucgccccuugguaugcguuugcccucuccagaggccuggggagcggaauuaucacaucuaacgcuuccauggaugagugugacaccaagugccagacaccccaaggcgccaucaauagcucucuuccuuuccagaacauucaccccgugaccaucggcgaauguccgaaauacgucaagagcaccaaacugcggaugguuacagggcuccgcaauauuccuuccauccagucuagaggacuguuuggcgcuauugccggguucaucgagggaggcuggacggggaugaucgauggaugguauggcuaccaucaccagaacgaacaaggcagcggguaugccgcugaccagaaguccacccagaaugcgauuaacggaaucacaaauaaggugaacagcgugauugagaaaaugaauacccaguuuacagccgucggcaaggaguucaacaaacuggaaaagcggauggagaaucucaacaaaaagguggaugacggguuucuggacaucuggaccuacaacgcugaacuucugguucuccuggagaaugaacgcacgcuugauuuccaugacucuaacgugaagaaucuguacgagaaagucaagaaccaacucagaaauaacgccaaagagauuggaaauggcugcuucgaauuuuaucacaaguguaacaaugagugcauggaauccgugaaaaacgggacauacgauuaucccaaguacagcgaggagucuaagcugaaucgggagaaaaucgacggcguuaagcuggaauccaugggaguguaucagauccucgccauuuacagcaccgucgcuuccucucuggugcuucuggucagccucggcgccaucuccuucuggaugugcucuaacgggagccugcaguguagaauuugcaucuga

SEQ ID NO: 189288 - RNA, 1701 nt, Artificial Sequence
  derived and/or modified sequence opt5 from hemagglutinin__InfluenzaA__ADT78936
augaaggccaaacugcucgugcugcuuugcgcucugagcgccaccuacgcggacacaaucuguauuggcuaucacgcuaacaauuccacggauaccgucgacacaguucucgagaagaacgugaccgugacacauucugucaaucugcuugaagauagccacaacgggaaacugugcagacucaagggaaaagccccgcugcagcugggcaaguguaauaucgccggguggauucucggaaacccugagugcgaaucccugcuuucuaagcggagcugguccuacaucgcugagacccccaauucugaaaacggcacauguuaucccggggacuucgccgauuacgaggagcugcgcgaacaacucagcuccgugagcucuuuugagagauucgaaauuuuuccuaaagaguccagcuggcccaagcauaauaccacgcggggaguuaccgcugccugcucucacgcgcgcaaauccagcuucuauaagaaccugcuuuggcugacagaggccaauggcucuuacccuaaccucuccaaaagcuaugugaauaaccaggaaaaggagguccuggugcuguggggcguucaucaccccuccaauaucgaagaccagagaacccucuaccggaaggagaacgcuuacgugucugucgugagcuccaacuauaaucgcagauuuacaccugaaaucgccgagcggccgaaagugcgcaaccaggcugggagaaugaauuacuauuggacccugcuugagcccggagauacgauuaucuucgaagccaacggcaaucugauugcgccuugguacgccuuugcucucagccgggggcugggaucuggcaucauuacauccaacgccagcauggacgagugugauaccaagugccaaacaccccagggggcuaucaauucuagccuuccuuuccagaacauucaccccgucaccaucggagaauguccgaaauauguuaaguccaccaaacugcgcauggugacaggccucagaaauaucccuucuauucagagccggggccuguuuggggccaucgccggauucauugagggcggguggacgggaaugauggacggcugguacggguaucaucaccaaaacgaacagggauccggcuacgcugcggaucaaaagagcacccagaaugccaucaacggcauuacaaauaaagugaacucugucaucgagaagaugaauacccaguuuacagcuguggggaaggaguucaacaaacuggaaaagcgcauggagaaccucaauaaaaagguugacgauggauuucuggacaucuggaccuacaacgccgaacuucuggugcuccuggagaaugaaagaacgcuugacuuccaugauuccaacgucaaaaaucuguaugagaaggugaagaaccagcuccggaauaacgccaaagagcugggcaaugggugcuucgaauuuuaccacaagugugacaacgagugcauggaaagcguuaaaaauggaacauaugauuaccccaaguauucugaggaguccaaacugaacagagaaaagauugacggcgugaagcucgagagcaugggggucuaccgcauccuggcuauuuauuccaccguggccucuagccuuguccugcucgugucccugggcgcgaucucuuucuggaugugcagcaauggaucccugcagugucggauuugcaucuga

SEQ ID NO: 189289 - RNA, 1689 nt, Artificial Sequence
  derived and/or modified sequence opt5 from hemagglutinin__InfluenzaA__ADT78961
auggccaucauuugccugauccuccuguucaccgcugugagaggcgaccagauuuguaucggguaccacgccaacaauagcacagagaaggucgauacgauucuugaacggaacguuaccgugacacaugcgaaagacauccuggagaagacccacaauggaaaacucugcaagcugaacggcauucccccucuugaacugggggauuguuccaucgcuggauggcuccugggcaauccggagugcgaccgccugcucucugugcccgaauggagcuauaucauggagaaagagaacccuagagaugggcuguguuaccccggauccuuuaaugacuaugaagaacuuaagcaucugcucucuagcgucaagcacuucgaaaaagugaagauucugccuaaaaaccgguggacacaacauaccacaaccggcggcucccgcgccugcgccguuucugggaaucccagcuuuuucagaaacaugguguggcuuacgaagaaaggauccaauuacccugucgcuaagggcagcuauaacaauaccucuggggagcagaugcugaucauuuggggagugcaccacccgaacgaugagacagaacagcggacccucuaccagaauguugagacauauguguccgucagcaccucuacgcugaacaagcgcuccacacccaaaaucgccaccagaccugaagugaacggccuggggagccggauggaguuuucuuggacacuccuggacaugugggauaccauuaauuucgaauccaccggaaaccuuaucgcucccgaguacggcuuuaagaucagcaaacgcggcuccucugggauuaugaagacagagggaacgcuggaaaauugugagaccaaaugccaaacaccucucggcgccaucaacaccacacugcccuuccauaaugugcacccgcuuaccauuggggaauguccuaaguacgucaaaagcgagaagcugguucucgcgacgggacccagaaacgugccucagaucgaaucccggggccuguuuggggccauugcuggauucaucgagggcggcuggcaggggaugguggacggaugguauggcuaccaucacagcaaugaucaggggucuggauaugccgcugacaaggaguccacacaaaaagccuuugauggcaucaccaacaaggucaauagcgugauugagaaaaugaacacccaguucgaggcgguugggaaggaauuuucuaaucuggagcgcagacucgaaaaccugaauaaaaagauggaggacggcuuccuugacguguggacauacaacgccgagcugcucguccugauggaaaaugagcggacccuugauuuccacgacagcaacgugaagaaccuguaugauaaaguucgcaugcagcucagagacaaugugaaggaacugggaaacggcugcuuugaguucuaccauaaaugugaugacgagugcaugaacuccgucaagaaugggacauaugauuaccccaaauacgaagaggaaucuaagcugaaucggaacgagaucaagggagugaaacucagcuccaugggcgucuaucagauucuggugaucuacgcuacgguugccgggagccuuucucuggcuauuaugauggccggaaucuccuuuuggaugugcagcaauggcucucuccaauguagaaucugcauuuga

SEQ ID NO: 189290 - RNA, 1701 nt, Artificial Sequence; identical to SEQ ID NO: 183788
  derived and/or modified sequence opt5 from hemagglutinin__InfluenzaA__ADT78971

SEQ ID NO: 189291 - RNA, 1701 nt, Artificial Sequence; identical to SEQ ID NO: 183329
  derived and/or modified sequence opt5 from hemagglutinin__InfluenzaA__ADT79010

SEQ ID NO: 189292 - RNA, 1701 nt, Artificial Sequence; identical to SEQ ID NO: 183788
  derived and/or modified sequence opt5 from hemagglutinin__InfluenzaA__ADT79030

SEQ ID NO: 189293 - RNA, 1701 nt, Artificial Sequence; identical to SEQ ID NO: 184366
  derived and/or modified sequence opt5 from hemagglutinin__InfluenzaA__ADT79050

SEQ ID NO: 189294 - RNA, 1701 nt, Artificial Sequence
  derived and/or modified sequence opt5 from hemagglutinin__InfluenzaA__ADT79108
augaaggccagacugcucauccugcuuugcgcucugagcgccaccgacgcggauacaauuuguaucggcuaccacgcuaacaauuccacggacaccguggauacaguccucgagaaaaacguuaccgugacacauucugugaaucugcuugaagacagccacaacgggaagcugugccggcucaaaggaauugcuccccugcagcugggcaaguguaauaucgccggguggauucucggaaacccugagugcgaaucccugcuuucuaaucgcagcugguccuauaucgccgagaccccgaacucugaaaauggcacauguuaccccggggauuucgccgacuaugaggagcugagagaacaacucagcuccgucagcucuuuugagcgguucgaaaucuuuccuaaagagcgcuccuggcccaagcauaacauuaccagaggagugacggcugccugcagccacgcgaagaaaucuuccuucuacaagaaucugcuuuggcugaccgaggccaacggcagcuauccuaaucucaucaaaucuuacguuaacaauaaggaaaaagaggugcugguccuguggggcgugcaucaccccuccaacauugaagaucagcggacacucuaucgcaaggagaacgcuuacguuagcguggucuccucuaauuacaacagacgguuuaccccugaaaucgccgagcgcccgaaggugagagggcaggcuggacggaugaauuauuacuggacacugcuugagcccggcgacaaaauuaucuucgaagccaacgggaaucugauugcgccuugguaugccuuugcucucagccgcggacugggcuccgggaucaucaccagcaacgccucuauggaugagugugacacgaagugccagacaccccaaggagcuauuaauuccagccuuccuuuccagaacauccaccccgugaccauuggcgaauguccgaaauacgucagaucuacaaagcugcggaugguuaccggccuccgcaauaucccuagcauucaguccagagggcuguuuggagccaucgccggcuucaucgaagggggauggaccggcaugguggaugggugguauggauaccaucaccagaacgaacaaggcucuggcuaugcugcggaccagaaaagcacacagaaugccauuaacgggaucacgaauaaggugaacuccgucauugagaaaaugaauacccaguuuacagcugugggaaaggaguucaacaagcuggaaaaacggauggagaaccucaauaagaaaguugaugacggcuuucuggacaucuggaccuacaacgccgaacuucuggugcuccuggagaaugaaagaacacuugauuuccaugacagcaacgucaagaaucuguacgagaaagugaagaaccaacuccgcaauaacgccaaggagauugggaauggaugcuucgaauuuuaucacaaaugugauaacgagugcauggaaucuguuaagaauggcaccuacgacuaucccaaauacuccgaggagagcaagcugaaccgggagaaaaucgauggggugaagcuggagucuaugggcgucuaucagauccucgcuauuuacuccacgguggccagcucccugguccuucuggugucucucggagcgaucagcuucuggaugugcuccaauggcucucugcaguguagaauuugcaucuga

SEQ ID NO: 189295 - RNA, 1689 nt, Artificial Sequence
  derived and/or modified sequence opt5 from hemagglutinin__InfluenzaA__ADT79119
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucucugugcccgaauggagcuacaucauggagaaagagaacccuagagaugggcugugcuaucccggauccuuuaaugacuacgaagaacuuaagcaucugcucucuagcgucaagcacuucgaaaaagugaagauucugccuaaagaucgguggacacaacauaccacaaccggcggcucccgcgccugugccguuucugggaaccccagcuuuuucagaaauaugguguggcuuacgaagaaaggauccaacuauccugucgcuaagggcagcuacaauaacaccucuggggagcagaugcugaucauuuggggagugcaccacccgaaugacgagacagaacagcggacccucuaucagaacguuggcacauacguguccgucgggaccagcacgcugaauaagcgcucuacacccgauaucgccaccagaccuaaagugaacggacugggcggccggauggaguuuuccuggacacuccuggacaugugggauaccauuaacuucgaaagcaccgggaaucuuaucgcucccgaguacggauuuaagaucucuaaacgcggcuccagcgggauuaugaagacagaaggaacgcugggcaacugcgagaccaaaugucaaacaccucucggggccaucaauaccacacugcccuuccauaacgugcacccgcuuaccauuggagagugcccuaaguaugucaaauccgaaaagcugguucucgcgacgggccugagaaaugugccccagaucgagucucggggccuguuuggggccauugcuggauucaucgaaggcggguggcagggaaugguggacggcugguacggguaucaucacagcaacgaucagggcuccggauacgccgcugacaaggagagcacacaaaaagccuuugacggcaucaccaauaaggucaacucugugauugagaaaaugaauacccaguucgaggcgguugggaaggaguuuuccaaccucgaacgcagacuggagaaucuuaacaaaaagauggaagauggauuccuggacguguggacauauaaugccgagcuccugguccuuauggaaaacgagcggacccuggauuuccacgacagcaaugugaagaaccucuacgauaaaguucgcaugcagcugagagacaacgugaaggagcugggcaauggguguuuugaguucuaucauaaaugcgaugacgaauguaugaacucugucaagaauggaacauacgauuacccuaaauaugaagaggagagcaagcucaaccggaaugaaaucaagggcgugaaacuguccucuaugggggucuaccagauucuugcuaucuaugccacgguggcuggcagccugucccucgccauuaugauggccggaaucagcuuuuggaugugcucuaacggcucccugcaaugcagaaucuguauuuga

SEQ ID NO: 189296 - RNA, 1689 nt, Artificial Sequence
  derived and/or modified sequence opt5 from hemagglutinin__InfluenzaA__ADT79129
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucagagugcccgaauggucuuacaucauggagaaagagaacccucgggaugggcugugcuaucccggaucuuuuaaugacuacgaggagcuuaagcaucugcucuccucugucaagcacuucgaaaaagugaagauucugccuaaagaucgcuggacacaacauaccacaaccggcggcagcagagccugugccguuuccgggaaccccagcuuuuuccggaauaugaucuggcuuacgaagaaaggaagcaacuauccuguggcuaagggcuccuacaauaacaccagcggggagcagaugcugauuaucuggggaguccaccacccgaaugacgagacagaacagcgcacccucuaucagaacgugggcacauacguuucuguggucaccuccacgcugaauaagagaagcacacccaaaauugccacccggccuaaggugaacgggcugggaggccgcauggaguuuucuuggacacuccuggauaugugggacaccaucaacuucgaauccaccggcaaucuuaucgcucccgaguacggguuuaaaauuagcaagagaggaucuuccggcaucaugaaaacagaagggacgcuggagaacugcgagaccaagugucaaacaccucucggagccauuaauaccacacugcccuuccauaacgugcacccgcuugcgaucggcgaaugcccuaaauaugucaagagcgagaagcugguucucgccaccgggcugcggaaugugccccagauugaaucccgcggacuguuuggcgcuaucgccggcuucaucgaagggggauggcagggcaugguggaugggugguacggauaucaucacucuaacgaccagggcagcggguacgcugccgauaaagaauccacgcaaagagcguuugacggcauuacaaauaaggucaacagcgugaucgagaaaaugaauacccaguucgaggccguuggaaaggaauuuucuaaccucgagcggcgccuggaaaaucuuaacaaaaagauggaggacggcuuccuggauguguggaccuauaaugcugaacuccugguccuuauggagaacgagagaacacuggacuuccacgauuccaaugugaagaaccucuacgacaaaguucggaugcagcugagagauaacgugaaggaacuggggaauggauguuuugaguucuaucauaaaugcgacgaugaauguaugaacagcgucaagaauggcaccuacgacuacccuaaauaugaggaggaaucuaagcucaaccgcaaugagauuaagggggugaaacugagcuccaugggagucuaccagauccuugccauuuaugcuacaguggccggcucucugagccucgccaucaugauggcugggaucuccuuuuggaugugcagcaacggcucucugcaaugccggauuuguaucuga

SEQ ID NO: 189297 - RNA, 1701 nt, Artificial Sequence
  derived and/or modified sequence opt5 from hemagglutinin__InfluenzaA__ADT79232
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucuccccuuccagaauaagcacccgauuacaaucggcaagugcccuaaauauguuaagagcacgaaacugagacuugcuaccgggcugcggaacgugcccuccauucagucucgcggacucuuuggcgccaucgccggguucauugagggaggcuggacagggaugguggacggaugguacggcuaucaucaccagaaugaacaaggcagcggguacgcugcggaugucaaguccacccagaacgccaucgacgagaucacaaauaaagugaacagcguuauugagaagaugaauacccaguuuacggcugugggaaaggaguucaaccaccuggagaaaagaaucgaaaaucuuaacaagaaagucgaugacggcuuccuggauauuuggacauacaaugccgagcuccuggugcugcucgaaaacgagcggacccuggacuaucaugauucuaaugucaagaaccuuuacgagaaagugcgcucccagcugaagaacaaugccaaggaaaucgggaacggauguuuugaguucuaucacaaaugcgacaauaccuguauggaaagcguuaagaacggcacauacgauuauccuaaauacucugaggaagcuaagcucaauagagaggagauugacggggugaaacuggaauccacccggaucuaucaaauccuugccauuuacagcacagucgcguccucucuggugcucguugugagccugggcgcuaucuccuuuuggaugugcucuaacggaagccugcagugccgcauuuguaucuga

SEQ ID NO: 189298 - RNA, 1701 nt, Artificial Sequence
  derived and/or modified sequence opt5 from hemagglutinin__InfluenzaA__ADT79242
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccccguccucugacaacggcacgugcuaucccggggauuuuauugacuacgaagaacugcgggagcagcuuagcuccgucagcucuuucgaacgcuuugagaucuucccuaagaccuccagcuggcccaaucacgauucuaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcagcuccagauauagcaagaaauuuaagccggagauugcuauccggcccaaaguccgcgaucaggaggggagaaugaauuacuauuggacacugguugaaccuggagacaagauuaccuucgaggccacgggcaaccugguggugccccgguacgcguuugccauggaacgcaacgcugggucuggaaucauuaucuccgauacaccuguccaugacugcaauaccacaugucaaacccccaaaggcgccaucaacaccagccucccguuccagaauauucacccuaucacaauuggcaagugccccaaguaugugaaaucuacgaagcugagacuugcuaccgggcugcggaacguuccuagcauccagucccgcggacucuuuggcgccauugccggguucaucgagggaggcuggacagggaugguggacggaugguacggcuaucaucaccagaaugaacaaggcucuggguacgcugcggaucugaaaagcacccagaacgccaucgacgagauuacaaauaaggucaacuccgugaucgagaaaaugaauacccaguuuacggcuguuggaaaggaguucaaccaccuugagaagagaauugaaaaucugaacaaaaagguggaugacggcuuccucgauaucuggacauacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauaccuguauggaauccgugaaaaacggcacauacgauuaucccaaguacagcgaggaagcuaaacugaauagagaggagaucgacgggguuaaacuugaaucuacccggaucuaucaaauucuggccaucuacuccacaguggcgagcucccucguccuggugguuucucugggcgcuauuagcuuuuggaugugcuccaacggaucucuccagugccgcaucuguauuuga

SEQ ID NO: 189299 - RNA, 1701 nt, Artificial Sequence
  derived and/or modified sequence opt5 from hemagglutinin__InfluenzaA__ADT91182
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaccgcucucuacagccagcuccuggucuuacaucguggagaccagcuccucugacaacggcacgugcuaucccggggauuuuauugacuacgaagaacugcgggagcagcuuagcuccgucagcucuuucgaacgcuuugagaucuucccuaagaccuccagcuggcccaaucacgauucuaacaagggagugacaaccgccuguccucaugcuggcgccaaauccuuuuauaagaaucugaucuggcucguuaaaaagggcaacagcuaccccaaacugucuaaguccuauauuaaugacaaggggaaagaagugcuuguccuguggggaauccaccacccuccgacaagcgcggaucaacagucccucuaccagaacgccgacgcuuacguguucgugggcaccucuagauauagcaagaaauuuaagcccgagauugccauccggccuaaaguccgcgaucaggaggggagaaugaauuacuauuggacgcugguugaacccggagacaagauuacauucgaggcuaccggcaaccugguggugccucgguacgccuuugcgauggaacgcaacgccggguccggaaucauuaucagcgauacacccguccaugacugcaauaccaccugucaaacaccgaaaggcgcuaucaacacgucucucccuuuccagaauauucaccccaucaccauuggcaagugcccuaaguaugugaaauccacaaagcugagacuugccaccgggcugcggaacguucccagcauccagucucgcggacucuuuggcgcuauugccggguucaucgagggaggcuggacagggaugguggacggaugguacggcuaucaucaccagaaugaacaaggcagcggguacgccgcugaucugaaauccacccagaacgcgaucgacggaauuacgaauaaggucaacucugugaucgagaaaaugaauacacaguuuaccgccguuggcaaggaguucaaccaccuugaaaagagaauugagaaucugaacaaaaagguggaugacggguuccucgauaucuggaccuacaaugcugaacugcugguccuccuggagaacgaacggacacuugacuaucaugauagcaaugugaaaaaccuguacgagaagguccgcucccagcucaaaaacaaugccaaggagauuggaaacggcuguuuugaguucuaucacaagugcgacaauaccuguauggagagcgugaaaaacgggacauacgauuaucccaaguacucugaagaggccaaacugaauagagaagagaucgacggcguuaaacuugaguccacgcggaucuaucaaauucuggcuaucuacagcaccguggccucuucccucguccuggugguuagccugggagcgauuuccuuuuggaugugcucuaacggcagccuccagugccgcaucuguauuuga

SEQ ID NO: 189300 - RNA, 1701 nt, Artificial Sequence
  derived and/or modified sequence opt5 from hemagglutinin__InfluenzaA__ADU20561
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugggaggcguugcuccccuccaucuggggaaaugcaacaucgccggauggauucugggcaauccugagugugaaucucucagcacagccuccucuuggagcuacaucguggagaccuccucuagcgacaacgggacgugcuauccgggagauuuuauugacuacgaagaacugagagagcagcuuuccagcgucucuuccuucgaacgguuugagaucuuccccaagaccagcucuuggccuaaucacgauuccaacaagggcgugacagccgcuuguccccaugccggcgcgaaaucuuuuuauaagaaucugaucuggcucguuaaaaaggggaacagcuacccuaaacuguccaagagcuauauuaaugacaagggaaaagaagugcuuguccuguggggcauccaccaccccuccaccucugccgaucaacagagccucuaccagaacgcugacgccuacguguucguggggacaucccgcuauagcaagaaauuuaagccugagauugcuaucagaccgaaaguccgggaucaggagggacgcaugaauuacuauuggacccugguugaacccggcgacaagauuacguucgaggccacagggaaccugguggugccuagauacgcguuugccauggaacggaacgcuggaucuggcaucauuaucuccgauacccccguccaugacugcaauacaaccugucaaaccccuaaaggcgccaucaacacaagccuccccuuccagaauauucacccgaucacgauugggaagugcccuaaguaugugaaaucuaccaagcugcgccuugcuacaggacugagaaacguucccagcauccagucccggggccucuuuggggccauugccggauucaucgagggcggguggaccggaaugguggacggcugguacggcuaucaucaccagaaugaacaagggucuggauacgcugcggaucugaaaagcacacagaacgccaucgacaagauuaccaauaaagucaacuccgugaucgagaagaugaauacgcaguuuacagcuguuggcaaggaguucaaccaccuugaaaaacgcauugagaaucugaacaagaaaguggaugacggguuccucgauaucuggaccuacaaugccgaacugcugguccuccuggagaacgaaagaacccuugacuaucaugauagcaaugugaagaaccuguacgagaaaguccggucucagcucaagaacaaugccaaggagauuggaaacggcuguuuugaguucuaucacaaaugcgacaauacauguauggaguccgugaagaacgggaccuacgauuauccuaaauacagcgaagaggcuaagcugaaucgcgaagagaucgacggcguuaaacuugagucuacaagaaucuaucaaauucuggccaucuacuccacgguggcgagcucccucguccuggugguuucucugggagcuauuagcuuuuggaugugcuccaacggcucucuccagugccggaucuguauuuga

SEQ ID NO: 189301 - RNA, 1701 nt, Artificial Sequence
  derived and/or modified sequence opt5 from hemagglutinin__InfluenzaA__ADU20562
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaaaugcaagaucgccggguggauucugggaaacccugagugugaaucucucagcacagcuuccucuuggagcuacaucguggagaccuccucuagcgacaauggcacgugcuauccgggggauuuuauugacuacgaagaacugcgggagcagcuuuccagcgucucuuccuucgaacgcuuugagaucuuccccaagaccagcucuuggccuaaccacgauuccaauaaaggagugacagccgcuuguccccaugccggcgccaagagcuuuuauaaaaaccugaucuggcucguuaagaaaggcaauucuuacccuaagcuguccaagagcuauauuaacgacaaagggaaggaagugcuuguccuguggggaauccaccaccccuccaccucugccgaucaacagagccucuaccagaaugcugacgccuacguguucgugggcacauccagauauagcaaaaaguuuaaaccugagauugcuauccggccgaagguccgcgaucaggaggggagaaugaacuacuauuggacccugguugaacccggagacaaaauuacguucgaggccacaggcaaucugguggugccucgguacgcguuugccauggaacgcaacgcugggucuggaaucauuaucuccgauacccccguccaugacugcaacacaaccugucaaaccccuaagggcgccaucaauacaagccuccccuuccagaacauucacccgaucacgauuggcaagugcccuaaauaugugaagucuaccaaacugagacuugcuacagggcugcggaauguucccagcauccagucccgcggacucuuuggcgccauugccggguucaucgagggaggcuggaccgggaugguggacggaugguacggcuaucaucaccagaacgaacaaggcucuggguacgcugcggaucuuaagagcacacagaaugccaucgacaaaauuaccaacaaggucaauuccgugaucgagaagaugaacacgcaguuuacagcuguuggaaaagaguucaaucaccuugaaaagagaauugagaaccugaauaaaaagguggaugacggcuuccucgauaucuggaccuacaacgccgaacugcugguccuccuggagaaugaacggacccuugacuaucaugauagcaacgugaaaaaucuguacgagaagguccgcucucagcucaagaacaacgccaaagagauugggaauggauguuuugaguucuaucacaagugcgacaacacauguauggaguccgugaaaaauggcaccuacgauuauccuaaguacagcgaagaggcuaaacugaacagagaagagaucgacgggguuaagcuggagucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 189302 - RNA, 1701 nt, Artificial Sequence
  derived and/or modified sequence opt5 from hemagglutinin__InfluenzaA__ADU25478
auggaggccaagcuguucgugcucuuuugcgcuuucaccgcccugaaagcggacacaaucugugucggcuaccacgcuaacaauagcacggauaccguugacacaauucuugaaagaaacgugaccgugacacauuccgucaaucugcucgagucuagccacaacgggaagcugugcucccuuaauggaaaagcuccccugcagcucggcaacuguaauguggccggguggauccugggaaacccugaaugcgaucugcuccugaccguuaauucuuggagcuauauuaucgagacauccaccucuaagaacggcgccuguuacccgggggaauuugccgacuaugaggagcuucgggaacaacugagcacgguguccagcuucgagcgcuuugaaauuuuccccaaagcuaccucuuggccuaaucaugagacaaccaagggaacaaccgucgccugcucccacagcggcgcgaacucuuuuuacagaaaucuccuguggaucgugaagaaaggcaacuccuaucccaaacuuagcaagucuuacacgaauaacaaggggaaagagguucuggugaucuggggaguccaucacccucccacagauuccgaccagcagacccucuaucagaacaaucacacauacgugagcgugggcuccucuaaguacuaucaacgguucaccccugaaauugucacccgcccgaagguuagagagcaggccgggcggaugaacuacuauuggacacugcuggaucagggagacacgaucaccuuugaagcuacaggcaaucucauugcccccuggcaugcuuucgcccugaacaaagggagcuccagcggaaucaugaugucugaugcgcacgugcauaauuguaccacaaagugccagaccccucacggcgcccuuaaauccaaccugcccuuucaaaaugugcacccuauuacgaucggcgagugucccaaguacgucaaaagcacacagcuccgcauggcuaccgggcugagaaacauuccgucuauccagagccggggacuuuucggcgccaucgcuggguuuauugaaggaggcuggaccgggaugaucgacggaugguauggcuaccaucaccagaaugagcaaggcuccggguaugccgccgaucagaagucuacacagauugcuaucgacggaauuagcaacaaaguuaauuccgugaucgagaagaugaacgugcaauucaccagcgucggcaaggaguucaauaaccuggaaaaacgcaucgaaaaucucaacaagaaaguggaugacggguuucuggacauuuggacauacaacgcggagcugcucauccugcuugaaaaugagagaacgcuggauuuccaugacuuuaacguuaagaaucucuacgagcgggugaaaucucagcugcgcaacaaugccaaggaaauuggaaacggcugcuucgaguuuuaucacaaguguaauaacgaaugcauggaguccgucaaaaaugggaccuacaacuauccuagauacagcgaagagucuaaacuuaaucgggaggaaaucgauggcgugaagcuggaguccgucggagugcaucagauucucgcuaucuauagcacaguugccuccucucuggugcugcucgucagccugggcgccaucuccuucuggaugugcucuaacgggagccuucagugucgcauuugcaucuga

SEQ ID NO: 189303 - RNA, 1701 nt, Artificial Sequence
  derived and/or modified sequence opt5 from hemagglutinin__InfluenzaA__ADU59558
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgggcaggagggaagaaugaauuacuauuggacccugguugaacccggcgauaagauuacguucgaggccacagggaaccugguggugccucgguacgcguuugccauggaacgcaacgcuggaucuggcaucauuaucuccgacacccccguccaugauugcaauacaaccugucaaaccccuaaaggcgccaucaacacaagccuccccuuccagaauauucacccgaucacgauugggaagugcccuaaguaugugaaaucuaccaagcugagacuugcuacaggacugcggaacguucccagcauccagucccgcggccucuuuggggccauugccggauucaucgagggcggguggaccggaaugguggacggcugguacggcuaucaucaccagaaugaacaagggucuggauacgcugcggaccugaaaagcacacagaacgccaucgauaagauuaccaauaaagucaacuccgugaucgagaagaugaauacgcaguuuacagcuguuggcaaggaguucaaccaccuugagaaaagaauugagaaucugaacaagaaaguggacgauggguuccucgacaucuggaccuacaaugccgaacugcugguccuccuggagaacgaacggacccuugauuaucaugacagcaaugugaagaaccuguacgagaaaguccgcucucagcucaagaacaaugccaaggagauuggaaacggcuguuuugaguucuaucacaaaugcgauaauacauguauggaauccgugaagaacgggaccuacgacuauccuaaauacagcgaagaggcuaagcugaauagagaagagaucgauggcguuaaacuugagucuacacggaucuaucaaauucuggccaucuacuccacgguggcgagcucccucguccuggugguuucucugggagcuauuagcuuuuggaugugcuccaacggcucucuccagugccgcaucuguauuuga

SEQ ID NO: 189304 - RNA, 1701 nt, Artificial Sequence; identical to SEQ ID NO: 185693
  derived and/or modified sequence opt5 from hemagglutinin__InfluenzaA__ADU59579

SEQ ID NO: 189305 - RNA, 1701 nt, Artificial Sequence; identical to SEQ ID NO: 185693
  derived and/or modified sequence opt5 from hemagglutinin__InfluenzaA__ADU59590

SEQ ID NO: 189306 - RNA, 1701 nt, Artificial Sequence; identical to SEQ ID NO: 185693
  derived and/or modified sequence opt5 from hemagglutinin__InfluenzaA__ADU59601

SEQ ID NO: 189307 - RNA, 1701 nt, Artificial Sequence; identical to SEQ ID NO: 185693
  derived and/or modified sequence opt5 from hemagglutinin__InfluenzaA__ADU59612

SEQ ID NO: 189308 - RNA, 1701 nt, Artificial Sequence; identical to SEQ ID NO: 185693
  derived and/or modified sequence opt5 from hemagglutinin__InfluenzaA__ADU59768

SEQ ID NO: 189309 - RNA, 1701 nt, Artificial Sequence; identical to SEQ ID NO: 185693
  derived and/or modified sequence opt5 from hemagglutinin__InfluenzaA__ADU59769

SEQ ID NO: 189310 - RNA, 1701 nt, Artificial Sequence; identical to SEQ ID NO: 185693
  derived and/or modified sequence opt5 from hemagglutinin__InfluenzaA__ADU59771

SEQ ID NO: 189311 - RNA, 1701 nt, Artificial Sequence; identical to SEQ ID NO: 185693
  derived and/or modified sequence opt5 from hemagglutinin__InfluenzaA__ADU59772

SEQ ID NO: 189312 - RNA, 1701 nt, Artificial Sequence; identical to SEQ ID NO: 185693
  derived and/or modified sequence opt5 from hemagglutinin__InfluenzaA__ADU59774

SEQ ID NO: 189313 - RNA, 1701 nt, Artificial Sequence; identical to SEQ ID NO: 185693
  derived and/or modified sequence opt5 from hemagglutinin__InfluenzaA__ADU59906

SEQ ID NO: 189314 - RNA, 1701 nt, Artificial Sequence; identical to SEQ ID NO: 185693
  derived and/or modified sequence opt5 from hemagglutinin__InfluenzaA__ADU59916

SEQ ID NO: 189315 - RNA, 1701 nt, Artificial Sequence; identical to SEQ ID NO: 185693
  derived and/or modified sequence opt5 from hemagglutinin__InfluenzaA__ADU76756

SEQ ID NO: 189316 - RNA, 1701 nt, Artificial Sequence; identical to SEQ ID NO: 185693
  derived and/or modified sequence opt5 from hemagglutinin__InfluenzaA__ADU76757

SEQ ID NO: 189317 - RNA, 1701 nt, Artificial Sequence; identical to SEQ ID NO: 185693
  derived and/or modified sequence opt5 from hemagglutinin__InfluenzaA__ADU76758

SEQ ID NO: 189318 - RNA, 1701 nt, Artificial Sequence; identical to SEQ ID NO: 185693
  derived and/or modified sequence opt5 from hemagglutinin__InfluenzaA__ADU76759

SEQ ID NO: 189319 - RNA, 1701 nt, Artificial Sequence; identical to SEQ ID NO: 186053
  derived and/or modified sequence opt5 from hemagglutinin__InfluenzaA__ADU76761

SEQ ID NO: 189320 - RNA, 1701 nt, Artificial Sequence; identical to SEQ ID NO: 185693
  derived and/or modified sequence opt5 from hemagglutinin__InfluenzaA__ADU76762

SEQ ID NO: 189321 - RNA, 1701 nt, Artificial Sequence
  derived and/or modified sequence opt5 from hemagglutinin__InfluenzaA__ADU76764
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggaggccuccucuagcaacaaugggaccugcuauccgggcgacuuuauugauuacgaagaacugcgggagcagcuuuccagcgucucuuccuucgaacgcuuugagaucuuccccaagacgagcucuuggccuaaccacgacuccaauaagggagugaccgcugccuguccccaugcgggcgccaagagcuuuuauaagaaccugaucuggcucguuaaaaagggcaauucuuacccuaaacuguccaagagcuauauuaacgauaaggggaaagaagugcuuguccuguggggaauccaccaccccuccacaucugcugaccaacagagccucuaccagaaugccgaugcuuacguguucgugggcaccuccagauauagcaagaaauuuaagccugagauugccauccggccgaaaguccgcgaccaggaggggagaaugaacuacuauuggacacugguugaacccggagauaagauuaccuucgaggcgacgggcaaccugguggugccucgguacgccuuugcuauggaacgcaaugccgggucuggaaucauuaucuccgacacacccguccaugauugcaacaccacaugucaaaccccuaaaggcgcuaucaauaccagccuccccuuccagaacauucacccgaucacaauuggcaagugcccuaaguaugugaaaucuacgaagcugagacuugccaccgggcugcggaauguucccagcauccagucccgcggacucuuuggcgccauugcuggguucaucgagggaggcuggacagggaugguggacggaugguacggcuaucaucaccagaacgaacaaggcucuggguacgcggccgaccugaaaagcacccagaaugcuaucgaugagauuacaaacaaggucaauuccgugaucgagaaaaugaacacccaguuuauugccguuggaaaggaguucaaucaccuugagaagagaaucgaaaaccugaauaaaaagguggacgauggcuuccucgacauuuggacguacaacgccgagcugcugguccuccuggaaaaugagcggacacuugauuaucaugacagcaacgugaaaaaccuguacgagaagguccgcucucagcucaaaaauaacgcuaaggaaaucgggaauggauguuuugaguucuaucacaagugcgauaacaccuguauggaauccgugaaaaauggcaccuacgacuauccuaaguacagcgaggaagccaaacugaacagagaggagaucgaugggguuaaacuugaaucuacacggauuuaucaaauccuggcgauuuacuccaccguggcuagcucccucguccuggugguuucucugggcgccaucagcuuuuggaugugcuccaauggaucucuccagugccgcauuuguaucuga

SEQ ID NO: 189322 - RNA, 1701 nt, Artificial Sequence
  derived and/or modified sequence opt5 from hemagglutinin__InfluenzaA__ADU76765
augaaggccauccugauugugcuccuguacaccuucgcuacagccaacgcggacacgcuuugcaucggcuaucacgcuaauaacagcaccgauacagucgacaccguucuggagaagaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccaagagcuauaucaaugacaaggggaaagaaguucuugugcuguggggcauucaccaccccuccaccucugccgaucaacagagccucuaccagaacgcugacgccuacgucuucgugggaacauccagauauagcaagaaauuuaagccugagaucgcuauucggccgaaagugcgcgaucaggaggggagaaugaauuacuauuggacccuggucgaacccggagacaagaucacguucgaggccacaggcaaccugguugugccucgguacgcguuugccauggaacgcaacgcugggucuggaauuaucaucuccgauacccccgugcaugacugcaauacaaccugucaaaccccuaaaggcgccauuaacacaagccuccccuuccagaauauccacccgauuacgaucggcaagugcccuaaguaugucaaaucuaccaagcugagacuugcuacagggcugcggaacgugcccagcauucagucccgcggacucuuuggcgccaucgccggguucaucgagggaggcuggaccgggaugguugacggaugguacggcuaucaucaccagaaugaacaaggcucuggguacgcugcggaucugaaaagcacacagaacgccauugacgagaucaccaauaaggugaacuccgucauugagaaaaugaauacgcaguuuacagcugugggaaaggaguucaaccaccuugagaagagaaucgaaaaucugaacaaaaagguugaugacggcuuccucgauauuuggaccuacaaugccgagcugcuggugcuccuggaaaacgagcggacccuugacuaucaugauagcaaugucaaaaaccuguacgagaaggugcgcucucagcucaaaaacaaugccaaggaaaucgggaacggauguuuugaguucuaucacaagugcgacaauacauguauggaauccgucaaaaacggcaccuacgauuauccuaaguacagcgaggaagcuaaacugaauagagaggagaucgacggggugaaacuugaaucuacacggauuuaucaaauccuggccauuuacuccagcguugcguccucucucgugcuggucgugagccugggcgcuaucuccuuuuggaugugcucuaacggaagccuccagugccgcauuuguaucuga

SEQ ID NO: 189323 - RNA, 1701 nt, Artificial Sequence; identical to SEQ ID NO: 187290
  derived and/or modified sequence opt5 from hemagglutinin__InfluenzaA__ADU76766

SEQ ID NO: 189324 - RNA, 1701 nt, Artificial Sequence
  derived and/or modified sequence opt5 from hemagglutinin__InfluenzaA__ADU76767
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaccugaaaagcacacagaacgccaucgauaagauuaccaauaaagucaacuccgugaucgagaagaugaauacgcaguuuacagcuguuggaaaggaguucaaccaccuugagaaaagaauugaaaaucugaacaagaaaguggacgauggcuuccucgacaucuggaccuacaaugccgagcugcugguccuccuggaaaacgagcggacccuugauuaucaugacagcaaugugaagaaccuguacgagaaaguccgcucucagcucaagaacaaugccaaggaaauugggaacggauguuuugaguucuaucacaaaugcgauaauacauguauggaauccgugaagaacggcaccuacgacuauccuaaauacagcgaggaagcuaagcugaauagagaggagaucgaugggguuaaacuugaaucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 189325 - RNA, 1701 nt, Artificial Sequence
  derived and/or modified sequence opt5 from hemagglutinin__InfluenzaA__ADU76768
augaaggccauccuggugguccuccuguacaccuucgcuauugccaacgcggacacacuuugcaucggcuaucacgcuaauaacagcacggauaccguugacacagugcuggagaaaaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacauccucuagcgacaacggaaccugcuauccgggggauuuuaucgacuacgaagaacugcgggagcagcuuuccagcgucucuuccuucgaacgcuuugagaucuuccccaagacgagcucuuggccuaaucacgauuccaacaagggagugaccgccgcuuguccccaugccggcgcgaaaucuuuuuauaagaaucugauuuggcucguuaaaaagggcaacagcuacccuaaacuguccaagagcuauaucaaugacaaggggaaagaagugcuuguccuguggggcauucaccaccccuccacaucugccgaucaacagagccucuaccagaacgcugacgccuacguguucgugggcaccuccaaguauagcaaaaaguuuaaaccugagaucgcuauuagaccgaagguccgggaucaggaggggcgcaugaauuacuauuggacacugguugaacccggagacaaaaucaccuucgaggccacgggcaaccugguggugccuagauacgcguuugccauggaacggaacgcugggucuggaauuaucaucuccgauacacccguccaugacugcaauaccacaugucaaaccccuaagggcgccauuaacaccagccuccccuuccagaauauccacccgauuacaaucggcaagugcccuaaauaugugaagucuacgaaacugcgccuugcuaccgggcugagaaacguucccagcauucagucccggggacucuuuggcgccaucgccggguucaucgagggaggcuggacagggaugguggacggaugguacggcuaucaucaccagaaugaacaaggcucuggguacgcugcggaucuuaagagcacccagcacgccauugacgagaucacaaacaaagucaauuccgugauugagaagaugaacacccaguuuacggcuguuggaaaggaguucaaucaucuggagaaacgcaucgaaaaccugaauaagaaaguggaugacggcuuccucgauauuuggacauacaacgccgagcugcugguccuccuggaaaaugagagaacccuugacuaucacgauagcaacgugaagaaucuguacgagaaaguccggucucagcucaagaacaacgccaaggaaaucgggaauggauguuuugaguucuaucauaaaugcgacaacaccuguauggaauccgugaagaauggcacauacgauuauccuaaauacagcgaggaagcuaagcugaaccgcgaggagaucaaugggguuaaacuugaaucuaccagaauuuaucaaauccuggccauuuacuccacaguggcgagcucccucguccuggugguuucucugggcgcuaucagcuuuuggaugugcuccaacggaucucuccagugccggauuuguaucuga

SEQ ID NO: 189326 - RNA, 1701 nt, Artificial Sequence; identical to SEQ ID NO: 185693
  derived and/or modified sequence opt5 from hemagglutinin__InfluenzaA__ADU76769

SEQ ID NO: 189327 - RNA, 1701 nt, Artificial Sequence; identical to SEQ ID NO: 185693
  derived and/or modified sequence opt5 from hemagglutinin__InfluenzaA__ADU76770

SEQ ID NO: 189328 - RNA, 1701 nt, Artificial Sequence; identical to SEQ ID NO: 185693
  derived and/or modified sequence opt5 from hemagglutinin__InfluenzaA__ADU76771

SEQ ID NO: 189329 - RNA, 1701 nt, Artificial Sequence; identical to SEQ ID NO: 186438
  derived and/or modified sequence opt5 from hemagglutinin__InfluenzaA__ADU76772

SEQ ID NO: 189330 - RNA, 1701 nt, Artificial Sequence; identical to SEQ ID NO: 185693
  derived and/or modified sequence opt5 from hemagglutinin__InfluenzaA__ADU76774

SEQ ID NO: 189331 - RNA, 1701 nt, Artificial Sequence; identical to SEQ ID NO: 185693
  derived and/or modified sequence opt5 from hemagglutinin__InfluenzaA__ADU76775

SEQ ID NO: 189332 - RNA, 1701 nt, Artificial Sequence; identical to SEQ ID NO: 185693
  derived and/or modified sequence opt5 from hemagglutinin__InfluenzaA__ADU76776

SEQ ID NO: 189333 - RNA, 1701 nt, Artificial Sequence; identical to SEQ ID NO: 185693
  derived and/or modified sequence opt5 from hemagglutinin__InfluenzaA__ADU76777

SEQ ID NO: 189334 - RNA, 1701 nt, Artificial Sequence; identical to SEQ ID NO: 185693
  derived and/or modified sequence opt5 from hemagglutinin__InfluenzaA__ADU76778

SEQ ID NO: 189335 - RNA, 1701 nt, Artificial Sequence; identical to SEQ ID NO: 188551
  derived and/or modified sequence opt5 from hemagglutinin__InfluenzaA__ADU76779

SEQ ID NO: 189336 - RNA, 1701 nt, Artificial Sequence; identical to SEQ ID NO: 185693
  derived and/or modified sequence opt5 from hemagglutinin__InfluenzaA__ADU76780

SEQ ID NO: 189337 - RNA, 1701 nt, Artificial Sequence; identical to SEQ ID NO: 187290
  derived and/or modified sequence opt5 from hemagglutinin__InfluenzaA__ADU76781

SEQ ID NO: 189338 - RNA, 1701 nt, Artificial Sequence; identical to SEQ ID NO: 186053
  derived and/or modified sequence opt5 from hemagglutinin__InfluenzaA__ADU76782

SEQ ID NO: 189339 - RNA, 1701 nt, Artificial Sequence
  derived and/or modified sequence opt5 from hemagglutinin__InfluenzaA__ADU76784
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcaacaauggcacgugcuauccgggggacuuuauugauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaccugguggugccucgguacgcguuugccauggaacgcaaugcugggucuggaaucauuaucuccgacacccccguccaugauugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggacggaugguacggcuaucaucaccagaacgaacaaggcucuggguacgcugcggaccugaaaagcacacagaaugccaucgaugagauuaccaacaaggucaauuccgugaucgagaaaaugaacacgcaguuuacagcuguuggaaaggaguucaaucaccuugagaagagaauugaaaaccugaauaaaaagguggacgauggcuuccucgacaucuggaccuacaacgccgagcugcugguccuccuggaaaaugagcggacccuugauuaucaugacagcaacgugaaaaaccuguacgagaagguccgcucucagcucaaaaauaacgccaaggaaauugggaauggauguuuugaguucuaucacaagugcgauaacacauguauggaauccgugaaaaauggcaccuacgacuauccuaaguacagcgaggaagcuaaacugaacagagaggagaucgaugggguuaaacuugaaucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 189340 - RNA, 1701 nt, Artificial Sequence; identical to SEQ ID NO: 185693
  derived and/or modified sequence opt5 from hemagglutinin__InfluenzaA__ADU76785

SEQ ID NO: 189341 - RNA, 1701 nt, Artificial Sequence; identical to SEQ ID NO: 185693
  derived and/or modified sequence opt5 from hemagglutinin__InfluenzaA__ADU76786

SEQ ID NO: 189342 - RNA, 1701 nt, Artificial Sequence
  derived and/or modified sequence opt5 from hemagglutinin__InfluenzaA__ADU76787
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccacaauauucauucuaucacgauuggcaagugcccgaaguaugugaaaagcaccaagcugagacuugcuacagggcugcggaacguuccuuccauccagucucgcggacucuuuggcgccauugccggguucaucgaaggaggcuggaccgggaugguggacggaugguacggcuaucaccaccagaaugagcagggcagcggguacgcugcggaccugaaauccacacaaaacgccaucgaugagauuaccaauaaggucaacagcgugaucgaaaagaugaauacgcaguuuacagcuguuggaaaggaguucaaccaucuugaaaagagaauugagaaucugaacaaaaagguggacgauggcuuccucgacaucuggaccuacaaugccgaacugcugguccuccuggagaacgagcggacccuugauuaucacgacucuaaugugaaaaaccuguacgaaaagguccgcucccagcucaaaaacaaugccaaggagauugggaacggauguuuugaguucuaucauaagugcgauaauacauguauggagagcgugaaaaacggcaccuacgacuaucccaaguacucugaagaggcuaaacugaauagagaggaaaucgaugggguuaaacuugaguccacacggaucuaucagauucuggccaucuacagcacgguggcguccucucucguccuggugguuagccugggcgcuauuuccuuuuggaugugcucuaacggaagccuccaaugccgcaucuguauuuga

SEQ ID NO: 189343 - RNA, 1701 nt, Artificial Sequence; identical to SEQ ID NO: 189324
  derived and/or modified sequence opt5 from hemagglutinin__InfluenzaA__ADU76788

SEQ ID NO: 189344 - RNA, 1701 nt, Artificial Sequence; identical to SEQ ID NO: 189324
  derived and/or modified sequence opt5 from hemagglutinin__InfluenzaA__ADU76789

SEQ ID NO: 189345 - RNA, 1701 nt, Artificial Sequence; identical to SEQ ID NO: 185693
  derived and/or modified sequence opt5 from hemagglutinin__InfluenzaA__ADU76790

SEQ ID NO: 189346 - RNA, 1701 nt, Artificial Sequence; identical to SEQ ID NO: 185693
  derived and/or modified sequence opt5 from hemagglutinin__InfluenzaA__ADU76791

SEQ ID NO: 189347 - RNA, 1701 nt, Artificial Sequence; identical to SEQ ID NO: 189324
  derived and/or modified sequence opt5 from hemagglutinin__InfluenzaA__ADU76792

SEQ ID NO: 189348 - RNA, 1701 nt, Artificial Sequence
  derived and/or modified sequence opt5 from hemagglutinin__InfluenzaA__ADU76793
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaaaaguuugagaucuuccccaagaccagcucuuggccuaaucacgauuccaacaaaggagugacagccgcuuguccccaugccggcaccaagagcuuuuauaaaaaucugaucuggcucguuaagaaaggcaacucuuacccuaagcuguccaagagcuauauuaaugacaaagggaaggaagugcuuguccuguggggaauccaccaccccuccacaucugcggaucaacagagccucuaccagaacgccgacgcuuacguguucgugggcaccucccgcuauagcaaaaaguuuaaaccugagauugccaucagaccgaagguccgggaucaggaggggcgcaugaauuacuauuggacgcugguugaacccggagacaaaauuacauucgaggcuaccggcaaccugguggugccuagauacgccuuugcgauggaacggaacgccgggucuggaaucauuaucuccgauacacccguccaugacugcaauaccaccugucaaacaccuaagggcgcuaucaacacgagccuccccuuccagaauauucacccgaucaccauuggcaagugcccuaaauaugugaagucuacaaaacugcgccuugccaccgggcugagaaacguucccagcauccagucccggggacucuuuggcgcuauugccggguucaucgagggaggcuggacagggaugguggacggaugguacggcuaucaucaccagaaugaacaaggcucuggguacgccgcugaucuuaagagcacccagaacgcgaucgacaaaauuacgaauaaggucaacuccgugaucgagaagaugaauacacaguuuaccgccguuggaaaagaguucaaccaccuugaaaagcgcauugagaaucugaacaaaaagguggaugacggcuuccucgauaucuggaccuacaaugcugaacugcugguccuccuggagaacgaaagaacacuugacuaucaugauagcaaugugaaaaaccuguacgagaagguccggucucagcucaagaacaaugccaaagagauugggaacggauguuuugaguucuaucacaagugcgacaauaccuguauggaguccgugaaaaacggcacauacgauuauccuaaguacagcgaagaggccaaacugaaucgcgaagagaucgacgggguuaagcuggagucuacgagaaucuaucaaauucuggcuaucuacuccaccguggccagcucccucguccuggugguuucucugggcgcgauuagcuuuuggaugugcuccaacggaucucuccagugccggaucuguauuuga

SEQ ID NO: 189349 - RNA, 1701 nt, Artificial Sequence
  derived and/or modified sequence opt5 from hemagglutinin__InfluenzaA__ADU85911
augaaggccaucauugugguccugcucuacaccuucgcuacagccgacgcggauacgcugugcaucggcuaucacgcuaacaauagcaccgacacaguugauaccgugcuugagaaaaacgugacagucacccauuccgugaaucugcucgaaaacaagcacaaugggaaacuguguaaacuuggaggcauugcuccccugcaucucgggaaaugcgacaucgccggauggcugcugggcaacccugagugugaaucucucuuuacagccagcuccuggucuuacauuguugagaccccgaauagcgauaacgggacgugcuaucccggagacuucaucaauuacgaggaacugagagagcaccuuuccucugugagcuccuuugaacgguucgagaucuuuccuaaggccaacagcuggcccaaucaugauaccaacaagggcgucacagcugccuguccuuaugcgggcgccaauucuuucuaccgcaaccugauuuggcucgugaaaaaggggaauagcuaucccaaacugagcaagucuuacaucaacaacaaaaagaaggaaguucuugugauuuggggaauccaccacccuccgaccuccacagaccagcaaacccuguaccagaaugcugaugccuaugucuuugugggcagcucuaaauacuccaagagauucaaacccgagauugcugcccggccuaaggugcgcgaccaggcggggagaauggauuauuacuggacgcucaucgagcccggagacacaauuaccuuugaagccacaggcaaccuggucguuccucgguaugcuuucgccaugaaacgcgggagcggauccggcaucaucgugucugaugcucccgugcaugacugcaauaccaccugucagacaccgaagggcgccauuaacacgagccugccuuuucaaaauauccaccccgucaccauuggggagugcccuaaauacgugaaguccacaaagcucagaauggccaccggacugcggaacauccccagcauucagucucgcggccuuuucggggcuaucgcgggauuucuggaaggcggguggacaggaaugaucgacggcugguauggcuaccaucaccagaaugagcagggguccggauacgccgcugaucaaaaauccacccagaacgccauugacggcaucacgaauaagguuaacucuauuaucgaaaagaugaauacacaguucaccgccguggggaaggaguucagccagcucgagaaaagaauugaaucccugaacaauaaggucgaugacggauuucuugauaucuggaccuauaacgcugagcugcucgugcugcuggaaaaugagcggacacucgacuaccacgauucuaacguuaagaaccuguaugaaaaagugcgcagccaacuuaagaauaacgccaaagagaucggcaauggguguuucgaguuuuaccauaagugcgacaacaccuguauggaauccgucaaaaauggcacauaugauuaccccaaguauagcgaggaagcgaagcugaacagagaggaaauugacggagugaaacucgagucugcucggaucuaccagauucuggccaucuacuccacggucgccagcucucuugugcugcucguuucccugggcgcuauuagcuucuggaugugcuccaaugggucucugcagugccgcaucuguauuuga

SEQ ID NO: 189350 - RNA, 1701 nt, Artificial Sequence; identical to SEQ ID NO: 186857
  derived and/or modified sequence opt5 from hemagglutinin__InfluenzaA__ADV17283

SEQ ID NO: 189351 - RNA, 1701 nt, Artificial Sequence; identical to SEQ ID NO: 186857
  derived and/or modified sequence opt5 from hemagglutinin__InfluenzaA__ADV17293

SEQ ID NO: 189352 - RNA, 1701 nt, Artificial Sequence
  derived and/or modified sequence opt5 from hemagglutinin__InfluenzaA__ADV17303
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuaaagggcugcggaacguucccagcauccagucccgcggacucuuuggcgccauugccggguucaucgagggaggcuggacagggaugguggacggaugguacggcuaucaucaccagaaugaacaaggcucuggguacgcugcggaucuuaagagcacccagaacgccaucgacgagauuacaaauaaagucaacuccgugaucgagaagaugaauacccaguuuacggcuguuggaaaggaguucaaccaccuggagaaaagaauugaaaaucugaacaagaaaguggaugacggcuuccucgauaucuggacauacaaugccgagcugcugguccuccuggaaaacgagcggacccuugacuaucaugauagcaaugugaagaaccuguacgagaaaguccgcucucagcucaagaacaaugccaaggaaauugggaacggauguuuugaguucuaucacaaaugcgacaauaccuguauggaauccgugaagaacggcacauacgauuauccuaaauacagcgaggaagcuaagcugaauagagaggagaucgacgggguuaaacuugaaucuacccggaucuaucaaauucuggccaucuacuccacaguggcgagcucccucguccuggugguuucucugggcgcuauuagcuuuuggaugugcuccaacggaucucuccagugccgcaucuguauuuga

SEQ ID NO: 189353 - RNA, 1701 nt, Artificial Sequence; identical to SEQ ID NO: 186857
  derived and/or modified sequence opt5 from hemagglutinin__InfluenzaA__ADV17313

SEQ ID NO: 189354 - RNA, 1701 nt, Artificial Sequence
  derived and/or modified sequence opt5 from hemagglutinin__InfluenzaA__ADV17323
augaaggccauccuggugguccuccuguacaccuucgcuacaacgaacgccgacacccuuugcauuggcuaucacgcgaauaacagcacagauaccguugacacagugcuggagaagaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaaauagcuggccuaaccacgauucuaauaagggagugaccgcugccuguccccaugcuggcgccaaauccuuuuauaagaaccugaucuggcucguuaaaaagggcaauagcuacccuaaacugucuaaguccuauauuaacgacaaggggaaagaagugcuuguccuguggggaauccaccaccccagcacauccgcggaucaacagggccucuaccagaaugccgacgcuuacguguucguggggaccucuagauauagcaagaaauuuaagccugagauugccauccggccgaaaguccgcgaucaggagggaagaaugaacuacuauuggacgcugguugaacccggcgacaagauuacauucgaggcuaccgggaaccugguggugccucgguacgccuuugcgauggaacgcaaugccggauccggcaucauuaucagcgauacacccguccaugacugcaacaccaccugucaaacaccugagggcgcuaucaauacgucucuccccuuccagaacauucacccgaucaccauugggaaaugcccuaaguaugugaaguccacaaaacugagacuugccaccggacugcggaauguucccagcauccagucucgcggccucuuuggggcuauugccggauucaucgaaggcggguggacaggaaugguggacggcugguacggcuaucaucaccagaacgagcaagggagcggauacgccgcugaucugaaguccacccagaaugcgaucgacaaaauuacgaacaaggucaauuacgugaucgagaaaaugaacacacaguuuaccgccguuggcaaggaguucaaucaccuugagaagagaauugaaaaccugaauaaaaagguggaugacggguuccucgauaucuggaccuauaacgcugagcugcugguccuccuggaaaaugagcggacacuugacuaccaugauucuaacgugaaaaaccuguaugagaagguccgcagccagcucaaaaauaacgccaaggaaauuggaaauggcuguuuugaguucuaccacaagugcgacaacaccuguauggaauccgugaaaaaugggacauaugauuacccuaaguauagcgaggaagccaaacugaacagagaggagaucgacggcguuaaacuugaaucuacgcggaucuaccaaauucuggcuaucuacuccaccguggccagcucucucguccuggugguuucccugggagcgauuagcuuuuggaugugcuccaauggcucucuccagugccgcaucuguauuuga

SEQ ID NO: 189355 - RNA, 1701 nt, Artificial Sequence
  derived and/or modified sequence opt5 from hemagglutinin__InfluenzaA__ADV17333
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagaaccucuaccagaaugcugacgccuacguguucgugggcacaagcagauauuccaagaaauuuaagccugagauugcuauccggccgaaaguccgcgaucaggaggggagaaugaacuacuauuggacccugguugaacccggagacaagauuacguucgaggccacaggcaaccugguggugcuccgguacgcguuugccauggaacgcaaugcugggagcggaaucauuaucucugauaccccuguccaugacugcaacacaaccugucaaacccccaaaggcgccaucaauacaucccugccuuuccagaacauucaccccaucacgauuggcaagugcccgaaguaugugaaaagcaccaaacuuagacuggcuacagggcuccggaauguuccuucuauccagagccgcggacuguuuggcgccauugccggguucaucgagggaggcuggaccgggaugguggacggaugguacggcuaucaucaccagaacgaacaaggcuccggguacgcugcggaucuuaaaucuacacagaaugccaucgacaagauuaccaacaaagucaauagcgugaucgagaagaugaacacgcaguuuacagcuguuggaaaggaguucaaucaccuggaaaagagaauugagaaccucaauaagaaaguggaugacggcuuccuggauaucuggaccuacaacgccgaacugcucguccugcuugagaaugaacggacccuggacuauuacgauuccaacgugaagaaccucuaugagaaaguccgcagccagcugaagaauaacgccaaggagauugggaauggauguuuugaguucuaccauaaaugcgacaacacauguauggagucugugaagaauggcaccuaugauuaccccaaauauuccgaagaggcuaaacuuaacagagaagagaucgacgggguuaagcuggagagcacacggaucuaccaaauucucgugaucuacucuacggucgccuccagccuggugcugguugugucccucggcgcgauuucuuuuuggaugugcagcaauggaucccugcagugccgcaucuguauuuga

SEQ ID NO: 189356 - RNA, 1701 nt, Artificial Sequence; identical to SEQ ID NO: 185693
  derived and/or modified sequence opt5 from hemagglutinin__InfluenzaA__ADV19019

SEQ ID NO: 189357 - RNA, 1701 nt, Artificial Sequence; identical to SEQ ID NO: 186178
  derived and/or modified sequence opt5 from hemagglutinin__InfluenzaA__ADV41677

SEQ ID NO: 189358 - RNA, 1701 nt, Artificial Sequence
  derived and/or modified sequence opt5 from hemagglutinin__InfluenzaA__ADV58939
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuaaguccuauauuaaugacaagggaaaagaagugcuuguccuguggggcauccaccaccccagcaccacagccgaucaacagucccucuaccagaacgcugacaccuacguguucguggggacgucuagauauagcaagaaauuuaagccugagauugccauccggccgaaaguccgcgaucaggagggaagaaugaauuacuauuggacacugguugaacccggcgacaagauuaccuucgaggcuacagggaaccugguggugccucgguacgccuuugcgauggaacgcaacgccggauccggcaucauuaucagcgauacccccguccaugacugcaauaccacaugucaaacgccuaaaggcgcuaucaacaccucucuccccuuccagaauauucacccgaucacaauugggaagugcccuaaguaugugaaauccaccaagcugagacuugccacaggacugcggaacguucccagcauccagucucgcggccucuuuggggcuauugccggauucaucgagggcggguggaccggaaugguggacggcugguacggcuaucaucaccagaaugaacaagggagcggauacgccgcugaucugaaauccacgcagaacgcgaucgacaagauuacaaauaaagucaacucugugaucgagaagaugaauacccaguuuaccgccguuggcaaggaguucaaccaccuugagaaaagaauugagaaucugaacaagaaaguggaugacggguuccucgauaucuggacauacaaugcugaacugcugguccuccuggagaacgaacggacccuugacuaucaugauagcaaugugaagaaccuguacgagaaaguccgcaaccagcucaagaauaacgccaaggagauuggaaauggcuguuuugaguucuaucacaaaugcgacaacacauguauggaauccgugaagaaugaaacguacgauuauccuaaauacagcgaggaagccaagcugaacagagaggagaucgacgggguuaaacuugaaucuacccggaucuaucaaauucuggcuaucuacuccacaguggccagcucucucguccuggugguuucccugggcgcgauuagcuuuuggaugugcuccaauggaucucuccagugccgcaucuguauuuga

SEQ ID NO: 189359 - RNA, 1698 nt, Artificial Sequence
  derived and/or modified sequence opt5 from hemagglutinin__InfluenzaA__ADV69074
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguaacguugcuggguggauucucggaaauccugagugcgaacugcuuaucagcaaagaguccuggucuuacauuguggaaaccccggaccccgagaacggcacguguuauccuggguacuuuaccgauuaugaggaacugagagagcaacucagcuccgucucuagcuucaagcgguuugaaaucuuccccaaggaguccagcuggccuaaucauacagugaccggaguuucugccuccugcagccacaacggcaaaucuuccuuuuaccgcaaucugcuuuggcugacagugaagaacggccucuaucccaaucugagcaaaucuuacaccaacgacaaggagaaagaaguccuggugcucuggggagugcaucacccuccguccaucggggaucagagaacgcuguaccacacagagaaugccuaugucagcguuguguccucucauuacagccggcgcuucacccccgaaauugugaagagaccuaagguccgggaccaggagggccgcaucaacuauuacuggacacuucuggaacccggggauaccauuaucugugaggcuaacggaaaucucauugccccuagauaugcuuuugcccugucccggggccuugggagcggaaucauuaccucuaacgcgcccaugggcgagugcaaugccaaaugucagacaccgcaaggcgcuaucaacuccagccugccuuuccagaaugugcaccccguuacgaucggggaaugcccuaaguacgugaaaucugccaagcuccgcauggucaccggacugagaaacacacccagcauucagucccggggccuguuuggggcuaucgccggauucauugagggcggguggaccggaaugguggacggcugguauggcuaccaucaccagaaugaacaagggucuggauacgcggccgaucagaaaagcacacagaacgcuaucaauggcauuaccaacaagguuaauuccgugaucgagaaaaugaacacgcaguuuacagccgucgggaaggaguucaauaagcucgaacgcagaauggagaaccugaauaaaaagguggacgauggauuucuugacaucuggaccuauaacgcugaacugcucguccugcuugagaacgaacggacccuggacuuccacgauagcaaugugaaaaaccucuacgagaagguuaaaucucaacugaagaauaacgccaaggaaauuggcaauggguguuucgaguuuuaucauaaaugcaacgacgagugcauggaauccgugaagaauggcacauacgauuaucccaaauacagcgaggaaucuaagcugaaccgcgagaaaaucgacggagucaagcucgaguccauggaaguguaucagauucuggccaucuacagcaccguugcuuccucucuuguguuccuggucgcgcucggcgccauuuguuuuuggaugugcagcaaugggucccugcaguguaagaucugcaucuga

SEQ ID NO: 189360 - RNA, 1698 nt, Artificial Sequence
  derived and/or modified sequence opt5 from hemagglutinin__InfluenzaA__ADV69075
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguaacguugcuggguggauucucggaaauccugagugcgaacugcuuaucagcaaagaguccuggucuuacauuguggaaaccccggaccccgagaacggcacguguuauccuggguacgucaccgauuaugaggaacugagagagcaacucagcuccgugucuagcuuuaagcgguucgaaaucuuucccaaggaguccagcuggccuaaucauacaguuaccggagugucugccuccugcagccacaacggcaaaucuuccuucuaccgcaaucugcuuuggcugacagucaagaacggccucuaucccaaucugagcaaaucuuacaccaacgacaaggagaaagaagugcuggugcucuggggaguccaucacccuccguccaucggggaucagagaacgcuguaccacacagagaaugccuauguuagcgugguguccucucauuacagccggcgcuuuacccccgaaauugucaagagaccuaaggugcgggaccaggagggccgcaucaacuauuacuggacacuucuggaacccggggauaccauuaucugugaggcuaacggaaaucucauugccccuagauaugcuuucgcccugucccggggcuuugggagcggaaucauuaccucuaacgcgcccaugggcgagugcaaugccaaaugucagacaccgcaaggcgcuaucaacuccagccuuccuuuccagaauguucaccccgugacgaucggggaaugcccuaaguacgucaaaucugccaagcugcgcauggugaccggacucagaaacacacccagcauucagucccggggccuguuuggggcuaucgccggauucauugagggcggguggaccggaaugguugacggcugguauggcuaccaucaccccaaugaacaggggucuggauacgcggccgaucaaaaauccacacagaacgcuaucaauggcauuaccaacaaggugaauagcgucaucgagaaaaugaacacgcaguuuacagccguggggaaggaguucaauaagcuggaacgcagaauggagaaccucaauaaaaaggucgacgauggauuucuggacaucuggaccuauaacgcugaacuucuggugcuccuggagaacgaacggacccuugacuuccacgauagcaauguuaaaaaccuguacgagaaggugaaaucucagcucaagaauaaggucaaagaaauuggcaacggguguuucgaguuuuaucauaagugcaaugacgagugcauggaauccgugaaaaacggcacauacgauuauccuaaguacagcgaggaaucuaaacugaaucgcgagaagaucgacggaguuaagcuggaguccauggaaguguaucaaauucucgccaucuacagcaccgucgccuccucucugguguuccuuguggcucugggcgcgauuuguuuuuggaugugcagcaacgggucccuccaguguaaaaucugcaucuga

SEQ ID NO: 189361 - RNA, 1698 nt, Artificial Sequence
  derived and/or modified sequence opt5 from hemagglutinin__InfluenzaA__ADV69077
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguaacguugcuggguggauucucggaaauccugagugcgaacugcuuaucagcaaagaguccuggucuuacauuguggaaaccccggaccccgagaacggcacguguuauccuggguacuuuaccgauuaugaggaacugagagagcaacucagcuccgucucuagcuucaagcgguuugaaaucuuccccaaggaguccagcuggccuaaucauacagugaccggaguuucugccuccugcagccacaacggcaaaucuuccuuuuaccgcaaucugcuuuggcugacagugaagaacggccucuaucccaaucugagcaaaucuuacaccaacgacaaggagaaagaaguccuggugcucuggggagugcaucacccuccguccaucggggaucagagaacgcuguaccacacagagaaugccuaugucagcguuguguccucucauuacagccggcgcuucacccccgaaauugugaagagaccuaagguccgggaccaggagggccgcaucaacuauuacuggacacuucuggaacccggggauaccauuaucuuugaggcuaacggaaaucucauugccccuagauaugcuuucgcccugucccggggcuuugggagcggaaucauuaccucuaacgcgcccaugggcgaguguaaugccaaaugccagacaccgcaaggcgcuaucaacuccagccuuccuuuccagaaugugcaccccguuacgaucggggaauguccuaaguacgugaaaucugccaagcugcgcauggucaccggacucagaaacacacccagcauucagucccggggccuguuuggggcuaucgccggauucauugagggcggguggaccggaaugguggacggcugguauggcuaccaucaccagaaugaacaagggucuggauacgcggccgaucagaaaagcacacagaacgcuaucaauggcauuaccaacaagguuaauuccgugaucgagaaaaugaacacgcaguuuacagccgucgggaaggaguucaauaagcuggaacgcagaauggagaaccucaauaaaaagguggacgauggauuccuggacaucuggaccuauaacgcugaacuucugguccuccuggagaacgaacggacccuugacuuucacgauagcaaugugaaaaaccuguacgagaagguuaaaucucaacucaagaauaacgccaaggaaauuggcaaugggugcuucgaguuuuaucauaaauguaacgacgagugcauggaauccgugaagaauggcacauacgauuaucccaaauacagcgaggaaucuaagcugaaccgcgagaaaaucgacggagucaagcuggaguccauggaaguguaucagauucucgccaucuacagcaccguugcuuccucucugguguuccuugucgcgcugggcgccauuugcuuuuggauguguagcaaugggucccuccagugcaagaucuguaucuga

SEQ ID NO: 189362 - RNA, 1698 nt, Artificial Sequence
  derived and/or modified sequence opt5 from hemagglutinin__InfluenzaA__ADV69078
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaaucccugauuucuaaaaagagcugguccuacaucguugagaccccgaaucccgaaaacggcgccuguuauccuggggaguuugccgacuacgaggaacuuagagagcaacugucuagcguguccagcuucgaacgguuugagaucuuccccaaggagucuuccuggccuaaucauacggcugccggagucagcgcuucuugcucccacaacggcgaaaagagcuuuuaucgcaaucucauuuggcugaccaagaaaaacggccuuuaccccaaucugucuaaguccuaugagaacgauaaagaaaaggaggugcucauccuguggggaguucaucacccuccgaauauugaaaaccagagaacacuguaccggaccgagaacgccuacgugagcgucguguccucucacuauagcgggcgcuucacacccgagaucaccaagagaccuaaagugcggaaucaggaaggccgcauuaacuacuauuggacgcuccuggagcccggggacacaaucauuuuugaagcgaauggaaaccuuaucgccccuugguacgcuuucacccuguccagaggccucgggagcggaaucauuacaucuaaugcccccauggaugagugugacgcuaagugccagaccccgcaaggcgccaucaacuccagccugccuuuucagaauguccaucccguuaccauuggcgaauguccuaaauaugugcggucuagcaaacuucgcauggugacagggcugagaaacauccccuccauucagucucggggacucuucggcgcgaucgccggguuuaucgagggaggcuggacggggauggucgauggaugguacggcuaucaccaucagaaugagcaaggcagcggguacgcugccgaccaggaauccacccagaacgcuauuaauggaaucacaaacaaagugaauagcguuauugagaagaugaacacccaguucacagccgugggcaaagaauuuaauaagcuggagcgcagaauggaaaaccugaacaagaaagucgaugacggguuccucgauaucuggaccuacaaugccgagcugcuugugcugcucgagaacgaacggacgcuggacuuccacgacucuaauguuaagucccuuuaugagaaagucaagagccaacugaaaaacaaugcuaaggaaauuggaaacggcugcuuugaguucuaccacaaguguaauaacgagugcauggaaucugugaaaaaugggacauaugauuaccccaaguauuccgaggaaagcaaacucaaccgcgagaagaucgacggcgugaaacuggauuccaugggagucuacagaauccuggcgauuuauucuaccguggccagcucccucguucugcuugugucucugggcgcuaucagcuuuuggaugugcuccaaugggagccuccagugucggauuugcaucuga

SEQ ID NO: 189363 - RNA, 1698 nt, Artificial Sequence
  derived and/or modified sequence opt5 from hemagglutinin__InfluenzaA__ADV69079
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaaaagucuuggagcuacaucguuaagaccccgaaucccgagaacggcuccuguuauccuggguacuuugccgacuaugaagaacugagagagcaacucucuagcguguccagcuucgaacgguuugagauguuccccaaagaaucuuccuggccuaaucauaacgucaauggagugagcgccucuugcucccacaacggcaagcgcagcuuuuacagaaaucugcuuuggcugacgggcaaaaacgggcucuaucccaaucugaccaagucuuacgagaacaacaaugagaaagaaguucugauccucuggggagugcaucacccuuccaacauuggcgaucagcggacacuguaccacaccgagaaugcuuaugucagcgugauguccucucauuacagccgcagauucacaccggaaaucaacaagcggcccaaggugcgcgaccaggaggggagaauuaauuauuacuggacccuucuggaaccuggagauacgaucauuuuugaggccaacggcaaucucaucgcucccugguaugccuucgcgcugucccggggguuuggaagcggcauuaucacaucuuccgccccuauggacgagugugaugcuaaaugccagacaccccgcggcgccaucaacagcucucuuccguuccaaaauguccacccuguuaccauuggggaaugucccaaguacgugagaagcgcuaaacugcggauggugaccggacuccgcaacaucccuuccauucagucuagaggccuguuuggggccaucgcgggauucauugagggcggguggaccggaauggucgacggcugguauggcuaccaucaccagaaugaacaggggagcggauacgccgcugaucaagaguccacacagaacgccaucaauggcaucacgaacaaggugaauagcguuauugagaaaaugaacacccaguuuacagcuguggggaaggaguucaacaaacuggagcggcgcauggaaaaucucaacaagaaggucgacgauggauuccuggacaucuggaccuauaaugccgagcuucuggugcuccuggaaaacgagagaacacuugacuuucacgauucuaauguuaaaucccuguacgaaaaggugaaaagccagcucaagaacaaugccaaagagauuggcaacgggugcuucgaguuuuaucauaaguguaauaacgaaugcauggagucugucaagaauggcaccuacgacuaucccaaauacuccgaagagagcaagcugaaccgggagaaaaucgauggagugaagcuggacuccaugggcgucuaucaaauucucgcuaucuacucuacgguggcgagcucccugguucuucuggugucucucggggccaucagcuucuggaugugcuccaauggaagccugcaguguagaauuugcaucuga

SEQ ID NO: 189364 - RNA, 1698 nt, Artificial Sequence
  derived and/or modified sequence opt5 from hemagglutinin__InfluenzaA__ADV69080
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaaucccugauuucuaaaaagagcugguccuacaucguugagaccccgaaucccgaaaacggcgccuguuauccuggggaguuugccgacuacgaggaacuuagagagcaacugucuagcguguccagcuucgaacgguuugagaucuuccccaaggagucuuccuggccuaaucauacggcugccggagucagcgcuucuugcucccacaacggcgaacgcagcuuuuauagaaaucucauuuggcugaccaugaaaaacggccuuuaccccaaucugcggaagucuuaugagaacgauaaagaaaaggaggugcucauccuguggggaguucaucacccuccgaauauugaaaaccagcgcacacuguaccacaccgagaacgccuacguguccgucgugagcucccauuauucugggagauucacacccgagaucaccaaacggccuaaggugcgcgaccaggaaggcagaauuaauuacuauuggacgcuccuggagcccggggauacaaucauuuuugaagcgaacggaaaucuuaucgccccuugguacgcuuucacccugagccggggccucggguccggaaucauuacaagcaacgcccccauggacgcuugugaugccaagugccagaccccgcaaggcgcgaucaauucuucccugccuuuucagaacguccaccccguuaccauuggcgaguguccuaaauaugugcgcagcgccaaacuuagaauggugacagggcugcggaauauccccucuauucagagccgcggacucuucggcgcuaucgccggguuuaucgaaggaggcuggacggggauggucgacggaugguacggcuaucaucaccagaacgagcaaggcuccggguacgcugccgaucaggagucuacccagaaugccauuaacggaaucacaaauaaggugaacagcguuauugaaaagaugaauacccaguucacagcugugggcaaagaguuuaacaagcuggaaagacggaucgagaaucugaacaaaaaggucgacgauggguucauugacaucuggaccuacaacgcggaacuccuggugcuucuggagaaugagcgcacgcucgacuuccacgauuccaacguuaagagccuguaugaaaaagugaagucucaacuuaaaaauaacgccaaggagaucggaaauggcugcuuugaguucuaccauaaauguaacaaugaaugcauggaguccgucaagaacgggacauaugacuaccccaaguauagcgaagagucuaaacugaauagagaaaagauugauggcgugaaacucgacuccaugggagucuaccggauccuggcuauuuauagcaccguggccuccucucugguucuccuggugagccuuggcgccaucuccuuuuggaugugcucuaacgggagccugcaguguagaauuugcaucuga

SEQ ID NO: 189365 - RNA, 1698 nt, Artificial Sequence
  derived and/or modified sequence opt5 from hemagglutinin__InfluenzaA__ADV69081
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguaacguugcuggguggauucucggaaauccugagugcgaacugcuuaucagcaaagaguccuggucuuacauuguggaaaccccgaaccccgagaauggcacguguuauccuggguacuuuaccgacuaugaggaacugagagagcaacucagcuccgucucuagcuucaagcgguuugaaaucuuccccaaggaguccagcuggccuaaccauacagugaccggaguuucugccuccugcagccacaauggcgagucuuccuuuuaccgcaaccugcuuuggcugacagugaaaaauggccucuaucccaagcugagcaaaucuuacaccaacgauaaggaaaaagagguccuggugcucuggggagugcaucacccuccgaauaucagagaccagcggacgcuguaccacacagaaaacgccuaugucuccguugugagcucccauuacucucgcagauucacccccgagauugugaagcggccuaagguccgcgaucaggaagggagaaucaacuauuacuggacacuucuggagcccggcgacaccauuaucuuugaggcuaaugggaaccucauugccccucgguaugcuuucgcccugagccgcggauuuggcuccgggaucauuaccagcaaugcgcccaugggagaauguaacgccaaaugccagacaccgcaaggcgcuaucaucucuucccuuccuuuccagaaugugcaccccguuacgauuggcgaguguccuaaguacgugaaaagcgccaagcugagaauggucaccgggcuccggaacacacccucuauccagagccgcggacuguuuggcgcuauugccggguucaucgaaggaggcuggaccgggaugguggauggaugguauggcuaccaucaccagaaugagcaaggcuccggguacgcggccgaccagaaaucuacacagaacgcuauuaauggaaucaccaacaagguuaauagcgugaucgaaaagaugaacacgcaguuuacagccgucggcaaagaguucaauaagcuggagagacggauggaaaaccucaauaaaaagguggaugacggguuccuggauauuuggaccuauaacgcugagcuucugguccuccuggaaaacgagcgcacccuugacuuucacgacuccaaugugaaaaaccuguacgaaaagguuaaaagccaacucaagaauaacgccaaggagaucggaaauggcugcuucgaguuuuaucauaaauguaacgaugaaugcauggagucugugaagaaugggacauacgacuaucccaaauacuccgaagagagcaagcugaacagagagaaaauugauggcgucaagcuggaaucuauggagguguaucagauccucgccauuuacuccaccguugcuagcucccugguguuccuugucgcgcugggagccaucugcuuuuggauguguucuaauggcagccuccagugcaagaucuguauuuga

SEQ ID NO: 189366 - RNA, 1698 nt, Artificial Sequence
  derived and/or modified sequence opt5 from hemagglutinin__InfluenzaA__ADV69083
augaaggugaaacugaugguccuccugugcaccuucacagccacguacgcugacaccaucuguguuggcuaucacgccaacaauagcacagauaccguggacacagugcuugagaagaacgucaccgugacacauuccguuaaucugcucgaagauucucacaacgggaaacugugccuucugaagggaauugcgccccuccagcugggcagcuguuccguggcuggguggauccugggaaauccugagugcgaacuccugauuucuaaagagagcugguccuacaucgucgaaaccccgaaccccgagaauggcacguguuauccuggguacuuuaccgacuaugaggaacuuagagagcaacugucuagcguguccagcuucaagcgguuugaaauuuuccccaaggagucuuccuggccuaaccauaauguuacaggagugucuagcuccugcagccacaacggcaaaucuuccuuuuaccgcaaucuccuguggcuuaccgucaagaacggccuguaucccaaucucagcaaauccuacacaaacaagaaagagaaggaagugcuggugcuguggggaguccaucacccuucuaauaucggggaucagagagcccucuaccacaccgagaacgccuauguuagcgugguguccagccauuacucucggcgcuucacgccggaaaucgcuaagagacccaaaguccggaaccaggagggccgcauuaauuauuacuggacacugcuugaaccuggggacaccaucauucuggaggccaacggaaaucucaucgcucccagauaugccuuugagcuguccaagggccuugggagcggaauuaucacaucuaacgcgccuaugggcgaauguaaugccaaaugccagacaccccaaggcgcuauuaacagcucccugccguuccagaaugugcacccuguuaccaucggggagugucccaaguacgugaaaucugccaagcuccggauggucaccggacugcgcaacacgccuagcauccaguccagaggccuguuuggggcuauugccggauucaucgaaggcggguggaccggaaugguggauggcugguauggcuaccaucaccagaaugagcaagggagcggauacgcggccgaccagcagucuacacagaacgcuauuaauggcaucaccaacaaaguuaauuccgugauugaaaagaugaacacacaauuuaccgccgucgggaaggaguucaauaaacucgagcggcgcauggaaaaccugaacaagaaaguggaugacggauuucuugauaucuggacguauaaugcugagcugcucguccugcuugaaaacgagagaacacuggacuuccacgauagcaaugugaagaaccucuacgaaaaaguuaagucucagcugaagaauaacgccaaagagaucggcaaugggugcuucgaguuuuaucauaaguguaacgacgaaugcauggaguccgugaaaaauggcaccuacgacuaucccaaguacagcgaagaguccaaacugaaccgggagaagauugauggagucaagcucgaaucuaugggcguguauaauauccuggccauuuacagcaccguugcuuccucucuugugcugcucgucagccugggggcgaucuccuucuggaugugcagcaacggaucucugcagugucgcauuugcaucuga

SEQ ID NO: 189367 - RNA, 1698 nt, Artificial Sequence
  derived and/or modified sequence opt5 from hemagglutinin__InfluenzaA__ADV69084
augaaggugaaacugaugguccuccugugcaccuucacagccacguacgcugacaccaucuguguuggcuaucacgccaacaauagcacagauaccguggacacagugcuugagaagaacgucaccgugacacauuccguuaaucugcucgaagauucucacaacgggaaacugugccuucugaagggaauugcgccccuccagcugggcagcuguuccguggcuggguggauccugggaaauccugagugcgaacuccugauuucuaaagagagcugguccuacaucgucgaaaccccgaaccccgagaauggcacguguuauccuggguacuuuaccgacuaugaggaacuuagagagcaacugucuagcguguccagcuucaagcgguuugaaauuuuccccaaggagucuuccuggccuaaccauaauguuacaggagugucuagcuccugcagccacaacggcaaaucuuccuuuuaccgcaaucuccuguggcuuaccgucaagaacggccuguaucccaaucucagcaaauccuacacaaacaagaaagagaaggaagugcugauccuguggggagugcaucacccuucuaauaucagagaucagcgggcccucuacuauaccgagaacgccuacgucagcguuguguccagccacuauucucgcagauucacgccggaaauugcuaagcggcccaaagugcgcaaccaggaggggagaaucaauuacuauuggacacugcuugaaccuggcgacaccauuaucuuugaggccaacgggaaucugauugcuccccgguacgccuucgagcucuccaagggauuuggcagcgggaucauuacaucugaugcgccuaugggagaauguaacgccaaaugccagacaccccaaggcgcuaucaauagcucccugccguuccagaacguccauccugugaccaucggcgagugucccaaguauguucgcucugccaaacuuagaauggugaccgggcugcggaauacgccuagcauucagucccgcggacucuuuggcgcuaucgccggguucauugaaggaggcuggaccgggauggucgacggaugguacggcuaccaccaucagaacgagcaaggcagcggguaugcggccgaucagcagucuacacagaaugcuaucaacggaauuaccaauaaggugaacuccguuaucgaaaagaugaauacacaauuuaccgccgugggcaaagaguucaacaagcuggagagacggauggaaaaucugaacaaaaagaucgacgauggguuccucgacauuuggacguacaacgcugagcugcuuguccugcucgaaaaugagcgcacacuggauuuucacgacagcaacgugaaaaaucuuuaugaaaaggucaaaucucagcugaagaacaaugccaaggagaucggaaacggcugcuucgaguuuuaccacaaauguaaugacgaaugcauggaguccgugaagaacgggaccuaugauuaccccaaauauagcgaagaguccaagcucaauagagagaaaauugacggcguuaagcuggaaucuaugggaguguacaacauccuggccauuuacagcaccgucgcuuccucucucgugcugcuuguuagccugggcgcgaucuccuucuggaugugcagcaaugggucucuccagugucggaucugcauuuga

SEQ ID NO: 189368 - RNA, 1698 nt, Artificial Sequence
  derived and/or modified sequence opt5 from hemagglutinin__InfluenzaA__ADV69085
augaaggugaaacugaugguccuccugugcaccuucacagccacguacgcugacaccaucuguguuggcuaucacgccaacaauagcacagauaccguggacacagugcuugagaagaacgucaccgugacacauuccguuaaucugcucgaagauucucacaacgggaaacugugccuucugaagggaauugcgccccuccagcugggcagcuguuccguggcuggguggauccugggaaauccugagugcgaacuccugauuucuaaagagagcugguccuacaucgucgaaaccccgaaccccgagaauggcacguguuauccuggguacuuuaccgacuaugaggaacuuagagagcaacugucuagcguguccagcuucaagcgguuugaaauuuuccccaaggagucuuccuggccuaaccauacaguuaccggagugucuagcuccugcagccacaauggcaaaucuuccuuuuaccgcaaccuccuguggcuuacaaugaagaauggccuguaucccaaccucagcaaauccuacaccaauaagaaagagaaggaaguccuggugcuguggggagugcaucacccuucuaacaucggggaucagagagcccucuaccacacggagaaugccuaugucagcguuguguccagccauuacucucggcgcuucacaccggaaaucgcuaagagacccaaagugcggaaccaggagggccgcauuaacuauuacuggacccugcuugaaccuggggacacaaucauuuuugaggccaauggaaaccugaucgcucccagauaugccuucgagcucuccaagggcuuugggagcggaauuaucaccucuaaugcgccuaugggcgaauguaacgccaaaugccagacaccccaaggcgcuauuaauagcucccugccguuccagaacguccacccugugaccaucggggagugucccaaguacguucggucuagcaaacuucgcauggugacgggacugagaaauaccccuuccauccagagccggggccucuuuggggccauugcuggauucaucgaaggcggguggacaggaauggucgauggcugguauggcuaccaucaccagaacgagcaagggucuggauacgccgcggaccagcaguccacccagaaugccauuaacggcaucacaaauaaggugaacagcguuauugaaaagaugaauacccaauuuacggcuguggggaaagaguucaacaagcuggagcgcagaauggaaaaucugaacaaaaagaucgaugacggauuccucgauaucuggacauauaacgccgagcugcuuguccugcucgaaaaugagcggacccuggacuuucacgauucuaacgugaaaaaucuuuacgaaaaggucaaaucccagcugaagaacaaugcuaaggagauuggcaacgggugcuucgaguuuuaucauaaauguaaugacgaaugcauggagagcgugaagaacggcaccuacgacuaucccaaauacuccgaagagucuaagcucaaucgcgagaaaaucgauggaguuaagcuggaaagcaugggcguguauaacauucuggccaucuacuccacagucgccucuagccucgugcugcuuguuucccugggggcuauuagcuucuggaugugcucuaauggaucccuccaguguagaaucugcaucuga

SEQ ID NO: 189369 - RNA, 1698 nt, Artificial Sequence
  derived and/or modified sequence opt5 from hemagglutinin__InfluenzaA__ADV69086
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguaacguugcuggguggauucucggaaauccugagugcgaacugcuuaucagcaaagaguccuggucuuacauuguggaaaccccgaaccccgagaauggcacguguuauccuggguacuuuaccgacuaugaggaacugagagagcaacucagcuccgucucuagcuucaagcgguuugaaaucuuccccaaggaguccagcuggccuaaacauacagugaccggaguuucugccuccugcagccacaacggcaagucuuccuuuuaccgcaaucugcuuuggcugacaggcaaaaacgggcucuaucccaaucugagcaagucuuacaccaacgauaaagagaaggaagugcugguccucuggggagugcaucacccuuccaauaucggcgaccagagagcccuguaccacaaggagaacgcuuaugugagcgucguuuccucucauuacagccggcgcuucacgccggaaauugugaaaagacccaaggugcgggaucaggaggggcgcaucaacuauuacuggacacuucuggaaccuggagacaccauuaucuuugaggccaauggcaaccucauugcucccagauaugccuucgcgcugucccggggguuuggaagcggcaucauuacaucuaaugccccuauggaugaguguaacaccaaaugccagacaccccaaggcgcuaucaauuccagccuuccguuccagaacguccacccugugaccaucggggaaugucccaaguacguuaaaucugccaagcugcgcauggugacgggacucagaaauaccccuagcauucagucccggggccuguuuggggcuaucgccggauucauugagggcggguggacaggaauggucgacggcugguauggcuaccaucaccagaacgaacaagggucuggauacgcggccgaucagaaaagcacccagaaugcuaucaacggcauuacaaauaaggugaacuccguuaucgagaagaugaauacccaguuuacggccguggggaaagaguucaacaagcuggaacgcagaauggagaaucucaacaaaaaggucgacgauggauuccuggacaucuggacauauaacgcugaacuucuggugcuccuggagaaugaacggacccuugacuuucacgauagcaacgucaaaaaucuguacgagaaggugaagucucaacucaaaaacaaugccaaggaaauuggcaacgggugcuucgaguuuuaucauaaauguaaugacgagugcauggaauccguuaagaacggcaccuacgauuaucccaaauacagcgaggaaucuaagcugaaucgcgagaagaucgacggagugaaacuggaguccauggaagucuaucagauucucgccaucuacagcacaguggcuuccucucugguuuuccuugugagccugggcgcgauuugcuuuuggauguguuccaacgggucucuccagugcagaaucuguaucuga

SEQ ID NO: 189370 - RNA, 1698 nt, Artificial Sequence
  derived and/or modified sequence opt5 from hemagglutinin__InfluenzaA__ADV69087
augaaggugaaacugaugguccuccugugcaccuucacagccacguacgcugacaccaucuguguuggcuaucacgccaacaauagcacagauaccguggacacagugcuugagaagaacgucaccgugacacauuccguuaaucugcucgaagauucucacaacgggaaacugugccuucugaagggaauugcgccccuccagcugggcagcuguuccguggcuggguggauccugggaaauccugagugcgaacuccugauuucuaaagagagcugguccuacaucgucgaaaccccgaaccccgagaauggcacguguuauccuggguacuuuaccgacuaugaggaacuuagagagcaacugucuagcguguccagcuucaagcgguuugaaauuuuccccaaggagucuuccuggccuaaccauacaguuaauggagugucuagcuccugcagccacaacggcgagucuuccuuuuaccgcaaucuccuguggcuuaccgucaaagauggccuguaucccaaccucagcaaguccuacacaaauaaaaaggaaaaagaggugcuggugcuguggggaguccaucacccuucuaacaucggggaccagagagcccucuaccacaccgaaaaugccuauguuagcgugguguccagccauuacucucggcgcuucacgccggagaucgcuaagagacccaagguccggaaccaggaaggccgcauuaacuauuacuggacacugcuugagccuggggauaccaucauuuuugaggccaauggaaaccugaucgcucccagauaugccuucgaacucuccaaaggcuuugggagcggaauuaucacaucuaaugcgccuaugggcgaguguaacgccaagugccagacaccccaaggcgcuauuaauagcucccugccguuccagaacgugcacccuguuaccaucggggaaugucccaaauacgugcggucuaccaaacuucgcauggucacgggacugagaaauaccccuagcauccagucccggggccucuuuggggccauugcuggauucaucgagggcggguggacaggaaugguggacggcugguauggcuaccaucaccagaacgaacaagggagcggauacgccgcggaucagcagucuacccagaaugccauuaacggcaucacaaauaagguuaacuccgugauugagaagaugaauacccaauuuacggcugucgggaaagaguucaacaagcuggaacgcagaauggagaaucugaacaagaaaaucgacgauggauuccucgacaucuggacauauaacgccgaacugcuugugcugcucgagaaugaacggacccuggauuuucacgacagcaacgucaagaaucuuuacgagaaagugaagucucagcugaaaaacaaugcuaaggagauuggcaacgggugcuucgaauuuuaucauaaguguaaugacgagugcauggaauccguuaaaaacggcaccuacgauuaucccaaguacagcgaggaguccaaacucaaucgcgaaaagaucgacggagugaaacuggagucuaugggcgucuauaacauucuggccaucuacagcacaguggccuccucucucguucugcuugugagccugggggcuauuuccuucuggaugugcagcaauggaucucuccaguguagaaucugcaucuga

SEQ ID NO: 189371 - RNA, 1698 nt, Artificial Sequence
  derived and/or modified sequence opt5 from hemagglutinin__InfluenzaA__ADV69088
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcgugaccggguggauccucggaaacccugagugcgaacugcuuauuuccaaaaagucuuggagcuacaucguugagacgccgaaucccgaaaacggcgcuuguuauccuggguacuuugccgacuaugaggagcugagagaacaacucuccucugugagcuccuucgagcgguuugaaaucuuccccaaggagagcucuuggccuaaucauaacgucaauggaguguccgccagcugcucucacaacggcaaauccagcuuuuaccgcaaucugcuuuggcugaccggcaagaacgggcucuaucccucucugacaaaauccuacgcuaaugauaaggagaaagaaguucugauucucuggggagugcaucacccuagcaacaucggcgaccagagaacccuguaccacacagagaacgccuaugucuccgugaugucuagccauuacucccggcgcuucaccccggaaauuagcaagagacccaaggugcgggaucaggaggggcgcaucaauuauuacuggacgcuucuggaaccuggagacacaauuaucuuugaggcuaacggcaaucucauugcccccugguaugcguucgcccugucuagaggguuuggauccggcaucaucaccagcucugcuccuauggaugccugugacgcuaaaugccagacaccccaaggcgccauuaacagcucccuuccguuccagaauguccacccuguuaccaucggggagugucccaaguacgugcggucuaccaaacugcgcauggugacaggacucagaaacauuccuagcauccagucccggggccuguuuggggcgauugccggauucaucgaaggcggguggacgggaauggucgauggcugguauggcuaccaucaccagaaugagcaagggagcggauacgcugccgaccaggaaucuacccagaacgcucugcacggcaucacaaauaaggugaacuccguuauugagaaaaugaauacccaguuuacagccguggggaaggaguucaacaaacucgaacgcagaauggagaaucugaacaagaaggucgaugacggauuccuugacaucuggaccuauaaugccgaacugcucgugcugcuugagaacgaacggacgcuggauuuucaugacagcaacguuaaaucucucuacgagaaggugaaaauucaacugaagaauaacgcuaaagaaaucggcaaugggugcuucgaguuuuaucacaaguguaacaaugagugcauggaauccguccgcaacggcacauacgauuaucccaaguacagcgaggaauccaaacugaauagagagaagauugacggagugaaacucgauucuaugggcgucuaucagauccuggcgaucuacagcaccguggccuccucucuuguucugcucgugagccugggggcuauuuccuucuggaugugcagcaacggaucucugcagugucggaucugcauuuga

SEQ ID NO: 189372 - RNA, 1698 nt, Artificial Sequence
  derived and/or modified sequence opt5 from hemagglutinin__InfluenzaA__ADV69089
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaaaagucuuggagcuacaucguugagaccccgaaucccgaaaacggcgccuguuauccuggguacuuugccgacuaugaggagcugagagaacaacucuccucugugagcuccuucgagcgguuugaaaucuuccccaaggagagcucuuggccuaaucauaacgucaauggaguguccgcuagcugcucucacaacggcaaauccagcuuuuaccgcaaucugcuuuggcugacgggcaagaacgggcucuaucccaaucugaccaaaucuuacgccaacaacaaggagaaagaaguucugauucucuggggagugcaucacccuuccaauaucggcgaucagagaacacuguaccacaccgagaacgcuuaugucagcgugauguccucucauuacagccggcgcuucacaccggaaauuaccaagagacccaagauccgggaccaggaggggcgcauuaauuauuacuggacgcuucuggaaccuggagauacaaucauuuaugaggccaacggcaaucucaucgcgcccugguacgccuuugcucuguccagaggguucggaagcggcaucauuaccucuuccgccccuauggacgagugugaugcuaaaugccagacaccccaaggcgccaucaacagcucucuuccguuucagaaugugcacccugucaccauuggggaaugucccaaguauguucggagcgcgaaacugcgcauggugaccggacucagaaacaucccuuccauucagucucggggccuguucggggccaucgcuggauuuaucgagggcggguggacaggaauggugaauggcugguacggcuaccgccugcauaacgaccaggggagcggauaugccgcugaucaaaaguccacgcagaaugcccucaacggcauuaccaauaaagucaacagcgugaucgaaaagaugaauacacaguucaccgccguugggaaagaguuuaacaagcuggaaagacggauggagaaccuuaauaagaaaguggacgauggauuccuggacauuuggacauacaacgcugagaugcucguccugcuugaaaaugagcgcacccuggacuuccacgauucuaacgugaagucccucuaugaaagaguuaaaauccagcugaagaauaacgcgaaagagauuggcaaugggugcuuugaguucuaccacaaguguaacaaugaaugcauggagagcgugcggaacggcacguaugacuaccccaaguauucugaagaguccaaacugaauagagaaaagaucgauggagucaaacucgacagcaugggcguguaccaaauccuggccauuuacuccacagucgcuucuagccuugugcugcucguuucccugggggccaucucuuuuuggaugugcagcaacggaucccugcagugucgcauuugcaucuga

SEQ ID NO: 189373 - RNA, 1698 nt, Artificial Sequence
  derived and/or modified sequence opt5 from hemagglutinin__InfluenzaA__ADV69090
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaaucccugaucucuaaagagagcugguccuacauuguggaaaccccgaaucccgagaacggcacguguuauccuggguacuuugccgacuaugaggaacuuagagagcaacugucuagcgucuccagcuucgaacgguuugagaucuuccccaaggagucuuccuggccuaaucauaccgugacaggaguuagcgccucuugcucccacaacggcaagagcucuuuuuaccgcaaucuccuguggcuuacccggaaaaacggccuguaucccaaucucuccaagagcuacgcuaacaauaaagaaaaggaggugcugguccuguggggagugcaucacccuccgaaccucggggaucagagagcccuguaccacacagaaaacgcuuauguguccgucguuucuagccauuacucccgcagauucacccccgagaucgccaaacggccuaaggugcgcgaccaggaaggcagaauuaauuauuacuggacgcuucuggagcccggggauacaaucauuuuugaggcgaacggaaaucucaucgccccucgguucgcuuuugcccugagccgcggcuucgggucuggaauuaucaccuccaacgcucccauggacgaaugugaugccaagugccagacaccgcaaggcgcgauuaauagcucucuuccuuuucagaacgugcaccccgucaccaucggcgaguguccuaaauaugugagaagcaccaagcugcggaugguuacagggcuccgcaauauccccuccauucagucuagaggacuguucggcgccaucgcuggguuuauugaaggaggcuggacggggaugguggacggaugguacggcuaucaucaccagaacgagcaaggcagcggguacgccgcugaucagaaauccacccagaaugccaucaacggaauuacaaauaaggucaacagcgugaucgaaaagaugaauacccaguucacagccguuggcaaagaguucaacaaacuggagcggcgcauggaaaaucucaacaagaagguggacgauggguuucuggacaucuggaccuacaacgcugagcuucugguccuccuggaaaaugagagaacgcuugacuuccacgauucuaacgugaaaaaucuguaugaaaaggucaaaucccaacucaagaacaaugcgaaagagauuggaaacggcugcuuugaguucuaccauaaguguaaugacgaaugcauggagagcgugaagaacgggacauaugauuaccccaaauauucugaagaguccaagcugaaucgggagaaaaucgacggcguuaagcuggaaagcaugggaguguaccagauucucgccaucuauuccaccgucgcuucuagccuggugcuucugguuucccucggcgccauuucuuuuuggaugugcagcaacgggucccugcaguguagaaucugcaucuga

SEQ ID NO: 189374 - RNA, 1698 nt, Artificial Sequence
  derived and/or modified sequence opt5 from hemagglutinin__InfluenzaA__ADV69091
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguaacguugcuggguggauucucggaaauccugagugcgaacugcuuaucagcaaagaguccuggucuuacauuguggaaaccccgaaccccgagaauggcacguguuauccuggguacuuuaccgacuaugaggaacugagagagcaacucagcuccgucucuagcuucaagcgguuugaaaucuuccccaaggaguccagcuggccuaaccauacagugaccggaguuucugccuccugcagccacaauggcaaaucuuccuuuuaccgcaaccugcuuuggcugacaagaaagaauggccucuaucccaaccugagcaaaucuuacaccaaugauaaggagaaagaagugcugguccucuggggagugcaucacccuuccaacaucggggaccagcgggcccuguaccacaaggagaacgcuuaugugagcgucguuuccucucauuacagccgcagauucacgccggaaauugugaagcggcccaaagugcgcgaucaggagggcagaaucaauuauuacuggacacuucuggaaccuggggacaccauuaucuuugaggccaacggaaaucucauugcuccccgguaugccuucgcgcugucccgcggcuuugggagcggaaucauuacaucuaacgccccuauggaugaguguaauaccaagugccagacaccccaaggcgcuaucaacuccagccuuccguuccagaauguccacccugugaccaucggcgaaugucccaaauacguuaagucugccaaacugagaauggugacggggcuccggaacaccccuagcauucagucccgcggacuguuuggcgcuaucgccggguucauugagggaggcuggacagggauggucgacggaugguauggcuaccaucaccagaaugaacaaggcucuggguacgcggccgaucagaaguccacccagaacgcuaucaauggaauuacaaacaaagugaauagcguuaucgagaagaugaacacccaguuuacggccgugggcaaggaguucaauaaacuggaaagacggauggagaaccucaacaagaaagucgacgauggguuccuggacaucuggacauauaaugcugaacuucuggugcuccuggagaacgaacgcacccuugacuuucacgauagcaaugucaagaaccuguacgagaaagugaagaaucaacucaagaacaaugccaaagaaauuggaaacggcugcuucgaguuuuaucauaaguguaaugacgagugcauggaaucuguuaaaaacgggaccuacgauuaucccaaguacuccgaggaaagcaaacugaauagagagaagaucgacggcgugaagcuggagucuauggaagucuaucagauucucgccaucuacuccacaguggcuagcucccugguuuuccuugugucucugggagcgauuugcuuuuggauguguagcaacggcucccuccagugccggaucuguaucuga

SEQ ID NO: 189375 - RNA, 1698 nt, Artificial Sequence
  derived and/or modified sequence opt5 from hemagglutinin__InfluenzaA__ADV69092
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguaacguugcuggguggauucucggaaauccugagugcgaacugcuuaucagcaaagaguccuggucuuacauuguggaaaccccgaaccccgagaauggcacguguuauccuggguacuuuaccgacuaugaggaacugagagagcaacucagcuccgucucuagcuucaagcgguuugaaaucuuccccaaggaguccagcuggccuaaccauacagugaccggaguuucugccuccugcagccacaauggcaaaucuuccuuuuaccgcaaccugcuuuggcugacaggcaagaaugggcucuaucccaaccugagcaaaucuuacaccaaugauaaggagaaagaagugcugguccucuggggagugcaucacccuuccaacaucggcgaccagagagcccuguaccacaaggagaacgcuuaugugagcgucguuuccucucauuacagccggcgcuucacgccggaaauugugaagagacccaaagugcgggaucaggaggggcgcaucaauuauuacuggacacuucuggaaccuggagacaccauuaucuuugaggccaacggcaaucucauugcucccagauaugccuucgcgcugucccggggguuuggaagcggcaucauuacaucuaacgccccuauggaugaguguaauaccaagugccagacaccccaaggcgcuaucaacuccagccuuccguuccagaauguccacccugugaccaucggggaaugucccaaauacguuaagucugccaaacugcgcauggugacgggacucagaaacacccugagcauucaguccaagggccuguuuggggcuaucgccggauucauugagggcggguggacaggaauggucgacggcugguauggcuaccaucaccagaaugaacaagggucuggauacgcggccgaucagaaaagcacccagaacgcuaucaauggcauuacaaacaagguuaauuccgugaucgagaagaugaacacccaguuuacggccguggggaaagaguucaauaagcucgaacggcgcauggagaaccugaacaaaaaggucgacgauggauuccuugacaucuggacauauaaugcugaacugcucgugcugcuugagaacgaaagaacccuggacuuucacgauagcaaugucaaaaaccucuacgagaaggugaagucucaacugaaaaauaacgccaaggaaauuggcaaugggugcuucgaguuuuaucauaaauguaacgacgagugcauggaauccguuaagaauggcaccuacgauuauccuaaauacagcgaggaaucuaagcugaaccgggagaagaucgacggagugaaacucgaguccauggaagucuaucagauucuggccaucuacagcacaguggcuuccucucuuguuuuccuggugagccucggcgcgauuugcuuuuggauguguuccaaugggucucugcagugccgcaucuguaucuga

SEQ ID NO: 189376 - RNA, 1698 nt, Artificial Sequence
  derived and/or modified sequence opt5 from hemagglutinin__InfluenzaA__ADV69093
augaaggugaaacugaugguccuccugugcaccuucacagccacguacgcugacaccaucuguguuggcuaucacgccaacaauagcacagauaccguggacacagugcuugagaagaacgucaccgugacacauuccguuaaucugcucgaagauucucacaacgggaaacugugccuucugaagggaauugcgccccuccagcugggcagcuguuccguggcuggguggauccugggaaauccugagugcgaacuccugauuucuaaagagagcugguccuacaucgucgaaaccccgaaccccgagaauggcacguguuauccuggguacgugaccgacuaugaggaacuuagagagcaacugucuagcguuuccagcuuuaagcgguucgaaauuuuucccaaggagucuuccuggccuaaccauacagugaccggagucucuagcuccugcagccacaauggcaaaucuuccuucuaccgcaaccuccuguggcuuacagugaagaauggccuguaucccaaccucagcaaauccuacaccaauaagaaagagaaggaagugcugguccuguggggaguucaucacccuucuaacaucggggaucagagagcccucuaccacacggagaaugccuaugugagcguggucuccagccauuacucucggcgcuuuacaccggaaaucgcuaagagacccaaagugcggaaccaggagggccgcauuaacuauuacuggacccugcuugaaccuggggacacaaucauuuucgaggccaauggaaaccugaucgcucccagauaugccuuugagcucuccaagggcuucgggagcggaauuaucaccucuaaugcgccuaugggcgaauguaacgccaaaugccagacaccccaaggcgcuauuaauagcucccugccguuucagaacguucacccugugaccaucggggagugucccaaguacgucaaaucugccaaacuucggauggugacgggacugcgcaauaccccuagcauccaguccagaggccucuucggggcuauugccggauuuaucgaaggcggguggacaggaaugguugauggcugguauggcuaccaucaccagaacgagcaagggagcggauacgcggccgaccagcagucuacccagaaugcuauuaacggcaucacaaauaaggugaacuccgucauugaaaagaugaauacccaauucacggccguggggaaggaguuuaacaaacuggagcggcgcauggaaaaucugaacaagagagucgaugacggauuccucgauaucuggacauauaacgcugagcugcuugugcugcucgaaaaugagcggacccuggacuuccacgauagcaacguuaaaaaucuuuacgaaaaggugaaaucucagcugaagaacaaugccaaggagaucggcaacgggugcuuugaguucuaucauaaauguaaugacgaaugcauggaguccgucaagaacggcaccuacgacuaucccaaauacagcgaagaguccaagcucaaucgcgagaaaauugauggagugaagcuggaaucuaugggcguuuauaacauccuggccauuuacagcacaguggcuuccucucucguccugcuugugagccugggggcgaucuccuuuuggaugugcagcaauggaucucuccaguguagaauuugcaucuga

SEQ ID NO: 189377 - RNA, 1698 nt, Artificial Sequence
  derived and/or modified sequence opt5 from hemagglutinin__InfluenzaA__ADV69094
augaaggugaaacugaugguccuccugugcaccuucacagccacguacgcugacaccaucuguguuggcuaucacgccaacaauagcacagauaccguggacacagugcuugagaagaacgucaccgugacacauuccguuaaucugcucgaagauucucacaacgggaaacugugccuucugaagggaauugcgccccuccagcugggcagcuguuccguggcuggguggauccugggaaauccugagugcgaacuccugauuucuaaagagagcugguccuacaucgucgaaaccccgaaccccgagaauggcacguguuauccuggguacuuuaccgacuaugaggaacuuagagagcaacugucuagcguguccagcuucaagcgguuugaaauuuuccccaaggagucuuccuggccuaaccauacaguuaccggagugucuagcuccugcagccacaauggcaaaucuuccuuuuaccgcaaccuccuguggcuuacagucaagaauggccuguaucccaaccucagcaaauccuacaccaauaagaaagagaaggaagugcuggugcuguggggaguccaucacccuucuaacaucggggaucagagagcccucuaccacacggagaaugccuauguuagcgugguguccagccauuacucucggcgcuucacaccggaaaucgcuaagagacccaaaguccggaaccaggagggccgcauuaacuauuacuggacccugcuugaaccuggggacacaaucauuuuugaggccaauggaaaccugaucgcucccagauaugccuucgagcucuccaagggcuuugggagcggaauuaucaccucuaaugcgccuaugggcgaauguaacgccaaaugccagacaccccaaggcgcuauuaauagcucccugccguuccagaacgugcacccuguuaccaucggggagugucccaaguacgugaaaucugccaaacuucggauggucacgggacugcgcaauaccccuagcauccaguccagaggccucuuuggggcuauugccggauucaucgaaggcggguggacaggaauggugcauggcugguauggcuaccaccaccagaacgagcaagggagcggauacgcggccgaacagcagucuacccaguaugcuauuaauggcaucacaaacaaaguuaauuccgugauugagaagaugaacacccaauuuacggccgucgggaaggaguucaauaaacuggaacggcgcauggagaaccugaauaagagaguggaugacggauuccucgauaucuggacauacaacgcugaacugcuuguccugcucgagaacgaacggacccuggacuuucaugauagcaaugugaaaaaccuuuaugagaagguuaaaucucagcugaagaauaacgccaaggagaucggcaaugggugcuucgaauuuuaccacaaauguaacgacgagugcauggaauccgugaagaauggcaccuaugauuaccccaaauauagcgaggaguccaagcucaaccgcgaaaagauugacggagucaagcuggagucuaugggcguguacaauauccuggccauuuacagcacaguugcuuccucucucgugcugcuugucagccugggggcgaucuccuucuggaugugcagcaacggaucucuccaguguagaauuugcaucuga

SEQ ID NO: 189378 - RNA, 1698 nt, Artificial Sequence
  derived and/or modified sequence opt5 from hemagglutinin__InfluenzaA__ADV69095
augaaggugaaacugaugguccuccugugcaccuucacagccacguacgcugacaccaucuguguuggcuaucacgccaacaauagcacagauaccguggacacagugcuugagaagaacgucaccgugacacauuccguuaaucugcucgaagauucucacaacgggaaacugugccuucugaagggaauugcgccccuccagcugggcagcuguuccguggcuggguggauccugggaaauccugagugcgaacuccugauuucuaaagagagcugguccuacaucgucgaaccgcccaacccugagaauggcaccuguuaucccggguacuuuacggacuaugaggaacuuagagagcaacugucuagcguguccagcuucaagcgguuugaaauuuucccuaaggagucuuccuggcccaaccauaccguuaauggagugucuagcuccugcagccacaacggcgagucuuccuuuuaccgcaaucuccuguggcuuacagucaaagauggccuguauccuaaccucagcaaguccuacaccaauaaaaaggaaaaagaggugcuggugcuguggggaguccaucacccgucuaacaucggggaccagagagcccucuaccacacagaaaaugccuauguuagcgugguguccagccauuacucucggcgcuucacccccgagaucgcuaagagaccuaagguccggaaccaggaaggccgcauuaacuauuacuggacgcugcuugagcccggggauacaaucauuuuugaggccaauggaaaccugaucgcuccuagauaugccuucgaacucuccaaaggcuuugggagcggaauuaucaccucuaaugcgcccaugggcgaguguaacgccaagugccagacaccgcaaggcgcuauuaauagcucccugccuuuccagaacgugcaccccguuaccaucggggaauguccuaaauacgugcggucuaccaaacuucgcauggucacaggacugagaaauacgcccagcauccagucccggggccucuuuggggccauugcuggauucaucgagggcggguggaccggaaugguggacggcugguauggcuaccaucaccagaacgaacaagggagcggauacgccgcggaucagcagucuacacagaaugccauuaacggcaucaccaauaagguuaacuccgugauugagaagaugaauacacaauuuaccgcugucgggaaagaguucaacaagcuggaacgcagaauggagaaucugaacaagaaaaucgacgauggauuccucgacaucuggacguauaacgccgaacugcuugugcugcucgagaaugaacggacacuggauuuucacgacagcaacgucaagaaucuuuacgagaaagugaagucucagcugaaaaacaaugcuaaggagauuggcaacgggugcuucgaauuuuaucauaaguguaaugacgagugcauggaauccguuaaaaacggcaccuacgauuaucccaaguacagcgaggaguccaaacucaaucgcgaaaagaucgacggagugaaacuggagucuaugggcgucuauaacauucuggccaucuacagcaccguggccuccucucucguucugcuugugagccugggggcuauuuccuucuggaugugcagcaauggaucucuccaguguagaaucugcaucuga

SEQ ID NO: 189379 - RNA, 1698 nt, Artificial Sequence
  derived and/or modified sequence opt5 from hemagglutinin__InfluenzaA__ADV69096
augaaggugaaacugaugguccuccugugcaccuucacagccacguacgcugacaccaucuguguuggcuaucacgccaacaauagcacagauaccguggacacagugcuugagaagaacgucaccgugacacauuccguuaaucugcucgaagauucucacaacgggaaacugugccuucugaagggaauugcgccccuccagcugggcagcuguuccguggcuggguggauccugggaaauccugagugcgaacuccugauuucuaaagagagcugguccuacaucgucgaaaccccgaaccccgagaauggcacguguuauccuggguacgugaccgacuaugaggaacuuagagagcaacugucuagcguuuccagcuuuaagcgguucgaaauuuuucccaaggagucuuccuggccuaaccauacagugaccggagucucuagcuccugcagccacaauggcaaaucuuccuucuaccgcaaccuccuguggcuuacagugaagaauggccuguaucccaaccucagcaaauccuacaccaauaagaaagagaaggaagugcugguccuguggggaguucaucacccuucuaacaucggggaucagagagcccucuaccacacggagaaugccuaugugagcguggucuccagccauuacucucggcgcuuuacaccggaaaucgcuaagagacccaaagugcggaaccaggagggccgcauuaacuauuacuggacccugcuugaaccuggggacacaaucauuuucgaggccaauggaaaccugaucgcucccagauaugccuuugagcucuccaagggcuucgggagcggaauuaucaccucuaaugcgccuaugggcgaauguaacgccaaaugccagacccccaagggcgcuauuaauagcucccugccguuucaaaacguucacccugugacaaucggggagugucccaaauacgucaagucugccaaacuucggauggugacgggacugcgcaauaccccuagcauccaguccagaggccucuucggggcuauugccggauuuaucgaaggcggguggacaggaaugguugauggcugguauggcuaccaucaccagaacgagcaggggagcggauacgcggccgaccaacagucuacccagaaugcuauuaacggcaucacaaauaaggugaacuccgucauugaaaagaugaauacccaguucacggccguggggaaagaguuuaacaagcuggagcggcgcauggaaaaucugaacaaaaaggucgaugacggauuccucgauaucuggacauauaacgcugagcugcuugugcugcucgaaaaugagagaacccuggacuuccacgaaagcaacguuaaaaaucuuuacgagaaggugaagucucaacugaaaaacaaugccaaggagaucggcaacgggugcuuugaguucuaucauaaauguaaugaugaaugcauggaauccgucaagaacggcaccuacgacuaucccaaauacagcgaggaguccaagcucaaucgggaaaagauugacggagugaaacuggagucuaugggcguuuauaacauccuggccauuuacagcacaguggcuuccucucucguccugcuugugagccugggggcgaucuccuuuuggaugugcagcaauggaucucuccagugucgcauuugcaucuga

SEQ ID NO: 189380 - RNA, 1698 nt, Artificial Sequence
  derived and/or modified sequence opt5 from hemagglutinin__InfluenzaA__ADV69097
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaaaagucuuggagcuacaucguugagaccccgaaucccggcaacggggccuguuauccuggauacuuugccgacuaugaggaacugagagagcaacucuccucugugagcuccuucgaacgguuugagaucuuccccaaggaaagcucuugguccaaucauaacgucaauggcgugagcgcuucuugcucccacaacggcaaaagcucuuuuuaccgcaaucugcuuuggcugacggggaagaacggacucuauccuacccugacaaaauccuacgccaaugauaaggagaaagagguucugauucucuggggcgugcaucaccccagcaacaucggggaccagagaacccuguaccacacagaaaacgcuuaugucuccgugaugucuagccauuacucccggcgcuucaccccugagauuagcaagagaccgaaggugcgggaucaggaaggacgcaucaauuauuacuggacgcuucuggagcccggcgacacaauuaucuuugaagccaacgggaaucucauugcgccuugguaugccuucgcucugucuagaggauuuggcuccggcaucaucaccagcaacgcccccauggaugagugugacgcuaaaugccagacaccucaaggggccauuaauucuagccuucccuuccagaacauccacccggucaccauuggagaguguccuaaguacguucgguccgcgaaacugcgcauggugaccggccucagaaauacacccucuauccagagccgggggcuguuuggagccauugcuggcuucaucgaagggggauggacgggcaugguggauggcugguauggguaccaucaccagaacgagcaaggauccggcuacgccgcugaccaggaaagcacccagaaugccaucaacgagauuacaaauaaggaaaacucugucaucgagaaaaugaauacccaguuuacauccguggggaaggaguucaacaaacuggaacgcagaauggagaaucucaacaagaagguugaugacggauuccuggacauuuggaccuauaacgccgaacuucuggugcuccuggagaaugaacggacgcuugauuuucacgacagcaacgucaaaucucuguacgagaaggugaaaauccaacucaagaauaacgcuaaagagauuggcaaugggugcuucgaauuuuaucauaaguguaacaaugagugcauggaauccguucgcaacggcacauacgauuauccuaaguacagcgaggaguccaaacugaauagagaaaagaucgacggagugaaacuggauucuaugggcgucuaucagauccucgcgauuuacagcaccguggccuccucucugguccuucuggugagccucggggcuaucuccuucuggaugugcagcaacggaucucugcagugucggauuugcaucuga

SEQ ID NO: 189381 - RNA, 1698 nt, Artificial Sequence
  derived and/or modified sequence opt5 from hemagglutinin__InfluenzaA__ADV69098
augaaggugaaacugaucguccuccugugcaccuucacagccacguacgcugacaccauuuguguuggcuaucacgccaacaauagcacagauaccguggacacagugcuugagaagaacgucaccgugacacauuccguuaaucugcucgaagauucucacaacgggaaacugugccuucugaagggaaucgcgccccuccagcugggcagcuguuccguggcuggguggauucugggaaauccugagugcgaacuccugaucucuaaagagagcugguccuacauugucgaaaccccgaaccccgagaauggcacguguuauccuggguacuuuaccgacuaugaggaacuuagagagcaacugucuagcguguccagcuucaagcgguuugaaaucuuccccaaggagucuuccuggccuaaccauacaguuaccggagugucuagcuccugcagccacaauggcaacucuuccuuuuaccgcaaucuccuguggcuuacagucaaaaacggccuguaucccaaucucagcaaguccuacaccaacaaaaaggagaaagaagugcuggugcuguggggaguccaucacccuucuaauaucgaggaucagagagcccucuaccacacggaaaacgccuauguuagcgugguguccagccauuacucucggcgcuucaacccggagauugcuaagagacccaagguccggaaucaggaagggcgcaucaacuauuacuggacacugcuugagccuggcgacaccauuaucuuugaggccaaugggaaccugauugcucccagauaugccuucgaacucuccaaaggauuuggcagcgggaucauuacaucuaaugcgccuaugggagaguguaacgccaagugccagacaccccaaggcgcuaucaauagcaaccugccguuccagaaugugcacccuguuaccaucggcgaaugucccaaauacgugcgguccgccaaacuucgcauggucaccgggcugagaaacacgccuucuauucagagccggggacucuuuggcgcuaucgccggguucauugagggaggcuggaccgggaugguggauggaugguauggcuaccaucaccacaaugaacagggcuccggguacgcggccaaccaaaagagcacacccaaugcuaucaacggaauuaccaauaagguuaacucugugaucgagaaaaugaacacacaguuuaccgccgucggcaaggaguucaauaagcuggaacgcagaauggagaaccugaauaaaaagguggacgauggguuccucgacaucuggacguauaacgcugaacugcuuguccugcucgagaaugaacggacacuggauuuucaugacuccaacgugaaaaaucuuuacgagaagguucgcagccagcugaaaaacaaugccaaggagauuggaaacggcugcuucgaauuuuaucacaaguguaaugaugagugcauggaaucugugaaaaacgggaccuacgacuaucccaaguacuccgaggagagcaaacucaauagagaaaagaucgacggcgucaaacuggaguccaugggaguguauaacauucuggccaucuacucuaccguugcuagcucccucgugcugcuugucucucugggcgcgauuagcuucuggaugugcuccaaugggagccuccagugucggaucugcaucuga

SEQ ID NO: 189382 - RNA, 1698 nt, Artificial Sequence
  derived and/or modified sequence opt5 from hemagglutinin__InfluenzaA__ADV69099
augaaggugaaacugaucguccuccugugcaccuucacagccacguacgcugacaccauuuguguuggcuaucacgccaacaauagcacagauaccguggacacagugcuugagaagaacgucaccgugacacauuccguuaaucugcucgaagauucucacaacgggaaacugugccuucugaagggaaucgcgccccuccagcugggcagcuguuccguggcuggguggauucugggaaauccugagugcgaacuccugaucucuaaagagagcugguccuacauugucgaaaccccgaaccccgagaauggcacguguuauccuggguacuuuaccgacuaugaggaacuuagagagcaacugucuagcguguccagcuucaagcgguuugaaaucuuccccaaggagucuuccuggccuaaccauacaguuaccggagugucuagcuccugcagccacaauggcaacucuuccuuuuaccgcaaucuccuguggcuuacagucaaaaacggccuguaucccaaucucagcaaguccuacaccaacaaaaaggagaaagaagugcuggugcuguggggaguccaucacccuucuaauaucgaggaucagagagcccucuaccacacggaaaacgccuauguuagcgugguguccagccauuacucucggcgcuucaacccggagauugcuaagagacccaagguccggaaucaggaagggcgcaucaacuauuacuggacacugcuugagccuggcgacaccauuaucuuugaggccaaugggaaccugauugcucccagauaugccuucgaacucuccaaaggauuuggcagcgggaucauuacaucuaaugcgccuaugggagaguguaacgccaagugccagacaccccaaggcgcuaucaauagcaaccugccguuccagaaugugcacccuguuaccaucggcgaaugucccaaauacgugcgguccgccaaacuucgcauggucaccgggcugagaaacacgccuucuauucagagccggggacucuuuggcgcuaucgccggguucauugagggaggcuggaccgggauggugaauggaugguauggcuaccaucaccacaacgaacagggcuccggguacgcggccaaucaacagagcccucccaacgcuaucaauggaauuacaaacaaaguuaacucugugaucgagaagaugaauacccaguuuacagccgucggcaaagaguucaacaagcuggaacgcagaauggagaaucugaacaagaaaguggaugacggguuccucgauaucuggaccuauaaugcugaacugcuuguccugcucgagaacgaacggacgcuggacuuucaugauuccaaugugaagaaccuuuacgagaaaguucgcagccagcugaagaauaacgccaaagagauuggaaauggcugcuucgaauuuuaucacaaguguaacgacgagugcauggaaucugugaagaaugggacauacgauuaucccaaauacuccgaggagagcaagcucaacagagaaaagaucgacggcgucaagcuggaguccaugggaguguauaauauucuggccaucuacucuaccguugcuagcucccucgugcugcuugucucucugggcgcgauuagcuucuggaugugcuccaacgggagccuccaaugucggaucugcaucuga

SEQ ID NO: 189383 - RNA, 1698 nt, Artificial Sequence
  derived and/or modified sequence opt5 from hemagglutinin__InfluenzaA__ADV69100
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaaucccugauuucuaaaaagagcugguccuacaucguugagaccccgaagcccgaaaauggcacguguuauccuggggaguuugccgacuacgaggaacuuagagagcaacugucuagcguguccagcuucgaacgguuugagaucuuccccaaagagucuuccuggccuaaccauaccgccgcuggagucagcgccucuugcucccacaauggcgaacgcagcuuuuauaagaaccucauuuggcugacagugaaaaauggccuuuaccccaaccugucuaaguccuauaaaaaugauaaggagaaggaaguucucauccuguggggagugcaucacccuccgaacauugagaaucagagaacccuguaccacacagaaaacaccuacgucagcgugguguccucucauuauagcgggcgguucacgcccgagaucacaaaacgcccuaaggucagagaccaggagggccggauuaacuacuauuggacccuccuggaacccggggauacaaucauuuuugaggcuaauggaaaccuuaucgccccuugguacgcguucacccugucccgcggccucgggagcggaaucguuaccucuaaugcccccauggacaaaugugaugcuaagugccagacaccgcacggcgccauuaacuccagccugccuuuucaaaaugugcaucccgugacgaucggcgaauguccuaaauaugucagaucugcuaaacuucggauggugaccgggcugcgcaacauucccagcauccaguccagaggacucuucggcgccauugcgggguuuaucgagggaggcuggacagggaugguugacggaugguacggcuaucaccaccagaaugaacagggcucuggguacgccgcugaucaagagagcacccagaacgccaucaauggaauuacaaacaaggucaauuccgugaucgagaagaugaacacccaguucacggcugugggcaaggaauuuaauaaacuggagcggcgcauggaaaaccugaauaagaaaguugacgauggguuccucgacauuuggacauacaacgccgagcugcuugugcugcucgaaaacgagagaacccuggacuuccaugauagcaaugucaagucucuuuaugagaaagugaagucccagcugaagaacaaugccaaagaaaucggaaacggcugcuuugaguucuaccacaaguguaauaacgaaugcauggagagcgucaaaaaugggaccuaugacuaccccaaguauucugaggaauccaaacucaaccgggagaagauugauggcgugaagcuggacagcaugggaguuuaccgcauccuggcuaucuauuccacaguggcgucuagccucguccugcuugugucccugggcgccauuucuuuuuggaugugcagcaaugggucccuccaauguagaaucugcauuuga

SEQ ID NO: 189384 - RNA, 1698 nt, Artificial Sequence
  derived and/or modified sequence opt5 from hemagglutinin__InfluenzaA__ADV69101
augaaggugaaacugcucauccuguucugcaccuuuacagccacguacgcugacaccauuuguaucggcuaucacgccaacaauagcacagauaccgucgacacaguucuugagaagaacgugaccgugacacauuccgucaaucugcucgaagauucucacaacgggaaacugugccuucugaagggaauugcgccccuccagcugggcaauuguagcguggcuggguggauccugggaaacccugagugcgaaucccucauuucuaaaaagagcugguccuacaucguugagaccccgaaucccgaaaacggcgccuguuauccuggggaguucgccgacuacgaggaacugagagagcaacuuucuagcguguccagcuuugaacgguucgagaucuuucccaaggagucuuccuggccuaaucauacggcuaccggagucagcgccucuugcucccacaacggcgaacgcagcuucuauagaaaucugauuuggcucacagugaaaaacggccuguaccccaaucuuucuaaguccuaugagaacgauaaagaaaaggagguucugauccucuggggagugcaucacccuccgaauauugaaaaccagcggacccuguaccacacagagaacgcuuacgucagcgugguguccucucauuauagcgggcgcuuuacccccgagaucacgaaaagaccuaagguccgggaccaggaaggccgcauuaauuacuauuggacacugcucgagcccggggauaccaucauuuucgaagccaacggaaaucugaucgcgccuugguacgccuuuacacuuuccagaggccuggggagcggaaucauuaccucuaacgcucccauggacgagugugauuccaagugccagaccccgcaaggcgccaucaauagcucucucccuuuccagaacguucaccccgugacaauuggcgaauguccuaaauaugugcggagcgcuaagcugcgcauggucacggggcuuagaaauauccccuccauucagucucggggacuguuuggcgccaucgcgggguucaucgagggaggcuggaccgggaugguggacggaugguacggcuaucaucaccagaacgagcaaggcagcggguacgccgcugaucaggaauccacacagaaugccauuaacggaaucaccaauaaaguuaacagcgugauugagaagaugaauccccaguuuacagcugucggcaaagaguucaacaagcucgaacgcagaauggaaaaucugaacaaaaagguggacgauggguuccuggacaucuggaccuacaacgccgagcuccugguucuucuggagaaugaacggacgcucgacuuucacgauucuaacgugaagucccuguaugagaaagucaagagccaacuuaaaaauaacgccaaggaaauuggaaauggcugcuucgaguuuuaccauaaauguaacaaugagugcauggaaucugugaagaacgggacauaugacuacccuaaguauuccgaggaaagcaaacugaaucgcgagaagaucgauggcgucaaacucgacuccaugggaguguacagaauccuggcuauuuauucuaccguugcgagcucccuggugcuccuggucucucuuggcgccaucagcuucuggaugugcuccaacgggagccugcagugucggauuugcaucuga

SEQ ID NO: 189385 - RNA, 1698 nt, Artificial Sequence
  derived and/or modified sequence opt5 from hemagglutinin__InfluenzaA__ADV69102
augaaggugaaacugcucauccuguucugcaccuuuacagccacguacgcugacaccauuuguaucggcuaucacgccaacaauagcacagauaccgucgacacaguucuugagaagaacgugaccgugacacauuccgucaaucugcucgaagauucucacaacgggaaacugugccuucugaagggaauugcgccccuccagcugggcaauuguagcguggcuggguggauccugggaaacccugagugcgaaucccucauuucuaaaaagagcugguccuacaucguugagaccccgaaucccgaaaacggcgccuguuauccuggggaguucgccgacuacgaggaacugagagagcaacuuucuagcguguccagcuuugaacgguucgagaucuuucccaaggagucuuccuggccuaaucauacggcuaccggagucagcgccucuugcucccacaacggcgaacgcagcuucuauagaaaucugauuuggcucacagugaaaaacggccuguaccccaaucuuucuaaguccuaugagaacgauaaagaaaaggagguucugauccucuggggagugcaucacccuccgaauauugaaaaccagcggacccuguaccacacagagaacgcuuacgucagcgugguguccucucauuauagcgggcgcuuuacccccgagaucacgaaaagaccuaagguccgggaccaggaaggccgcauuaauuacuauuggacacugcucgagcccggggauaccaucauuuucgaagccaacggaaaucugaucgcgccuugguacgccuuuacacuuuccaccggccuggggagcggaaucauuaccucuaacgcucccauggacgagugugauuccaagugccagacaccgcaaggcgccaucaauagcucucucccuuuccagaacguucaccccgugacgauuggcgaauguccuaaauaugugagaagcgcuaagcugcggauggucaccgggcuucgcaauauccccuccauucagucuagaggacuguuuggcgccaucgcgggguucaucgagggaggcuggacagggaugguggacggaugguacggcuaucaucaccagaacgagcaaggcagcggguacgccgcugaucaggaauccacccagaaugccauuaacggaaucacaaauaaaguuaacagcgugauugagaagaugaauacccaguuuacggcugucggcaaagaguucaacaagcucgaacggcgcauggaaaaucugaacaaaaagguggacgauggguuccuggacaucuggacauacaacgccgagcuccugguucuucuggagaaugaaagaacccucgacuuucacgauucuaacgugaagucccuguaugagaaagucaagagccaacuuaaaaauaacgccaaggaaauuggaaauggcugcuucgaguuuuaccauaaauguaacaaugagugcauggaaucugugaagaacgggaccuaugacuaccccaaguauuccgaggaaagcaaacugaaucgggagaagaucgauggcgucaaacucgacuccaugggaguguaccgcauccuggcuauuuauucuacaguugcgagcucccuggugcuccuggucucucuuggcgccaucagcuucuggaugugcuccaacgggagccugcaguguagaauuugcaucuga

SEQ ID NO: 189386 - RNA, 1698 nt, Artificial Sequence
  derived and/or modified sequence opt5 from hemagglutinin__InfluenzaA__ADV69103
augaaggugaaacugaugguccuccugugcaccuucacagccacguacgcugacaccaucuguguuggcuaucacgccaacaauagcacagauaccguggacacagugcuugagaagaacgucaccgugacacauuccguuaaucugcucgaagauucucacaacgggaaacugugccuucugaagggaauugcgccccuccagcugggcagcuguuccguggcuggguggauccugggaaauccugagugcgaacuccugauuucuaaagagagcugguccuacaucgucgaaaccccgaaccccgagaauggcacguguuauccuggguacuuuaccgacuaugaggaacuuagagagcaacugucuagcguguccagcuucaagcgguuugaaauuuuccccaaggagucuuccuggccuaaccauaauguuacaggagugucuagcuccugcagccacaacggcaaaucuuccuuuuaccgcaaucuccuguggcuuaccgucaagaacggccuguaucccaaucucagcaaauccuacacaaacaagaaagagaaggaagugcuggugcuguggggaguccaucacccuucuaauaucggggaucagagagcccucuaccacaccgagaacgccuauguuagcgugguguccagccauuacucucggcgcuucacgccggaaaucgcuaagagacccaaaguccggaaccaggagggccgcauuaauuauuacuggacacugcuugaaccuggggacaccaucauuuuugaggccaacggaaaucugaucgcucccagauaugccuucgagcucuccaagggcuuugggagcggaauuaucacaucuaacgcgccuauuggcgaauguaaugccaaaugccagacaccccaaggcgcuaucaacagcucccugccguuccagaaugugaacccuguuaccaucggggagugucccaaguacgugaaaucugccaaacuucggauggucaccggacugcgcaauacgccuagcauucaguccagaggccucuuuggggcuaucgccggauucauugaaggcggguggaccggaaugguggauggcugguauggcuaccaccaucagaacgagcaagggagcggauacgcggccgaccagcagucuacacagaaugcuaucaacggcauuaccaauaagguuaacuccgugaucgaaaagaugaauacacaauuuaccgccgucgggaaggaguucaacaaacuggagcggcgcauggaaaaccugaauaagaaaguggaugacggauuccucgauaucuggacguauaacgcugagcugcuuguccugcucgaaaaugagagaacacuggacuuucacgauagcaacgugaagaaucuuuacgaaaaaguuaagucucagcugaagaacaaugccaaagagauuggcaacgggugcuucgaguuuuaucacaaguguaaugacgaaugcauggaguccgugaaaaacggcaccuacgacuaucccaaguacagcgaagaguccaaacucaaucgggagaagaucgauggagucaagcuggaaucuaugggcguguauaacauucuggccaucuacagcaccguugcuuccucucucgugcugcuugucagccugggggcgauuuccuucuggaugugcagcaauggaucucuccagugucgcaucugcaucuga

SEQ ID NO: 189387 - RNA, 1698 nt, Artificial Sequence
  derived and/or modified sequence opt5 from hemagglutinin__InfluenzaA__ADV69104
augaaggugaaacugcucauccuguucugcaccuuuacagccacguacgcugacaccauuuguaucggcuaucacgccaacaauagcacagauaccgucgacacaguucuugagaagaacgugaccgugacacauuccgucaaucugcucgaagauucucacaacgggaaacugugccuucugaagggaauugcgccccuccagcugggcaauuguagcguggcuggguggauccugggaaacccugagugcgaaucccucauuucuaaaaagagcugguccuacaucguugagaccccgaaucccgaaaacggcgccuguuauccuggggaguucgccgacuacgaggaacugagagagcaacuuucuagcguguccagcuuugaacgguucgagaucuuucccaaggagucuuccuggccuaaucauacggcuaccggagucagcgccucuugcucccacaacggcgaacgcagcuucuauagaaaucugauuuggcucacagugaaaaacggccuguaccccaaucuuucuaaguccuaugagaacgauaaagaaaaggagguucugauccucuggggagugcaucacccuccgaauauugaaaaccagcggacccuguaccacacagagaacgcuuacgucagcgugguguccucucauuauagcgggcgcuuuacccccgagaucacgaaaagaccuaagguccgggaccaggaaggccgcauuaauuacuauuggacacugcucgagcccggggauaccaucauuuucgaagccaacggaaaucugaucgcgccuugguacgccuuuacacuuuccagaggccuggggagcggaaucauuaccucuaacgcucccauggacgagugugauuccaagugccagaccccgcaaggcgccaucaauagcucucucccuuuccagaacguucaccccgugacaauuggcgaauguccuaaauaugugcggagcgcuaagcugcgcauggucacggggcuuagaaauauccccuccauucagucucggggacuguuuggcgccaucgcgggguucaucgagggaggcuggaccgggaugguggacggaugguacggcuaucaucaccagaacgagcaaggcagcggguacgccgcugaucaggaauccacacagaaugccauuaacggaaucaccaauaaaguuaacagcgugauugagaagaugaauacacaguuuaccgcugucggcaaagaguucaacaagcucgaacgcagaauggaaaaucugaacaaaaagguggacgauggguuccuggacaucuggacguacaacgccgagcuccugguucuucuggagaaugaacggacacucgacuuucacgauucuaacgugaagucccuguaugagaaagucaagagccaacuuaaaaauaacgccaaggaaauuggaaauggcugcuucgaguuuuaccauaaauguaacaaugagugcauggaaucugugaagaacgggaccuaugacuaccccaaguauuccgaggaaagcaaacugaaucgcgagaagaucgauggcgucaaacucgacuccaugggaguguacagaauccuggcuauuuauucuaccguugcgagcucccuggugcuccuggucucucuuggcgccaucagcuucuggaugugcuccaacgggagccugcagugucggauuugcaucuga

SEQ ID NO: 189388 - RNA, 1698 nt, Artificial Sequence
  derived and/or modified sequence opt5 from hemagglutinin__InfluenzaA__ADV69105
augaaggugaaacugcucauccugcuuugcaccuucacagccacguacgcugacaccauuuguaucggcuaucacgccaacaauagcacagauaccgucgacacaguucuggaaaagaacgugaccgugacacauuccgucaaucuccuggaagauucucacaacgggaaacuuugccugcucaagggaauugcgccccugcagcugggcaauuguagcguggcuggguggauccucggaaacccugagugcgaaucccugauuucuaaaaagagcugguccuacaucguugagaccccgaaucccgaaaacggcgccuguuauccuggggaguuugccgacuacgaggaacuuagagagcaacugucuagcguguccagcuucgaacgguuugagaucuuccccaaggagucuuccuggccuaaucauacggcugccggagucagcgcuucuugcucccacaacggcgaacgcagcuuuuauagaaaucucauuuggcugaccgugaaaaacggccuuuaccccaaucugucuaaguccuauaaaaacgauaaggagaaagaaguucucaucauuuggggagugcaucacccuccgaauaucgagaaccagcggacacuguaccacaccgaaaacgccuacgucagcgugguguccucucauuauagcgggcgcuucacacccgagauuaccaagagaccuaagguccgggaccaggagggccgcaucaauuacuauuggacgcugcucgaacccggggauacaauuaucuuugaggcgaacggaaaucugaucgccccuugguacgcuuucacccuuuccagaggccuggggagcggaauuaucacaucuaacgcccccauggacgaaugugaugcuaaaugccagaccccgcaaggcgccauuaauuccagccucccuuuucagaacguucaccccgugaccaucggcgaguguccuaaguaugugcggucugcgaaacugcgcauggucacagggcuuagaaauauucccagcauccagucccggggacuguucggcgccaucgcuggguuuauugaaggaggcuggacggggaugguggacggaugguacggcuaucaucaccagaacgagcaaggcucuggguacgccgcugaucaggagagcacccagaaugccaucaacggaauuacaaauaagguuaacuccgugaucgagaaaaugaauacccaguucacagccgucggcaaggaauuuaacaaacucgaacgcagaauggagaaucugaacaagaagguggacgauggguuccuggacauuuggaccuacaacgcugaacuccugguucuucuggagaaugagcggacgcucgacuuccacgauagcaacgugaaaucucuguaugaaaaggucaaaucccaacuuaagaauaacgcgaaagagaucggaaauggcugcuuugaguucuaccauaaguguaacaaugaaugcauggagagcgugaagaacgggacauaugacuaccccaaauauucugaagaguccaagcugaaucgcgagaaaaucgauggcgucaagcucgacagcaugggaguguaccggauucuggccaucuauuccaccguugcuucuagccuggugcuccuggucucccuuggcgccauuucuuuuuggaugugcagcaacgggucccugcaguguagaaucugcauuuga

SEQ ID NO: 189389 - RNA, 1698 nt, Artificial Sequence
  derived and/or modified sequence opt5 from hemagglutinin__InfluenzaA__ADV69106
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaaucccugauuucuaaaaagagcugguccuacaucguugagaccccgaaucccggcaacggggccuguuauccuggauacuuugccgacuaugaagaacuuagagagcaacugucuagcguguccagcuucgaacgguuugagauguuccccaaggaaucuuccuggccuaaucauaacgucaauggcgugagcgcuucuugcucccacaacggcaaaagcucuuuuuaccgcaaucuccuguggcuuacgagaaagaacgggcuguaucccaaucucaccaaauccuacgccaacaacaaugauaaggagguucugauccuguggggagugcaucacccuagcaacauuggcgaccagcggacacucuaccacaccgagaaugcuuaugucuccgugaugucuagccauuacucccgcagauucacaccggaaaucaccaaacggcccaaggugcgcgaucaggaggggagaauuaacuauuacuggacgcugcuugaaccuggagacacaaucauuuuugaggccaauggcaaccugaucgcgcccugguaugccuucgcucucagccggucuuuuggguccggaauuaucaccagcucugccccuauggaugaaugugacgcuaagugccagacaccccaaggcgccaucaauagcucccugccguuccagaacguccacccuguuaccauuggcgagugucccaaauacgugcgcucugcgaaacuuaaaauggugaccgggcugagaaauaucccuagcauucagucccggggacucuuuggcgccaucgcuggguucauugagggaggcuggacagggauggucgauggaugguauggcuaccaucaccagaacgaacaaggcagcggguacgccgcugaccaggagucuacgcagaaugccaucaacggaaucaccaauaaggugaacuccguuauugaaaagaugaauacacaguuuaccgccgugggcaaggaguucaacaaacuggaaaagcgcauggagaaccugaauaagaaagucgaugacggguuccucgacaucuggacauauaacgcugagcugcuugugcugcucgaaaaugagagaacccuggauuuucacgacagcaacguuaagucucuuuacgaaaaagugaagauucaacugaaaaauaacgcgaaggagaucggaaauggcugcuucgaauuuuaucauaaguguaacaaugagugcauggaguccguccggaacgggacguacgauuaucccaaauacagcgaagaguccaagcucaaucgcgagaaaauugacggcgugaagcuggauucuaugggagucuaucagauccuggccaucuacagcacaguggcuuccucucucguucugcuugugagccugggcgccauuuccuucuggaugugcagcaacgggucucuccaguguagaaucugcauuuga

SEQ ID NO: 189390 - RNA, 1698 nt, Artificial Sequence
  derived and/or modified sequence opt5 from hemagglutinin__InfluenzaA__ADV69107
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaaucccugauuucuaaagagagcugguccuacaucguugaaacccccaauucugacaacggcgccuguuaucccgggcaauuuacggauuacgaggagcuuagagaacagcugagcuccgugagcucuuucgagcgguuugaaaucuucccuaaggaguccagcuggcccaaucauaccgucacaggagugucugccuccugcagccacaacggcgagcgcucuuuuuauagaaaucucauuuggcugaccguuaagaacggccuuuacccuaaucuguccaaaagcuaugaaaacgacaaggagaaagaagugcucauccuguggggaguccaucacccgccuaauauuggggaucagcggacacuguaccacaccgagaacgcuuacaucuccguggugucuagccauuauuccggccgcuucacgccggaaauuacaaagagacccaaaguccgggaccaggaggggcgcaucaacuacuauuggacccuccuggagccuggagauacaauuaucuuugaagccaauggcaaccuuaucgcucccugguacgccuucgcgcugagcagagggcucggaucuggcauuaucaccuccaaugccccuauggacaagugugaugcuaagugccaaacaccccagggcgccauuaacagcucucugccguuucagaauguucacccugugaccaucggggagugucccaaauaugugcggagcacgaaacuucgcauggucaccggacugagaaacauuccuuccauccagucucggggccucuucggggcuaucgccggauuuauugaaggcggguggacaggaaugguggacggcugguacggcuaucaucaccaaaaugagcaggggagcggauacgcggccgaucaggaauccacccagaacgcuaucaauggcauuacaaacaaaguuaauagcgugaucgagaagaugaacacccaauucacggccgucgggaaagaguuuaauaagcuggaacgcagaauggagaaccugaauaaaaagguggacgacggauuccucgauauuuggacauacaacgcugaacugcuuguucugcucgagaacgaacggacccuggacuuccacgauucuaaugugaagucccuuuaugagaaagucaagagccagcugaaaaacaaugccaaggagaucggcaacgggugcuuugaguucuaccauaaauguaauaacgaaugcauggaaucugugcgcaauggcaccuaugacuaccccaaguauuccgaggagagcaagcucaacagagaaaagaucgauggagucaagcuggacuccaugggcguguaccggauucuggccaucuauucuacagcugcgagcucccucguucugcuugugucucugggggccauuagcuuuuggaugugcuccaauggaagccuccaguguagaaucugcauuuga

SEQ ID NO: 189391 - RNA, 1698 nt, Artificial Sequence
  derived and/or modified sequence opt5 from hemagglutinin__InfluenzaA__ADV69108
augaaggugaaacugcucguccugcuuugcaccuucacagccacguacgcugacaccaucuguguuggcuaucacgccaacaauagcacagauaccguggacacagugcuggagaagaacgucaccgugacacauuccguuaaucuccuggaagauucucacaacgggaaacuuugccugcucaagggaauugcgccccugcagcugggcagcuguuccguggcuggguggauccucggaaauccugagugcgaacugcuuauuucuaaagagagcugguccuacaucgucgaaaccccgaaccccgagaauggcacguguuauccuggguacuuuaccgacuaugaggaacugagagagcaacucucuagcguguccagcuucaagcgguuugaaauuuuccccaaggagucuuccuggccuaaccauacaguuaccggagugucuagcuccugcagccacaauggcaaaucuuccuuuuaccgcaaccugcuuuggcugacaaugaagaauggccucuaucccaaccugagcaaauccuacaccaauaagaaagagaaggaaguccuggugcucuggggagugcaucacccuucuaacaucggggaucagagagcccuguaccacacggagaaugccuaugucagcguuguguccagccauuacucucggcgcuucacaccggaaaucgcuaagagacccaaagugcggaaccaggagggccgcauuaacuauuacuggacccuucuggaaccugaggacacaaucauuuuugaggccaaugggaaccucaucgcucccagauaugccuucgaacuguccaagggauuuggcagcgggauuaucaccucuaaugcgccuaugggagaguguaacgccaaaugccagacaccccaaggcgcuauuaauagcucccuuccguuccagaacguccacccugugaccaucggcgaaugucccaaguacguucggucuagcaaacugcgcauggugacggggcucagaaauaccccuuccauccagagccggggacuguuuggcgccauugcuggguucaucgagggaggcuggacagggauggucgauggaugguauggcuaccaucaccagaacgaacaaggcucuggguacgccgcggaccagcaguccacccagaaugccauuaacggaaucacaaauaaggugaacagcguuauugagaaaaugaauacccaauuuacggcugugggcaaggaguucaacaagcuggaacgcagaauggagaaucucaacaaaaagaucgaugacggguuccuggauaucuggacauauaacgccgaacuucugguccuccuggagaaugaacggacccuugacuuucacgauucuaacgugaaaaaucuguacgagaaggucaaaucccagcucaagaacaaugcuaaggagauuggaaacggcugcuucgaauuuuaucauaaauguaaugacgagugcauggaaagcgugaagaacgggaccuacgacuaucccaaauacuccgaggagucuaagcugaaucgcgagaaaaucgauggcguuaagcuggaaagcaugggaguguauaacauucucgccaucuacuccacagucgccucuagccuggugcuucugguuucccucggcgcuauuagcuucuggaugugcucuaaugggucccugcaguguagaaucugcaucuga

SEQ ID NO: 189392 - RNA, 1698 nt, Artificial Sequence
  derived and/or modified sequence opt5 from hemagglutinin__InfluenzaA__ADV69109
augaaggugaaacugcucauccugcuuugcaccuucaaggccacauacgcugacacgauuuguaucggcuaucacgccaacaauagcaccgagacagucgauaccguucuggaaaagaacgugacagugacccauuccgucaaucuccuggaggacucucacaacgggaaacuuugccugcucaaaggaauugcgccccugcagcugggcaauuguagcguggcuggguggauccucggaaacccugaaugcgagucccugauuucuaaaaagagcugguccuacaucguugaaacaccgaaucccgagaacggcgccuguuauccuggggaguuugccgauuacgaggaacuuagagaacaacugucuagcguguccagcuucgagcgguuugagaucuuccccaaggaaucuuccuggccuaaucauaccgcuacgggagucagcgccucuugcucccacaacggcgagcgcagcuuuuauagaaaucucauuuggcugaccgugaagaacggccuuuaccccaaucugucuaaauccuaugaaaacgacaagaaaaaggagguucucauccuguggggagugcaucacccuccgaauauugaaaaccagcggacacuguaccacaccgagaacgcuuacgucagcgugguguccucucauuauagcgggcgcuucacacccgagaucaccaagagaccuaaaguccgggaucaggaaggccgcauuaauuacuauuggacgcuccuggagcccggggacacaaucauuuuugaagccaacggaaaucuuaucgcgccuugguacgccuucacccuguccagaggccucgggagcggaaucauuacaucuaacgcucccauggaugagugugacgccaagugccagaccccgaaaggcgcuaucaauuccagccugccuuuucaaaacguucaccccgugaccauuggcgaauguccuaaguaugugcggucugccaaacuucgcauggucacagggcugagaaauauccccagcauucagucccggggacucuucggcgcgaucgccggguuuaucgagggaggcuggacggggaugguggauggaugguacggcuaucaucaccagaacgagcagggcucuggguacgcugccgaccaagaaagcacccagaaugcuauuaacggaaucacaaauaagguuaacuccgugauugagaaaaugaauacccaguucacagccgucggcaaggaauuuaacaagcuggagcgcagaauggaaaaucugaacaaaaagguggaugacggguuccucgauaucuggaccuacaacgccgagcugcuuguucugcucgagaaugaacggacgcuggacuuccacgacagcaacgugaaaucucuuuaugagaaggucaaaucccagcugaagaauaacgcuaaggaaauuggaaauggcugcuuugaguucuaccauaaauguaacaaugagugcauggaaagcgugaagaacgggacauaugauuaccccaaauauucugaggaauccaagcucaaucgcgagaaaaucgacggcgucaagcuggauagcaugggaguguacagaauccuggcgauuuauuccaccguugccucuagccucgugcugcuugucucccugggcgcuaucucuuuuuggaugugcagcaacgggucccuccaaugucggauuugcaucuga

SEQ ID NO: 189393 - RNA, 1701 nt, Artificial Sequence
  derived and/or modified sequence opt5 from hemagglutinin__InfluenzaA__ADV76579
augaagaccaucauugcccugagcuacauccucugccugguguucgcucagaaacuucccggcaacgacgauuccacagccacgcugugucucgggcaccaugcggucccuaauggaaccauuguuaagacaaucaccaacgaccaaauugaggugacaaaugcuaccgaacuggugcagucuagcuccacaggcgagaucugcgauucuccgcaccagauccuugacggggaaaacuguacccugauugaugcccuccugggagacccccagugcgauggcuuucaaaauaaaaagugggaccuguucgucgagagaagcaaagccuauuccaacuguuacccuuaugaugugcccgacuacgcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaucugcgcuuuaaguauccugcccuuaacgucaccaugcccaauaacgagcaguucgauaagcuguacauuuggggcgugcaccauccugggacggacaacgaucagaucuuucucuaugcgcaagccucuggaagaauuacaguuuccaccaaacggagccagcagacagugaucccgaauauuggcucccgccccagaguccggaacaucccuucucgcaucagcauuuacuggaccaucgugaagcccggggacauucugcugaucaauuccaccggaaaccucauugcuccuagaggcuacuucaaaauccggagcgggaagucuuccaucaugcgcagcgacgcccccauuggaaaauguaauucugaaugcaucacaccgaacggcagcauuccuaaugauaagcccuuucagaacgugaauagaaucacguauggcgcuuguccucgguacgucaagcaaaacacccugaaacuugccacagggaugcgcaauguucccgagaagcagaccagaggaauuuucggcgcgaucgccggguuuaucgaaaacggaugggagggcaugguggacgggugguauggauuccggcaccaaaauuccgagggcagaggccaggcugccgaucugaaaucuacacaggcugccauugaccagaucaacgggaagcucaaucgccugauuggaaaaaccaacgaaaaguuccaccagaucgagaaagaauuuagcgagguggaaggccggauucaagaucuugagaaguacgucgaggacacgaagaucgaucugugguccuauaacgccgaacuccugguggcucuggagaaucagcauacaauugaccucaccgauagcgaaaugaacaaacuguucgagaagaccaaaaagcagcuuagagaaaaugcggaggacauggggaacggaugcuuuaaaaucuaccacaagugugauaaugccugcaucggcucuauucgcaacgggacauaugaccaugacguuuaccgggaugaggcucugaauaacagauuccagaucaagggcguggaacucaaauccggauacaaggacuggauucuguggaucagcuuugccauuucuugcuuccuucugugugucgcccuccugggcuuuaucaugugggcuugccaaaaagggaauauccgcuguaacauuugcaucuga

SEQ ID NO: 189394 - RNA, 1701 nt, Artificial Sequence; identical to SEQ ID NO: 186612
  derived and/or modified sequence opt5 from hemagglutinin__InfluenzaA__ADV76587

SEQ ID NO: 189395 - RNA, 1701 nt, Artificial Sequence; identical to SEQ ID NO: 186612
  derived and/or modified sequence opt5 from hemagglutinin__InfluenzaA__ADV76598

SEQ ID NO: 189396 - RNA, 1701 nt, Artificial Sequence; identical to SEQ ID NO: 186435
  derived and/or modified sequence opt5 from hemagglutinin__InfluenzaA__ADV76609

SEQ ID NO: 189397 - RNA, 1701 nt, Artificial Sequence; identical to SEQ ID NO: 186612
  derived and/or modified sequence opt5 from hemagglutinin__InfluenzaA__ADV76620

SEQ ID NO: 189398 - RNA, 1701 nt, Artificial Sequence
  derived and/or modified sequence opt5 from hemagglutinin__InfluenzaA__ADV76631
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauccgcagaucuaagaacuccuuuuucagccggcugaauuggcucacacaucugaacuuuaaauauccugcccuuaaugucaccaugcccaacaacgagcaguucgacaagcuguacauuuggggcgugcaccauccugggacggauaaagaccagaucuuucucuaugcgcaagccucuggacgcauuacaguuuccaccaagagaagccagcagacagugaucccgaauauuggcucccggccccgcgucagaaacaucccuucucggaucagcauuuacuggaccauggugaaacccggggauauccugcugauuaauuccaccggaaaccucaucgcuccucgcggcuacuucaagauuagaagcgggaagucuuccaucaugcggagcgacacacccaucggaaaauguaauucugagugcauuacgccgaacggcagcaucccuaaugacaagcccuuucagaacgugaaucgcauuaccuauggcgccuguccuagauacgucaaacaaaacacacugaaacuugcuaccgggaugcggaauguucccgaaaaacagacacgcggaaucuucggcgccauugcgggguuuaucgagaacggaugggaaggcaugguggaugggugguauggauucagacaccaaaauuccgagggccggggccaggccgcugaccugaagucuacccaggccgcuaucgaucagauuaacgggaaacucaauagacugaucggaaaggccaacgagaaguuccaccagauugaaaaagaguuuagcgaaguggagggccgcauccaagaccuugaaaaguacgucgaggauacgaaaauugaccugugguccuauaacgccgagcuccugguggcucuggaaaaucagcauacaaucgaucucaccgacagcgagaugaacaagcuguucgaaaagaccaagaagcagcuucgggagaaugcggaagauauggggaacggaugcuuuaaaauuuaccacaagugugacaaugccugcaucggcucuaucagaaacgggacauaugaucaugacguuuaccgcgacgaggcucugaauaaccgguuccagauuaaaggcguggagcucaaguccggauacaaagauuggauccuguggauuagcuuugccaucucuugcuuccuucugugugucgcccuccugggcuuuauuaugugggcuugccaaaaggggaauaucagauguaacaucugcauuuga

SEQ ID NO: 189399 - RNA, 1701 nt, Artificial Sequence; identical to SEQ ID NO: 188616
  derived and/or modified sequence opt5 from hemagglutinin__InfluenzaA__ADV76642

SEQ ID NO: 189400 - RNA, 1701 nt, Artificial Sequence; identical to SEQ ID NO: 188620
  derived and/or modified sequence opt5 from hemagglutinin__InfluenzaA__ADV76664

SEQ ID NO: 189401 - RNA, 1701 nt, Artificial Sequence
  derived and/or modified sequence opt5 from hemagglutinin__InfluenzaA__ADV76673
augaagaccaucauugcccugagcuacaucuucugccucgcucugggccaggaccuucccgggaacgauaauuccacagccacgcugugucucggacaccaugcggugccuaacggcacccuggucaaaacaauuaccgacgaucaaaucgagguuacaaaugcuaccgaacuugugcagucuagcuccacagggaagauuugcaacaauccgcacagaauccuggacggaaucgauuguacccucauugacgcccugcugggcgauccccauugcgacguguuucagaacgagacgugggaucucuucgucgaacggucuaaagccuuuagcaauuguuauccuuacgacgugcccgauuaugcuucccugcgcucucuuguugccagcuccgggacccuggaguucaucacagaaggauuuaccuggacaggcgugacccagaacggcgggagcaaugcuugcaagagaggaccuggcucuggguucuuuucccggcucaacuggcugacgaaaagcggaucuacauaccccguccuuaaugugaccaugccuaacaaugacaacuucgauaagcuguauauuuggggcguucaccauccguccacaaaucaagagcagaccagccucuacgugcaggccucugggcgcgucaccguguccacaagacggagccagcaaacgaucauucccaacaucgagucccgcccuugggugagaggacugucuagccggauuuccaucuauuggaccaucgucaaccccggcgacguucuggugauuaauagcaacggcaaucucaucgcgccucgcggguacuuuaagaugagaacaggaaaaucuuccauuaugcggagcgacgcccccaucgauaccuguauuucugaaugcaucacaccgaacggcagcaucccuaaugacaagcccuuccagaacgugaauaaaauuaccuacggggcuuguccuaaguaugucaaacagaacacgcugaaacuugccacaggaaugcgcaaugugcccgagaagcagaccagaggccuguuuggggcuaaagccggauucaucgaaaacggcugggagggcaugauugaugggugguacggauuucggcaccaaaauuccgagggcaccgggcaggcggccgaccucaagucuacacaggcugccaucgaucaaauuaacggaaaacugaaucgcguuaucgaaaagaccaacgagaaauuccaccagaucgaaaaggaguucagcgaaguggagggccggauucaggaccuugagaaauaugucgaagauacaaagaucgaccugugguccuacaaugcugagcuccugguggcccuggaaaaccagcauacgauugaucucaccgacagcgagaugaacaagcuguuugaaaagacaagaagacaacuucgcgagaaugccgaggauauggggaacggcugcuucaagaucuaucacaaaugugacaaugcuugcauugaaucuauccggaacggaaccuacgaccaugauguuuauagagacgaggcgcugaauaaccgcuuucagauuaagggcguggaacucaaauccggguacaaggauuggauccuguggaucagcuucgccauuucuugcuuucuucugugugucgugcuccugggauucaucaugugggcuugccagcggggcaauauuagauguaacaucugcauuuga

SEQ ID NO: 189402 - RNA, 1701 nt, Artificial Sequence
  derived and/or modified sequence opt5 from hemagglutinin__InfluenzaA__ADV76682
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaauuuuaaguauccugcccuuaacgucaccaugcccaacaaugagcaguucgacaagcuguacauuuggggcgugcaccauccugggacggauaaagaccagaucuuucucuaugcgcaagccucuggacgcauuacaguuuccaccaagagaagccagcaggcugugaucccgaacauuggcucccggccccgcgucagaaauaucccuucucggaucagcauuuacuggacaaucgugaaacccggggauauucugcugaucaacuccaccggaaaucucauugccccucgcggcuacuucaagaucagaagcggggaaucuuccaucaugcggagcgacgcucccauuggaaaauguaacucugagugcaucaccccgaauggcagcauuccuaacgacaagcccuuucagaaugugaaccgcaucacauauggcgccuguccuagauacgucaagcaaaauacgcugaaacuugcgaccgggaugcggaacguucccgaaaagcagacacgcggaauuuucggcgccaucgcuggguuuaucgagaauggaugggagggcaugguggaugggugguauggauucagacaccagaacuccgaaggccggggccaagccgcugaccugaaaucuacccaggccgccauugaucagaucaaugggaagcucaacagacugauuggaaaaacaaacgagaaguuccaccagaucgaaaaagaguuuagcgaaguggagggccgcauucaagaccuugagaaguacgucgaagauaccaagaucgaccugugguccuauaaugcugagcuccugguggcgcuggaaaaccagcauacgauugaucucacagacagcgagaugaauaaacuguucgaaaagaccaaaaagcagcuucgggagaacgccgaggauauggggaauggaugcuuuaaaaucuaccacaagugugacaacgcuugcaucggcucuauuagaaaugggaccuaugaucaugacguuuaccgcgacgaagcccugaacaaucgguuccagaucaagggcguggagcucaaauccggauacaaggauuggauucuguggaucagcuuugccauuucuugcuuccuucugugugucgcucuccugggcuuuaucaugugggccugccaaaaagggaacaucagauguaauauuugcaucuga

SEQ ID NO: 189403 - RNA, 1701 nt, Artificial Sequence; identical to SEQ ID NO: 186637
  derived and/or modified sequence opt5 from hemagglutinin__InfluenzaA__ADV76694

SEQ ID NO: 189404 - RNA, 1701 nt, Artificial Sequence; identical to SEQ ID NO: 186435
  derived and/or modified sequence opt5 from hemagglutinin__InfluenzaA__ADV76705

SEQ ID NO: 189405 - RNA, 1701 nt, Artificial Sequence; identical to SEQ ID NO: 186637
  derived and/or modified sequence opt5 from hemagglutinin__InfluenzaA__ADV76716

SEQ ID NO: 189406 - RNA, 1701 nt, Artificial Sequence
  derived and/or modified sequence opt5 from hemagglutinin__InfluenzaA__ADV76727
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaaguccagcgcuugcauccgcagaucuaaaaacuccuuuuucagccggcugaauuggcucacccaucugaacuuuaaguauccugcccuuaaugucacaaugcccaacaacgagcaguucgacaaacuguacauuuggggcgugcaccauccugggaccgauaaggaccagaucuuucucuaugcgcaagccucuggacgcauuacgguuuccacaaaaagaagccagcagaccgugaucccgaauauuggcucccggccccgcgucagaaacaucccuucucggaucagcauuuacuggacaaucgugaagcccggggauauucugcugaucaauuccaccggaaaccucauugcuccucgcggcuacuucaagaucagaagcgggaaaucuuccaucaugcggagcgacgcccccauuggaaaguguaauucugagugcaucaccccgaacggcagcauuccuaaugacaaacccuuucagaacgugaaucgcaucacauauggcgcuuguccuagauacgucaagcaaaacacgcugaaacuugccaccgggaugcggaauguucccgaaaagcagacacgcggaauuuucggcgcgaucgccggguuuaucgagaacggaugggaaggcaugguggaugggugguauggauucagacaccaaaauuccgagggccggggccaggcugccgaccugaaaucuacccaggcugccauugaucagaucaacgggaagcucaauagacugauuggaaagacaaacgagaaauuccaccagaucgaaaaggaguuuagcgaaguggagggccgcauucaagaccuugaaaaauacgucgaggauaccaagaucgaccugugguccuauaacgccgagcuccugguggcucuggaaaaucagcauacgauugaucucacagacagcgagaugaacaaacuguucgaaaagaccaagaaacagcuucgggagaaugcggaagauauggggaacggaugcuuuaagaucuaccacaaaugugacaaugccugcaucggcucuauuagaaacgggaccuaugaucaugacguuuaccgcgacgaggcucugaauaaccgguuccagaucaagggcguggagcucaaauccggauacaaggauuggauucuguggaucagcuuugccauuucuugcuuccuucugugugucgcccuccugggcuuuaucaugugggcuugccaaaaggggaauaucagauguaacauuugcaucuga

SEQ ID NO: 189407 - RNA, 1701 nt, Artificial Sequence
  derived and/or modified sequence opt5 from hemagglutinin__InfluenzaA__ADV91009
augaaggccauccuggcugugcuccuguacaccuucgccacagcgaacgcugacacgcuuugcauuggcuaucacgccaauaacagcaccgauacagucgacaccguucuggagaaaaaugugacagugacccauuccgucaaccuccuggaagauaagcacaaugggaaacuuuguaagcugagaggaaucgcuccccuccaucugggcaaaugcaacauugccggguggauccugggaaauccugagugugaaucucucagcacagccuccucuuggagcuacauuguggagaccccguccucugacaacggcacgugcuaucccggggauuuuaucgacuacgaagaacugcgggagcagcuuagcuccguuagcucuuucgaacgcuuugagaucuucccuaagaccuccagcuggcccaaucacgauucuaacaagggagugacagcugccuguccucaugcgggcgccaaauccuuuuauaagaaucugauuuggcucgucaaaaagggcaacagcuaccccaaacugucuaaguccuauaucaaugacaaggggaaaaaggugcuuguucuguggggcauucaccacccuagcaccuccgcugaucaacagucucucuaccagaacgccgacgcuuacguguucgucggaacaagcagauauuccaaaaaguuuaaaccggaaaucgccauucggcccaaggugcgcgaucaggaggggagaaugaauuacuauuggacccugguggagccuggagacaaaaucacguucgaagcgacaggcaaccuggucguuccccgguacgccuuugcuauggagcgcaacgccgggagcggaauuaucaucucugauaccccugugcaugacugcaauacaaccugucaaacccccaagggcgcuauuaacacaucccucccguuccagaauauccacccuauuacgaucggcaagugccccaaauauguggaaagcaccaagcugagacuugccacagggcugcggaacgucccuucuauucagagccgcggacucuuuggcgccaucgcuggguucaucgagggaggcuggaccgggaugguggacggaugguacggcuaucaucaccagaaugaacaaggcuccggguacgcggccgaucugaaaucuacacagaacgcuauugacaagaucaccaauaaaguuaacagcgugauugagaagaugaauacgcaguuuacagccgucggaaaggaguucaaccaccuugagaaaagaaucgagaaucugaacaagaaaguggaugacggcuuccucgauauuuggaccuacaaugccgaacugcugguucuccuggagaacgaacggacccuugacuaucaugauuccaaugugaagaaccuguacgagaaaguccgcagccagcucaagaacaaugcuaaggagaucgggaacggauguuuugaguucuaucacaaaugcgacaauacauguauggaaucugugaagaacggcaccuacgauuaucccaaauacuccgaagaggccaagcugaauagagaagagaucgacggggucaaacuugagagcacacggauuuaucaaauccuggcgauuuacucuacgguggcuuccagccucguucugguggucucccugggcgccaucucuuuuuggaugugcagcaacggaucccuccagugccgcauuuguaucuga

SEQ ID NO: 189408 - RNA, 1701 nt, Artificial Sequence
  derived and/or modified sequence opt5 from hemagglutinin__InfluenzaA__ADV91010
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuaccgacuacgaagaacugcgggagcagcuuuccagcgucucuuccuucgaacgcuuugagauuuuccccaagacaagcucuuggccuaaucacgauuccaacaagggagugaccacagccuguccccaugcuggcgccaagagcuuuuauaagaaucugaucuggcucguuaaaaagggcaacucuuacccuaaacuguccaagagcuauaucaaugacaaggggaaagaagugcuuguccuguggggcauucaccaucccccuaccuccgcggaucaacagucucucuaccagaacgccgacgcuuacguguucgugggaacgagcagauauuccaagaaauuuaagccggagaucgccauucggcccaaaguccgcgaucaggaggggagaaugaauuacuauuggacacugguugaaccuggagacaagaucaccuucgaggcuacaggcaaccugguggugccccgguacgccuuugcgauggaacgcaacgccgggagcggaauuaucauuucugauaccccuguccacgacugcaauaccacaugucaaacgcccaaaggcgcuaucaacaccucccucccguuccagaauauccacccuauuacaaucggcaagugccccaaguaugugaaaagcaccaagcugagacuugccacagggcugcggaacguuccuucuauucagagccgcggacucuuuggcgcuaucgccggguucauugagggaggcuggaccgggaugguggacggaugguacggcuaucaucaccagaaugaacaaggcuccggguacgccgcugaucugaaaucuacgcagaacgcgaucgacgagaucacaaauaaggucaacagcgugauugagaaaaugaauacccaguuuaccgccguuggaaaggaguucaaccaccuugagaagagaaucgaaaaucugaacaaaaagguggaugacggcuuccucgauauuuggacauacaaugcugagcugcugguccuccuggaaaacgagcggacccuugacuaucaugauuccaaugugaaaaaccuguacgagaagguccgcagccagcucaaaaacaaugccaaggaaaucgggaacggauguuuugaguucuaucacaagugcgacaauacauguauggaaucugugaaaaacggcacguacgauuaucccaaguacuccgaggaagccaaacugaauagagaggagauugacgggguuaaacuugaaagcacccggaucuaucaaauccuggcuauuuacucuacaguggccuccagccucguccuggugguuucccugggcgcgaucucuuuuuggaugugcagcaacggaucccuccagugccgcauuuguaucuga

SEQ ID NO: 189409 - RNA, 1701 nt, Artificial Sequence
  derived and/or modified sequence opt5 from hemagglutinin__InfluenzaA__ADW01407
auggaggccaagcuguucgugcucuuuugcgcuuucaccgcccugaaagcggacacaaucugugucggcuaccacgcuaacaauagcacggauaccguugacacaauucuugaaaagaacgugaccgugacacauuccgucaaucugcucgagaacucucacaaugggaaacugugcagccuuaacggaaagaucccccugcagcucggcaauuguaacguggccggguggauucugggaaauccuaaaugcgaucugcuccugaccgccaacuccuggucuuauaucauugaaacaagcaauuccaagaacggcgcuuguuacccgggggaguuugccgacuaugaagaacuuaaggagcaacugucuaccguuagcuccuucgaaagauuugagaucuuccccaaagcuacgagcuggccuaaucaugauaccacacggggaaccacaguggccugcucucacuccggcgcgaacagcuuuuaccgcaaucuccuguggaucgucaagaaaggcaacucuuaucccaaacuuuccaaaagcuacaccaacaauaaggggaaggaagugcugguuauuuggggagugcaucacccucccacggacucugaucagcagacacucuaucagaacaaucacaccuacgucuccgugggcagcuccaaauacuauaagagacugacaccugagaucguggcccggccgaaaguccgcgagcaagcugggagaaugaacuacuauuggacccugcucgaccagggagauaccauuacauucgaagccacgggcaaucugaucgcucccuggcaugccuuugcgcuuaagaaagggucuagcuccggaauuaugcggagcgacgcccagguucacaacuguaccacaaagugccagaccccucauggcgcucugaaaggcaaucuccccuuccaaaacgugcacccugugacaaucggggagugucccaaguacgucaagucuacccagcugcgcauggccacgggacuuagaaauauuccguccauccagagccggggccuguuuggggcuaucgccggauucauugaaggcggguggacaggaaugguggauggcugguauggcuaccaccaucgcaacgagcaggggucuggauaugccgcugaccaaaagagcacccagaucgcgauugauggcaucuccaauaagguuaacucugugauugagaaaaugaauauccaguuuaccagcgucgggaaggaguucaacucccucgagaaaagaauggaaaaucugaacaagaagguggacgacggauuccuggauguuuggacauacaacgccgagcuccugauccuucuggaaaaugagcggacccucgacuuucacgaucugaacgugaaaaaucuuuacgaaaaggucaaaagccaacugcgcaacaaugcuaaggagauuggcaacgggugcuucgaguuuuaucauaaaugugacaaugaaugcauggagucugugaagaacggcacauacaauuauccuaaguacuccgaagagagcaaacucaacagagaagagaucgauggagucaagcuggagucuaugggcauucaccagauccuggccauuuauuccacgguggccagcucccucguucugcuugugucucugggggcuaucagcuucuggaugugcuccaauggaucucuccagugucgggucugcaucuga

SEQ ID NO: 189410 - RNA, 1698 nt, Artificial Sequence; identical to SEQ ID NO: 186155
  derived and/or modified sequence opt5 from hemagglutinin__InfluenzaA__ADW09101

SEQ ID NO: 189411 - RNA, 1698 nt, Artificial Sequence
  derived and/or modified sequence opt5 from hemagglutinin__InfluenzaA__ADW09111
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucguggaccagaaaacccuguacagaacagagaaugccuacgucagcguuguguccucucauuauagccggaaguucacccccgaaauugcuaagcgcccuaaagugagagaucaggagggccggaucaacuacuauuggacgcuucuggagcccggggacacaauuaucuuugaagccaauggaaaccucauugcgccucgcuacgccuucgcucuguccagaggcuuugggagcggaaucauuaauucuaacgcccccauggauaagugugacgcuaaaugccagaccccgcggggcgccaucaauuccagccuuccuuuccaaaacguccaccccgugacaaucggcgaguguccuaaguauguucgcucugcgaaacugagaauggugaccgggcuccggaauauucccagcauccagucccgcggacuguuuggcgccauugcuggguucaucgaaggaggcuggaccgggauggucgauggaugguacggcuaucaucaccagaacgaccagggcucuggguacgccgcugaucaaaagagcacacagaaugccauuaacggaaucacgaauaaagugaacuccguuaucgagaagaugaauacccaguuuacagccgugggcaaggaguucaacaaacuggaaagacggauggagaaccucaauaagaaagucgacgauggguucauugacaucuggaccuacaacgcugaacugcuugugcugcucgagaaugaacgcacacuggacuuucacgauagcaacgucaagaaucuuuaugagaaagugaagucucagcugaagaacaaugcgaaagaaauuggaaacggcugcuucgaguuuuaccauaaguguaaugacgagugcauggaauccguuaaaaacgggaccuaugauuaccccaaguauagcgaggaaucuaaacucaauagagagaagaucgacggcgugaagcuggaguccaugggagucuaccaaauucuggccaucuauagcacgguggcuuccucucucguucugcuugugagccugggcgccaucuccuucuggaugugcucuaacgggagccuccagugucggauuugcaucuga

SEQ ID NO: 189412 - RNA, 1698 nt, Artificial Sequence
  derived and/or modified sequence opt5 from hemagglutinin__InfluenzaA__ADW09120
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacagugaaaaauggccucuaccccaaccugucuaaguccuaugcuaauaacaaagagaaggaaguccuggugcucuggggagugcaccacccuccgaacaucgucgaccagaaaacccuguaccauacagagaaugccuacguuagcgugguguccucucacuauagcagaaaguucacccccgaaauugcuaagcggccuaaaguccgcgaucaggaggggagaaucaacuacuauuggacgcuucuggagcccggcgacacaauuaucuuugaagccaaugggaaccucauugcgccucgguacgccuucgcucuguccaagggauuuggcagcgggaucauuaauucuaacgcccccauggauaaaugugacgcuaagugccagaccccgcgcggagccaucaauuccagccuuccuuuccaaaacgugcaucccguuacaaucggcgaguguccuaaauaugugagaucugcgaagcugcggauggucaccggccuccgcaauauucccagcauccaguccagagggcuguuuggagccauugcuggcuucaucgaagggggauggaccggcaugguggaugggugguacggauaucaccaccagaacgagcagggcucuggcuacgccgcugaccagaaaagcacacaaaaugccauuaacgggaucacgaauaagguuaacuccgugaucgaaaagaugaauacccaguuuacagccgucggaaaagaguucaacaagcuggagcggcgcauggaaaaccucaauaaaaagguggaugacggcuucauugauaucuggaccuacaacgcugagcugcuuguccugcucgaaaaugagagaacacuggacuuucaugacagcaacgugaaaaaucuuuaugaaaagguuaagucucagcugaaaaacaaugcgaaggagauugggaacggaugcuucgaguuuuaccacaaauguaaugaugaaugcauggaguccgugaagaacggcaccuaugacuaccccaaauauagcgaagagucuaagcucaaucgggagaagaucgauggggucaaacuggaauccaugggcguguaccaaauucuggccaucuauagcacgguugcuuccucucucgugcugcuugucagccugggagccaucuccuucuggaugugcucuaacggcagccuccagugucgcauuugcaucuga

SEQ ID NO: 189413 - RNA, 1698 nt, Artificial Sequence; identical to SEQ ID NO: 186640
  derived and/or modified sequence opt5 from hemagglutinin__InfluenzaA__ADW09131

SEQ ID NO: 189414 - RNA, 1698 nt, Artificial Sequence
  derived and/or modified sequence opt5 from hemagglutinin__InfluenzaA__ADW09153
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacagugaaaaauggccucuaccccaaccugucuaaguccuaugcuaauaacaaagagaaggaaguccuggugcucuggggagugcaccacccuccgaacaucgucgaccagaaaacccuguacagaacagagaaugccuacguuagcgugguguccucucauuauagccggaaguucacccccgaaauugcuaagcgcccuaaagucagagaucaggaggggcggaucaacuacuauuggacgcuucuggagcccggcgacacaauuaucuuugaagccaaugggaaccucauugcgccucgcuacgccuucgcucuguccagaggauuuggcagcgggaucauuaauucuaacgcccccauggauaagugugacgcuaaaugccagaccccgcggggagccaucaauuccagccuuccuuuccaaaacgugcaccccguuacaaucggcgaguguccuaaguaugugcgcucugcgaaacugagaauggucaccggccuccggaauauucccagcauccagucccgcgggcuguuuggagccauugcuggcuucaucgaagggggauggaccggcaugguggaugggugguacggauaucaucaccagaacgagcagggcucuggcuacgccgcugaccaaaagagcacacaggaugccauuaaugggaucacgaacaaaguuaauuccgugaucgaaaagaugaacacccaguuuacagccgucggaaaggaguucaauaaacuggagagacggauggaaaaccucaacaagaaaguggacgauggcuucauugacaucuggaccuacaaugcugagcugcuuguccugcucgaaaacgagcgcacacuggacuuucacgauagcaaugugaagaaccuuuaugaaaaaguuaagucucagcugaagaauaacgcgaaagagauugggaauggaugcuucgaguuuuaccauaaguguaacgacgaaugcauggaguccgugaaaaauggcaccuaugauuaccccaaguauagcgaagagucuaaacucaacagagagaagaucgacggggucaagcuggaauccaugggcguguaccaaauucuggccaucuauagcacgguugcuuccucucucgugcugcuugucagccugggagccaucuccuucuggaugugcucuaauggcagccuccagugucggauuugcaucuga

SEQ ID NO: 189415 - RNA, 1698 nt, Artificial Sequence; identical to SEQ ID NO: 186640
  derived and/or modified sequence opt5 from hemagglutinin__InfluenzaA__ADW09164

SEQ ID NO: 189416 - RNA, 1698 nt, Artificial Sequence
  derived and/or modified sequence opt5 from hemagglutinin__InfluenzaA__ADW09186
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucguggaccagaaaacccuguacagaacagagaaugccuacgucagcguuguguccucucauuauagccggaaguucacccccgaaauugcuaagcgcccuaaagugagagaucaggagggccggaucaacuacuauuggacgcuucuggagcccggggacacaauuaucuuugaagccaauggaaaccucauugcgccucgcuacgccuucgcucuguccagaggcuuugggagcggaaucauuaauucuaacgcccccauggauaagugugacgcuaaaugccagaccccgcaaggcgccaucaauuccagccuuccuuuccagaacguccaccccgugacaaucggcgaguguccuaaguauguucggucugcgaaacugcgcauggugaccgggcucagaaauacccccagcauucagucccggggacuguuuggcgccaucgcuggguucauugaaggaggcuggacagggauggucgauggaugguacggcuaucaucaccagaacgagcaaggcucuggguacgccgcugaccaaaagagcacgcagaaugccaucaacggaauuaccaauaaagugaacuccguuaucgaaaagaugaauacacaguuuaccgccgugggcaaggaguucaacaaacuggagcgcagaauggaaaaccucaauaagaaagucgaugacggguucaucgauauuuggacauacaacgcugagcugcuugugcugcucgaaaaugagcggacccuggacuuucacgacagcaacgucaagaaucuuuaugaaaaagugaagucucagcugaagaacaaugcgaaagagaucggaaacggcugcuucgaguuuuaccauaaguguaaugaugaaugcauggaguccguuaaaaacgggacguaugacuaccccaaguauagcgaagagucuaaacucaaucgcgagaagauugauggcgugaagcuggaauccaugggagucuaccagauccuggccauuuauagcacaguggcuuccucucucguucugcuugugagccugggcgccaucuccuucuggaugugcucuaacgggagccuccaguguagaaucugcauuuga

SEQ ID NO: 189417 - RNA, 1698 nt, Artificial Sequence; identical to SEQ ID NO: 186155
  derived and/or modified sequence opt5 from hemagglutinin__InfluenzaA__ADW09197

SEQ ID NO: 189418 - RNA, 1698 nt, Artificial Sequence; identical to SEQ ID NO: 186640
  derived and/or modified sequence opt5 from hemagglutinin__InfluenzaA__ADW09208

SEQ ID NO: 189419 - RNA, 1698 nt, Artificial Sequence; identical to SEQ ID NO: 186640
  derived and/or modified sequence opt5 from hemagglutinin__InfluenzaA__ADW09219

SEQ ID NO: 189420 - RNA, 1698 nt, Artificial Sequence; identical to SEQ ID NO: 186155
  derived and/or modified sequence opt5 from hemagglutinin__InfluenzaA__ADW09230

SEQ ID NO: 189421 - RNA, 1698 nt, Artificial Sequence
  derived and/or modified sequence opt5 from hemagglutinin__InfluenzaA__ADW09241
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaaaugagagagcaacuguccucugucagcuccuucgaacgguuugagaucuuccccaaggagagcucuuggccuaaccacacggugaccggaguuuccgccagcugcucucauaauggcgaauccagcuuuuaucgcaaccuccuguggcuuacagugaaaaauggccuguaccccaaccucucuaaguccuaugcuaauaacaaagagaaggaaguccuggugcuguggggagugcaccacccuccgaacaucgucgaccagaaaacccucuacagaacagagaaugccuacguuagcgugguguccucucauuauagccggaaguucacccccgaaauugcuaagcgcccuaaagucagagaucaggaggggcggaucaacuacuauuggacgcugcuugagcccggcgacacaauuaucuuugaagccaaugggaaccugauugcgccucgcuacgccuucgcucucuccagaggauuuggcagcgggaucauuaauucuaacgcccccauggauaagugugacgcuaaaugccagaccccgcggggagccaucaauuccagccugccuuuccaaaacgugcaccccguuacaaucggcgaguguccuaaguaugugcgcucugcgaaacuuagaauggucaccggccugcggaauauucccagcauccagucccgcgggcucuuuggagccauugcuggcuucaucgaagggggauggaccggcaugguggaugggugguacggauaucaucaccagaacgagcagggcucuggcuacgccgcugaccaaaagagcacacagaaugccauuaacgggaucacgaauaaaguuaacuccgugaucgaaaagaugaauacccaguuuacagccgucggaaaggaguucaacaaacuggagagacggauggaaaaccugaauaagaaaguggaugacggcuucauugauaucuggaccuacaacgcugagcuccugguccuucuggaaaaugagcgcacacucgacuuucacgacagcaacgugaagaaucuguaugaaaaaguuaagucucagcuuaagaacaaugcgaaagagauugggaacggaugcuucgaguuuuaccauaaguguaaugaugaaugcauggaguccgugaaaaacggcaccuaugacuaccccaaguauagcgaagagucuaaacugaauagagagaagaucgauggggucaagcucgaauccaugggcguguaccaaauucuggccaucuauagcacgguugcuuccucucuggugcuccuggucagccuuggagccaucuccuucuggaugugcucuaacggcagccugcagugucggauuugcaucuga

SEQ ID NO: 189422 - RNA, 1698 nt, Artificial Sequence; identical to SEQ ID NO: 186640
  derived and/or modified sequence opt5 from hemagglutinin__InfluenzaA__ADW09252

SEQ ID NO: 189423 - RNA, 1698 nt, Artificial Sequence
  derived and/or modified sequence opt5 from hemagglutinin__InfluenzaA__ADW09274
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacagugaaaaauggccucuaccccaaccugucuaagccuuaugcuaauaacaaagagaaggaaguccuggugcucuggggagugcaccacccgcccaacaucgucgaccagaaaacccuguacagaacagagaaugccuacguuuccguggugagcucccauuauucucggaaguucaccccugaaauugcuaagcgccccaaagucagagaucaggaggggcggaucaacuacuauuggacgcuucuggagccuggcgacacaauuaucuuugaagccaaugggaaccucauugcgccccgcuacgccuucgcucugagcagaggauuuggcuccgggaucauuaauagcaacgccccgauggauaagugugacgcuaaaugccagaccccucggggagccaucaauucuucccuucccuuccaaaacgugcacccuguuacaaucggcgagugucccaaguaugugcgcagcgcgaaacugagaauggucaccggccuccggaauauucccucuauccagagccgcgggcuguuuggagccauugcuggcuucaucgaagggggauggaccggcaugguggaugggugguacggauaucaucaccagaacgagcagggcuccggcuacgccgcugaccaaaagucuacacagaaugccauuaacgggaucacgaauaaaguuaacagcgugaucgaaaagaugaauacccaguuuacagccgucggaaaggaguucaacaaacuggagagacggauggaaaaccucaauaagaaaguggaugacggcuucauugauaucuggaccuacaacgcugagcugcuuguccugcucgaaaaugagcgcacacuggacuuucacgacuccaacgugaagaaucuuuaugaaaaaguuaagagccagcugaagaacaaugcgaaagagauugggaacggaugcuucgaguuuuaccauaaguguaaugaugaaugcauggagucugugaaaaacggcaccuaugacuacccuaaguauuccgaagagagcaaacucaauagagagaagaucgauggggucaagcuggaaucuaugggcguguaccaaauucuggccaucuauuccacgguugcuagcucccucgugcugcuugucucucugggagccaucagcuucuggaugugcuccaacggcucucuccagugucggauuugcaucuga

SEQ ID NO: 189424 - RNA, 1698 nt, Artificial Sequence
  derived and/or modified sequence opt5 from hemagglutinin__InfluenzaA__ADW09285
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucguggaccagaaaacccuguacagaacagagaaugccuacgucagcguuguguccucucauuauagccggaaguucacccccgaaauugcuaagcgcccuaaagugagagaucaggagggccggaucaacuacuauuggacgcuucuggagcccggggacacaauuaccuuugaagccaauggaaaccucaucgcgccucgcuacgccuucgcucuguccagaggcuuugggagcggaauuaucaauucuaacgcccccauggauaagugugacgcuaaaugccagacaccgcaaggcgccauuaauuccagccuuccuuuccagaacguccaccccgugaccaucggcgaguguccuaaguauguucggucugcgaaacugcgcauggugaccgggcucagaaauauccccagcauucagucccggggacuguuuggcgccaucgcuggguucauugaaggaggcuggacagggauggucgauggaugguacggcuaucaucaccagaacgagcaaggcucuggguacgccgcugaccaaaagagcacgcagaaugccaucaacggaauuaccaauaaagugaacuccguuaucgaaaagaugaauacacaguuuaccgccgugggcaaggaguucaacaaacuggagcgcagaauggaaaaccucaauaagaaagucgaugacggguucaucgauauuuggacauacaacgcugagcugcuugugcugcucgaaaaugagcggacccuggacuuucacgacagcaacgucaagaaucuuuaugaaaaagugaagucucagcugaagaacaaugcgaaagagaucggaaacggcugcuucgaguuuuaccauaaguguaaugaugaaugcauggaguccguuaaaaacgggacguaugacuaccccaaguauagcgaagagucuaaacucaaucgcgagaagauugauggcgugaagcuggaauccaugggagucuaccagauccuggccauuuauagcacaguggcuuccucucucguucugcuugugagccugggcgccaucuccuucuggaugugcucuaacgggagccuccaguguagaaucugcauuuga

SEQ ID NO: 189425 - RNA, 1698 nt, Artificial Sequence; identical to SEQ ID NO: 186640
  derived and/or modified sequence opt5 from hemagglutinin__InfluenzaA__ADW09296

SEQ ID NO: 189426 - RNA, 1698 nt, Artificial Sequence; identical to SEQ ID NO: 186155
  derived and/or modified sequence opt5 from hemagglutinin__InfluenzaA__ADW09307

SEQ ID NO: 189427 - RNA, 1698 nt, Artificial Sequence
  derived and/or modified sequence opt5 from hemagglutinin__InfluenzaA__ADW09327
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucguggaccagaaaacccuguacagaacagagaaugccuacgucagcguuguguccucucauuauagccggaaguucacccccgaaauugcuaagcgcccuaaagugagagaucaggagggccggaucaacuacuauuggacgcuucuggagcccggggacacaauuaucuuugaagccaauggaaaccucauugcgccucgcuacgccuucgcucuguccagaggcuuugggagcggaaucauuaauucuaacgcccccauggauaagugugacgcuaaaugccagaccccgcaaggcgccaucaauuccagccuuccuuuccagaacguccaccccgugacaaucggcgaguguccuaaguauguucggucugcgaaacugcgcauggugaccgggcucagaaauauucccagcauccagucccggggacuguuuggcgccauugcuggguucaucgaaggaggcuggaccgggauggucgauggaugguacggcuaucaucaccagaacgagcaaggcucuggguacgccgcugaccaaaagagcacacagaaugccauuaacggaaucacgaauaaagugaacuccguuaucgaaaagaugaauacccaguuuacagccgugggcaaggaguucaacaaacuggagcgcagaauggaaaaccucaauaagaaagucgaugacggguucauugauaucuggaccuacaacgcugagcugcuugugcugcucgaaaaugagcggacacuggacuuucacgacagcaacgucaagaaucuuuaugaaaaagugaagucucagcugaagaacaaugcgaaagagauuggaaacggcugcuucgaguuuuaccauaaguguaauaacgaaugcauggaguccguuaaaaaugggaccuaugauuaccccaaguauagcgaagagucuaaacucaaccgcgagaagaucgacggcgugaagcuggaauccaugggagucuaccagauucuggccaucuauagcacgguggcuuccucucucguucugcuugugagccugggcgccaucuccuucuggaugugcucuaaugggagccuccaguguagaauuugcaucuga

SEQ ID NO: 189428 - RNA, 1698 nt, Artificial Sequence; identical to SEQ ID NO: 186640
  derived and/or modified sequence opt5 from hemagglutinin__InfluenzaA__ADW10483

SEQ ID NO: 189429 - RNA, 1698 nt, Artificial Sequence
  derived and/or modified sequence opt5 from hemagglutinin__InfluenzaA__ADW10494
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucguggaccagaaaacccuguacagaacagagaaugccuacgucagcguuguguccucucauuauagccggaaguucacccccgaaauugcuaagcgcccuaaagugagagaucaggagggccggaucaacuacuauuggacgcuucuggagcccggggacacaauuaucuuugaagccaauggaaaccucauugcgccucgcuacgccuucgcucuguccagaggcuuugggagcggaaucauuaauucuaacgcccccauggauaagugugacgcuaaaugccagaccccgcaaggcgccaucaauuccagccuuccuuuccagaacguccaccccgugacaaucggcgaguguccuaaguauguucggucugcgaaacugcgcauggugaccgggcucagaaauauucccagcauccagucccggggacuguuuggcgccauugcuggguucaucgaaggaggcuggaccgggauggucgauggaugguacggcuaucaucaccagaacgagcaaggcucuggguacgccgcugaccaaaagagcacacagaaugccauuaacggaaucacgaauaaagugaacuccguuaucgaaaagaugaauacccaguuuacagccgugggcaaggaguucaacaaacuggagcgcagaauggaaaaccucaauaagaaagucgaugacggguucauugauaucuggaccuacaacgcugagcugcuugugcugcucgaaaaugagcggacacuggacuuucacgacagcaacgucaagaaucuuuaugaaaaagugaagaaccagcugaagaauaacgcgaaagagauuggaaauggcugcuucgaguuuuaccauaaguguaacgaugaaugcauggagucuguuaaaaaugggaccuaugacuaccccaaguauuccgaagagagcaaacucaaccgcgagaagaucgauggcgugaagcuggaaucuaugggagucuaccagauucuggccaucuauuccacgguggcuagcucccucguucugcuugugucucugggcgccaucagcuucuggaugugcuccaaugggucucuccaguguagaauuugcaucuga

SEQ ID NO: 189430 - RNA, 1698 nt, Artificial Sequence; identical to SEQ ID NO: 186640
  derived and/or modified sequence opt5 from hemagglutinin__InfluenzaA__ADW10505

SEQ ID NO: 189431 - RNA, 1698 nt, Artificial Sequence; identical to SEQ ID NO: 186640
  derived and/or modified sequence opt5 from hemagglutinin__InfluenzaA__ADW10516

SEQ ID NO: 189432 - RNA, 1698 nt, Artificial Sequence
  derived and/or modified sequence opt5 from hemagglutinin__InfluenzaA__ADW10527
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucguggaccagaaaacccuguacagaacagagaaugccuacgucagcguuguguccucucauuauagccggaaguucacccccgaaauugcuaagcgcccuaaagugagagaucaggagggccggaucaacuacuauuggacgcuucuggagcccggggacacaauuaucuuugaagccaauggaaaccucauugcgccucgcuacgccuucgcucuguccagaggcuuugggcuuggaaucauuaauagcaacgcccccauggauaagugugacgcuaaaugccagaccccgcaaggcgccaucaauucuucccugccuuuccagaacguccaccccgugacaaucggcgaguguccuaaguauguucggagcgcgaaacuccgcauggugaccgggcugagaaauauucccucuauccagagccggggacuguuuggcgccauugcuggguucaucgaaggaggcuggaccgggauggucgauggaugguacggcuaucaucaccagaacgagcaaggcuccggguacgccgcugaccagaagucuacacagaaugccauuaacggaaucacgaauaaagugaacagcguuaucgaaaagaugaauacccaguuuacagccgugggcaaggaguucaacaaacucgagcgcagaauggaaaaccugaauaagaaagucgaugacggguucauugauaucuggaccuacaacgcugagcuucuggugcuccuggaaaaugagcggacacuugacuuucacgacuccaacgucaagaaucuguaugaaaaaguuaagagccaacucaagaacaaugcgaaagagauuggaaacggcugcuucgaguuuuaccauaaguguaaugaugaaugcauggagucugugaaaaacgggaccuaugacuaccccaaguauuccgaagagagcaaacugaaucgcgagaagaucgauggcgugaagcuggaaucuaugggagucuaccagauucucgccaucuauuccacgguggcuagcucccugguucuucuggugucucucggcgccaucagcuucuggaugugcuccaacgggucucugcaguguagaauuugcaucuga

SEQ ID NO: 189433 - RNA, 1698 nt, Artificial Sequence
  derived and/or modified sequence opt5 from hemagglutinin__InfluenzaA__ADW10538
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucguggaccagaaaacccuguacagaacagagaaugccuacgucagcguuauguccucucauuauagccggaaguucacccccgaaauugcuaagcgcccuaaagugagagaucaggagggccggaucaacuacuauuggacgcuucuggagcccggggacacaauuaucuuugaagccaauggaaaccucauugcgccucgcuacgccuucgcucuguccagaggcuuugggagcggaaucauuaauucuaacgcccccauggauaagugugacgcuaaaugccagaccccgcaaggcgccaucaauuccagccuuccuuuccagaacgugcaccccgucacaaucggcgaguguccuaaguaugugcggucugcgaaacugcgcaugguuaccgggcucagaaauauucccagcauccagucccggggacuguuuggcgccauugcuggguucaucgaaggaggcuggaccgggaugguggauggaugguacggcuaucaucaccagaacgagcaaggcucuggguacgccgcugaccaaaagagcacacagaaugccauuaacggaaucacgaauaaagucaacuccgugaucgaaaagaugaauacccaguuuacagccguuggcaaggaguucaacaaacuggagcgcagaauggaaaaccucaauaagaaaguggaugacggguucauugauaucuggaccuacaacgcugagcugcuuguccugcucgaaaaugagcggacacuggacuuucacgacagcaacgugaagaaucuuuaugaaaaagucaagucucagcugaagaacaaugcgaaagagauuggaaacggcugcuucgaguuuuaccauaaguguaaugaugaaugcauggaguccgugaaaaacgggaccuaugacuaccccaaguauagcgaagagucuaaacucaaucgcgagaagaucgauggcguuaagcuggaauccaugggaguguaccagauucuggccaucuauagcacggucgcuuccucucucgugcugcuuguuagccugggcgccaucuccuucuggaugugcucuaacgggagccuccaguguagaauuugcaucuga

SEQ ID NO: 189434 - RNA, 1698 nt, Artificial Sequence; identical to SEQ ID NO: 186640
  derived and/or modified sequence opt5 from hemagglutinin__InfluenzaA__ADW10549

SEQ ID NO: 189435 - RNA, 1698 nt, Artificial Sequence
  derived and/or modified sequence opt5 from hemagglutinin__InfluenzaA__ADW10560
augaaggugaaacugcucguccugcuuugcaccuucacagccacguacgcugacaccaucuguauuggcuaucacgccaacaauagcacagauaccguugacacaguguuugagaagaacgugaccgucacacauuccgugaaucugcucgaaaacucucacaaugggaaacugugccuucugaagggaaucgcgccccuccagcugggcaacuguagcguugcuggguggauucugggaaauccugagugcgaacuccugaucuccaaagagucuuggagcuacauuguggaaaagccgaaccccgagaauggcaccuguuauccugggcauuucgccgauuacgaggaacuuagagagcaacuguccucugucagcuccuuugaacgguucgagaucuuucccaaggagagcucuuggccuaaccacacggugaccggaguuuccgccagcugcucucauaauggcgaacgcuccuucuauagaaaccuccuguggcuuacaggcaaaaaugggcuguaccccaaccucagcaagucuuaugcuaauaacaaagagaaggaagugcugguccuguggggagugcaccacccuccggacaucggcgaucagaaaacccucuaccauacagagaacgccuacguguccgucguuagcucccacuauucucggaaguuuacccccgaaauugcuaagcgcccuaaagugagagaccaggaggggcggaucaauuacuauuggacgcugcuugagcccggagauacaauuaucuucgaagccaacggcaaucugauugcgccucgcuacgccuuugcucucagcagaggguucggauccggcaucauuaacagcaaugcccccauggacaagugugaugcuaaaugccagaccccgcaaggcgccaucaacucuucccugccuuuucagaaugugcaucccgucacaaucggggaguguccuaaguaugugcggagcgcgaaacuucgcaugguuaccggacugagaaacauucccucuauccagagccggggccucuucggggccauugcuggauuuaucgaaggcggguggaccggaaugguggacggcugguacggcuaucaccaccagaaugagcaaggguccggauacgccgcugaucagaagucuacacagaacgccauuaauggcaucacgaacaaagucaauagcgugaucgaaaagaugaacacccaguucacagccguugggaaggaguucaauaaacuggagcgcagaauggaaaaccugaacaagaaaguggacgauggauuuauugacaucuggaccuacaaugcugagcuccugguccuucuggaaaacgagcggacacucgacuuccaugauuccaaugugaagaaccuguaugaaaaagucaagagccaacuuaagaauaacgcgaaagagauuggcaaugggugcuuugaguucuaccacaaguguaacgacgaaugcauggagucugugaaaaauggcaccuaugauuaccccaaguauuccgaagagagcaaacugaaccgcgagaagaucgacggaguuaagcucgaaucuaugggcguguaccagauucuggccaucuauuccacggucgcuagcucccuggugcuccugguuucucuuggggccaucagcuuuuggaugugcuccaauggaucucugcaguguagaauuugcaucuga

SEQ ID NO: 189436 - RNA, 1698 nt, Artificial Sequence; identical to SEQ ID NO: 188977
  derived and/or modified sequence opt5 from hemagglutinin__InfluenzaA__ADW10571

SEQ ID NO: 189437 - RNA, 1698 nt, Artificial Sequence; identical to SEQ ID NO: 186155
  derived and/or modified sequence opt5 from hemagglutinin__InfluenzaA__ADW10582

SEQ ID NO: 189438 - RNA, 1698 nt, Artificial Sequence; identical to SEQ ID NO: 186640
  derived and/or modified sequence opt5 from hemagglutinin__InfluenzaA__ADW10593

SEQ ID NO: 189439 - RNA, 1698 nt, Artificial Sequence; identical to SEQ ID NO: 186640
  derived and/or modified sequence opt5 from hemagglutinin__InfluenzaA__ADW10604

SEQ ID NO: 189440 - RNA, 1698 nt, Artificial Sequence; identical to SEQ ID NO: 186640
  derived and/or modified sequence opt5 from hemagglutinin__InfluenzaA__ADW10615

SEQ ID NO: 189441 - RNA, 1698 nt, Artificial Sequence
  derived and/or modified sequence opt5 from hemagglutinin__InfluenzaA__ADW10626
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacagugaaaaauggccucuaccccaaccugucuaaguccuaugcuaauaacaaagagaaggaaguccuggugcucuggggagugcaccacccuccgagcaucgucgaccagaaaacccuguacagaacagagaacgccuacguuuccguggugucuagccauuauucccggaaguucacccccgaaauugcuaagcgcccuaaagucagagaucaggaggggcggaucaauuacuauuggacgcuucuggagcccggcgacacaauuaucuuugaagccaacgggaaucucauugcgccucgcuacgccuucgcucugagcagaggauuuggcucugggaucauuaacuccaaugcccccauggauaagugugacgcuaaaugccagaccccgcggggagccaucaacagcucucuuccuuuccaaaaugugcaccccguuacaaucggcgaguguccuaaguaugugcgcagcgcgaaacugagaauggucaccggccuccggaacauucccuccauccagucucgcgggcuguuuggagccauugcuggcuucaucgaagggggauggaccggcaugguggaugggugguacggauaucaucaccagaaugagcagggcagcggcuacgccgcugaccaaaaguccacacagaacgccauuaaugggaucacgaacaaaguuaauagcgugaucgaaaagaugaacacccaguuuacagccgucggaaaggaguucaauaaacuggagagacggauggaaaaccucaacaagaaaguggaugacggcuucauugauaucuggaccuacaaugcugagcugcuuguccugcucgaaaacgagcgcacacuggacuuucacgacucuaaugugaagaaccuuuaugaaaaaguuaagucccagcugaagaauaacgcgaaagagauugggaauggaugcuucgaguuuuaccauaaguguaacgaugaaugcauggagagcgugaaaaauggcaccuaugacuaccccaaguauucugaagaguccaaacucaacagagagaagaucgauggggucaagcuggaaagcaugggcguguaccaaauucuggccaucuauuccacgguugcuucuagccucgugcugcuugucucccugggagccaucucuuucuggaugugcagcaauggcucccuccagugucggauuugcaucuga

SEQ ID NO: 189442 - RNA, 1698 nt, Artificial Sequence
  derived and/or modified sequence opt5 from hemagglutinin__InfluenzaA__ADW10721
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucaagcgguuugaaaucuuccccaaagagagcucuuggccuaaccacacggugaccggaguuuccgccagcugcucucauaauggcgaguccagcuuuuaucgcaaccugcuuuggcugacagugaagaauggccucuaccccaaccugucuaaauccuaugcuaauaacaaggaaaaagagguccuggugcucuggggagugcaccacccuccgaacaucgucgaccagagaacccuguaccauacagaaaaugccuacguuagcgugguguccucucacuauagccggaaguucacccccgagauugcuaagcgcccuaaagucagaaaccaggaagggcggaucaauuacuauuggacgcuucuggagcccggcgauacaauuaucuuugaggccaacgggaaucucauugcgccucgcuacgccuucgcucuguccagaggauuuggcagcgggaucauuaacucuaaugcccccauggacaagugugaugcuaaaugccagaccccgcggggagccaucaacuccagccuuccuuuccaaaaugugcaucccguuacaaucggcgaauguccuaaguaugugcgcucugcgaaacugagaauggucaccggccuccggaacauucccagcauccagucccgcgggcuguuuggagccauugcuggcuucaucgaagggggauggaccggcaugguggacgggugguacggauaucaccaccagaaugaacagggcucuggcuacgccgcugaucaaaagagcacacagaacgccauuaaugggaucacgaacaaaguuaauuccgugaucgagaagaugaacacccaguuuacagccgucggaaaggaguucaacaaacuggagagacggauggagaaucucaacaagaaaguggacgauggcuucauugacaucuggaccuacaaugcugaacugcuuguccugcucgagaacgaacgcacacuggauuuucaugacagcaaugugaagaaccuuuaugagaaaguuaagucucagcugaagaauaacgcgaaagaaauugggaauggaugcuucgaguuuuaccacaaguguaacgacgagugcauggaauccgugaaaaauggcaccuaugauuaccccaaguauagcgaggaaucuaaacucaacagagagaagaucgacggggucaagcuggaguccaugggcguguaccaaauucuggccaucuauagcacgguugcuuccucucucgugcugcuugucagccugggagccaucuccuucuggaugugcucuaauggcagccuccagugucggauuugcaucuga

SEQ ID NO: 189443 - RNA, 1698 nt, Artificial Sequence
  derived and/or modified sequence opt5 from hemagglutinin__InfluenzaA__ADW10743
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacagugaaaaauggccucuaccccaaccugucuaaguccuaugcuaauaacaaagagaaggaaguccuggugcucuggggagugcaccacccuccgaacaucgucgaccagaaaacccuguacagaacagagaauaccuacguuagcgugguguccucucauuauagccggaaguucacgcccgaaauugccaagcgcccuaaaaucagagaucaggaggggcggauuaacuacuauuggacacuucuggagcccggcgacaccaucauuuuugaagcuaaugggaaccucaucgccccucgcuacgcguucgcccuguccagaggauuuggcagcgggauuaucaauucuaacgcucccauggauaagugugacgccaaaugccagacaccgcggggagcuaucaauuccagccuuccuuuccaaaacguccaccccgugaccauuggcgaguguccuaaguauguucgcucugugaaacugagaauggucaccggccuccggaauauccccagcauucagucccgcgggcuguuuggagccaucgcgggcuucauugaagggggauggacaggcaugguggaugggugguacggauaucaucaccagaacgagcagggcucuggcuacgccgcugaccaaaagagcacgcagaaugccaucaacgggaucaccaauaaaguuaacuccgugauugaaaagaugaauacacaguuuaccgcugucggaaaggaguucaacaaacuggagagacggauggaaaaccucaauaagaaaguggaugacggcuucaucgauauuuggacauacaacgccgagcugcuuguccugcucgaaaaugagcgcacccuggacuuucacgacagcaacgugaagaaucuuuaugaaaaaguuaagucucagcugaagaacaaugccaaagagaucgggaacggaugcuucgaguuuuaccauaaguguaaugaugaaugcauggaguccgugaaaaacggcacguaugacuaccccaaguauagcgaagagucuaaacucaauagagagaagauugauggggucaagcuggaauccaugggcguguaccaaauccuggcuaucuauagcacaguugcguccucucucgugcugcuugucagccugggagccauuuccuucuggaugugcucuaacggcagccuccagugucggaucugcauuuga

SEQ ID NO: 189444 - RNA, 1698 nt, Artificial Sequence
  derived and/or modified sequence opt5 from hemagglutinin__InfluenzaA__ADW10754
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaaaacuccuuuuaucgcaaucugcuuuggcugacaggcaaaaacgggcucuaccccaaucugagcaagucuuaugcuaacaacaaagagaaggaagugcugguccucuggggagugcaccacccuccgaauaucgccgaccagaaaacccuguaccauacagagaacgcuuacguguccgucguuagcucccacuauucuagaaaguucacccccgaaauugccaagcggccuaaagugcgcgaucaggagggcagaaucaauuacuauuggacgcuucuggagcccggggacacaauuaucuuugaagcgaacggaaaucucauugccccucgguacgcuuucgcccugagccgcggcuuuggguccggaaucauuaacagcaaugcucccauggauaagugugacgccaaaugccagaccccgcaaggcgcgaucaacucuucccuuccuuuccagaaugugcaucccgucacaaucggcgaguguccuaaguaugugagaagcgccaaacugcggaugguuaccgggcuccgcaacauucccucugugcagagcagaggacuguuuggcgcuaucgccggguucauugaaggaggcuggaccgggauggucgauggaugguacggcuaucaccaccagaaugagcaaggcuccggguacgcugccgaccagaagucuacacagaacgccaucaauggaauuacgaacaaagugaauagcguuaucgaaaagaugaacacccaguuuacagcugugggcaaggaguucaacaaacuggagcggcgcauggaaaaucucaacaagaaagucgaugacggguucaucgauauuuggaccuacaaugcggagcugcuugugcugcucgaaaacgagagaacacuggacuuucaugacuccaaugucaagaaccuuuaugaaaaaguuaagagccaacugaagaauaacgccaaagagaucggaaauggcugcuucgaguuuuaccacaaguguaacgaugaaugcauggagucugugaaaaaugggaccuaugacuaccccaaguauuccgaagagagcaaacucaaccgggagaagauugauggcgugaagcuggaaucuaugggagucuaccagauccuggcuauuuauuccacgguggccagcucccucguucugcuugugucucugggcgccaucagcuucuggaugugcuccaaugggucucuccagugucgcaucugcauuuga

SEQ ID NO: 189445 - RNA, 1698 nt, Artificial Sequence
  derived and/or modified sequence opt5 from hemagglutinin__InfluenzaA__ADW10765
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacagugaaaaauggccucuaccccaaccugucuaaguccuaugcuaauaacaaagagaaggaaguccuggugcucuggggagugcaccacccuccgaacaucgucgaccagaaaacccuguaccauacagagaaugccuacguuagcgugguguccucucacuauagcagaaaguucacccccgaaauugcuaagcggccuaaaguccgcaaccaggaggggagaaucaauuacuauuggacgcuucuggagcccggcgauacaauuaucuuugaagccaacgggaaucucauugcgccucgguacgccuucgcucugucccgcggauuuggcagcgggaucauuaacucuaaugcccccauggacaagugugaugcuaaaugccagaccccgagaggagccaucaacuccagccuuccuuuccaaaaugugcaucccguuacaaucggcgaguguccuaaguaugugcggucugcgaaacugcgcauggucaccggccucagaaacauucccagcauccagucccgggggcuguuuggagccauugcuggcuucaucgaagggggauggaccggcaugguggacgggugguacggauaucaccaccagaaugagcagggcucuggcuacgccgcugaucaaaagagcacacagaacgccauuaaugggaucacgaacaaaguuaauuccgugaucgaaaagaugaacacccaguuuacagccgucggaaaggaguucaacaaacuggagcgcagaauggaaaaucucaacaagaaaguggacgauggcuucauugacaucuggaccuacaaugcugagcugcuuguccugcucgaaaacgagcggacacuggauuuucaugacagcaaugugaagaaccuuuaugaaaaaguuaagucucagcugaagaauaacgcgaaagagauugggaauggaugcuucgaguuuuaccacaaguguaacgacgaaugcauggaguccgugaaaaauggcaccuaugauuaccccaaguauagcgaagagucuaaacucaaccgcgagaagaucgacggggucaagcuggaauccaugggcguguaccaaauucuggccaucuauagcacgguugcuuccucucucgugcugcuugucagccugggagccaucuccuucuggaugugcucuaauggcagccuccaguguagaauuugcaucuga

SEQ ID NO: 189446 - RNA, 1698 nt, Artificial Sequence
  derived and/or modified sequence opt5 from hemagglutinin__InfluenzaA__ADW10776
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaaugacaaagagaaggaagugcugguccucuggggagugcaccacccuccgaacaucguggaucagaaaacccuguacagaacagagaacgccuacgucagcguuguguccucucauuauagccggaaguucacccccgaaauugcuaagcgcccuaaagugagagaccaggagggccggaucaauuacuauuggacgcuucuggagcccggggauacaauuaucuuugaagccaacggaaaucucauugcgccucgcuacgccuucgcucuguccagaggcuuugggagcggaaucauuaacucuaaugcccccauggacaagugugaugcuaaaugccagaccccgcaaggcgccaucaacuccagccuuccuuuccagaauguccaccccgugacaaucggcgaguguccuaaguauguucggucugcgaaacugcgcauggugaccgggcucagaaacauucccagcauccagucccggggacuguuuggcgccauugcuggguucaucgaaggaggcuggaccgggauggucgacggaugguacggcuaucaucaccagaaugagcaaggcucuggguacgccgcugaucagaaguccacacagaacgccauuaauggaaucacgaacaaagugaauagcguuaucgaaaagaugaacacccaguuuacagccgugggcaaggaguucaauaaacuggagcgcagaauggaaaaccucaacaagaaagucgacgauggguucauugacaucuggaccuacaaugcugagcugcuugugcugcucgaaaacgagcggacacuggacuuucacgauagcaaugucaagaaccuuuaugaaaaagugaagucucaacugaagaauaacgcgaaagagauuggaaauggcugcuucgaguuuuaccauaaguguaacgacgaaugcauggaguccguuaaaaaugggaccuaugauuaccccaaguauagcgaagagucuaaacucaaccgcgagaagaucgacggcgugaagcuggaauccaugggagucuaccagauucuggccaucuauagcacgguggcuuccucucucguucugcuugugagccugggcgccaucuccuucuggaugugcucuaaugggagccuccaguguagaauuugcaucuga

SEQ ID NO: 189447 - RNA, 1698 nt, Artificial Sequence
  derived and/or modified sequence opt5 from hemagglutinin__InfluenzaA__ADW10787
augaaggugaaaauccugguccuccugugcaccuucacagccacguacgcugacaccauuuguaucggcuaucacgccaacaauagcacagauaccguugacacagugcuugagaagaacgugaccgucacacauuccgugaaucugcucgaaaacucucacaaugggaaacugugccuucugaagggaauugcgccccuccagcugggcaacuguagcguugcuggguggauccugggaaauccugagugcgaacuccugauuuccaaagagucuuggagcuacaucguggaaaagccgaaccccgagaauggcaccuguuauccugggcauuuugccgauuacgaggaacuuagagagcaacuguccucugucagcuccuucgaacgguuugagaucuuccccaaggagagcucuuggccuaaccacacggugaccggaguuuccgccagcugcucucauaauggcgaauccagcuuuuaucgcaaccuccuguggcuuacagugaaaaauggccuguaccccaaccucucuaaguccuaugcuaauaacaaagagaaggaaguccuggugcuguggggagugcaccacccuccgaacauugucgaccagaaaacccucuacagaacagagaaugccuacguuagcgugguguccucucauuauagccggaaguucacccccgaaaucgcuaagcgcccuaaagucagagaucaggaggggcggauuaacuacuauuggacgcugcuugagcccggcgacacaaucauuuuugaagccaaugggaaccugaucgcgccucgcuacgccuucgcucucuccagaggauuuggcagcgggauuaucaauucuaacgcccccauggauaagugugacgcuaaaugccagaccccgcggggagccaucaauuccagccugccuuuccaaaacgugcaccccguuacaauuggcgaguguccuaaguaugugcgcucugcgaaacuuagaauggucaccggccugcggaauauccccagcauucagucccgcgggcucuuuggagccaucgcuggcuucauugaagggggauggaccggcaugguggaugggugguacggauaucaucaccagaacgagcagggcucuggcuacgccgcugaccaaaagagcacacagaaugccaucaacgggaucacgaauaaaguuaacuccgugauugaaaagaugaauacccaguuuacagccgucggaaaggaguucaacaaacuggagagacggauggaaaaccugaauaagaaaguggaugacggcuucaucgauauuuggaccuacaacgcugagcuccugguccuucuggaaaaugagcgcacacucgacuuucacgacagcaacgugaagaaucuguaugaaaaaguuaagucucagcuuaagaacaaugcgaaagagaucgggaacggaugcuucgaguuuuaccauaaguguaaugaugaaugcauggaguccgugaaaaacggcaccuaugacuaccccaaguauagcgaagagucuaaacugaauagagagaagauugauggggucaagcucgaauccaugggcguguaccaaauccuggccaucuauagcacgguugcuuccucucuggugcuccuggucagccuuggagccauuuccuucuggaugugcucuaacggcagccugcagugucggaucugcauuuga

SEQ ID NO: 189448 - RNA, 1698 nt, Artificial Sequence
  derived and/or modified sequence opt5 from hemagglutinin__InfluenzaA__ADW10798
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucguggaccagaaaacccuguacagaacagagaaugccuacgucagcguuguguccucucauuauagccggaaguucacccccgaaauugcuaagcgcccuaaagugagagaucaggagggccggaucaacuacuauuggacgcuucuggagcccggggacacaauuaucuuugaagccaauggaaaccucauugcgccucgcuacgccuucgcucuguccagaggcuuugggagcggaaucauuaauucuaacgcccccaugggcaagugugaugcuaaaugccagaccccgcaaggcgccaucaauuccagccuuccuuuccagaacguccaccccgugacaaucggggaguguccuaaguauguucggucugcgaaacugcgcauggugaccggacucagaaauauucccagcauccagucccggggccuguuuggggccauugcuggauucaucgaaggcggguggaccggaauggucgacggcugguacggcuaucaucaccagaacgagcaagggucuggauacgccgcugaucaaaagagcacacagaaugccauuaacggcaucacgaauaaagugaacuccguuaucgaaaagaugaauacccaguuuacagccguggggaaggaguucaacaaacuggagcgcagagucgaaaaccucaauaagaaaguggacgauggauucauugacaucuggaccuacaacgcugagcugcuuguccugcucgaaaaugagcggacacuggauuuucacgacagcaacgugaagaaucuuuaugaaaaaguuaagucucagcugaagaacaaugcgaaagagauuggcaacgggugcuucgaguuuuaccauaaguguaaugacgaaugcauggaguccgugaaaaacggcaccuaugauuaccccaaguauagcgaagagucuaaacucaaucgcgagaagaucgacggagucaagcuggaauccaugggcguguaccagauucuggccaucuauagcacgguugcuuccucucucgugcugcuugucagccugggggccaucuccuucuggaugugcucuaacggaagccuccaguguagaauuugcaucuga

SEQ ID NO: 189449 - RNA, 1698 nt, Artificial Sequence; identical to SEQ ID NO: 189445
  derived and/or modified sequence opt5 from hemagglutinin__InfluenzaA__ADW10809

SEQ ID NO: 189450 - RNA, 1698 nt, Artificial Sequence; identical to SEQ ID NO: 186640
  derived and/or modified sequence opt5 from hemagglutinin__InfluenzaA__ADW10820

SEQ ID NO: 189451 - RNA, 1698 nt, Artificial Sequence; identical to SEQ ID NO: 186155
  derived and/or modified sequence opt5 from hemagglutinin__InfluenzaA__ADW10831

SEQ ID NO: 189452 - RNA, 1698 nt, Artificial Sequence
  derived and/or modified sequence opt5 from hemagglutinin__InfluenzaA__ADW10842
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacagugaaaaauggccucuaccccaaccugucuaaguccuaugcuaauaacaaagagaaggaaguccuggugcucuggggagugcaccacccuccgaacaucgucgaccagaaaacccuguacagaacagagaaugccuacguuagcgugguguccucucauuauagccggaaguucgcucccgaaauugccaagcgcccuaaagucagagaucaggaggggcggaucaacuacuauuggacccuucuggagcccggcgacacgauuaucuuugaagcgaaugggaaccucauugccccucgcuacgcuuucgcccuguccagaggauuuggcagcgggaucauuaauucuaacgcucccauggauaagugugacgccaaaugccagacaccgcggggagcgaucaauuccagccuuccuuuccaaaacgugcaccccguuaccaucggcgaguguccuaaguaugugcgcucugccaaacugagaauggucacaggccuccggaauauucccagcauccagucccgcgggcuguuuggagcuauugccggcuucaucgaagggggauggaccggcaugguggaugggugguacggauaucaucaccagaacgagcagggcucuggcuacgcugccgaccaaaagagcacccagaaugccauuaacgggaucacaaauaaaguuaacuccgugaucgaaaagaugaauacgcaguuuaccgcugucggaaaggaguucaacaaacuggagagacggauggaaaaccucaauaagaaaguggaugacggcuucauugauaucuggacauacaacgcggagcugcuuguccugcucgaaaaugagcgcacccuggacuuucacgacagcaacgugaagaaucuuuaugaaaaaguuaagucucagcugaagaacaaugccaaagagauugggaacggaugcuucgaguuuuaccauaaguguaaugaugaaugcauggaguccgugaaaaacggcacauaugacuaccccaaguauagcgaagagucuaaacucaauagagagaagaucgauggggucaagcuggaauccaugggcguguaccaaauucuggcuaucuauagcaccguugccuccucucucgugcugcuugucagccugggagccaucuccuucuggaugugcucuaacggcagccuccagugucggauuugcaucuga

SEQ ID NO: 189453 - RNA, 1698 nt, Artificial Sequence; identical to SEQ ID NO: 188996
  derived and/or modified sequence opt5 from hemagglutinin__InfluenzaA__ADW10853

SEQ ID NO: 189454 - RNA, 1698 nt, Artificial Sequence; identical to SEQ ID NO: 189445
  derived and/or modified sequence opt5 from hemagglutinin__InfluenzaA__ADW10864

SEQ ID NO: 189455 - RNA, 1698 nt, Artificial Sequence; identical to SEQ ID NO: 189445
  derived and/or modified sequence opt5 from hemagglutinin__InfluenzaA__ADW10875

SEQ ID NO: 189456 - RNA, 1698 nt, Artificial Sequence; identical to SEQ ID NO: 186640
  derived and/or modified sequence opt5 from hemagglutinin__InfluenzaA__ADW10886

SEQ ID NO: 189457 - RNA, 1698 nt, Artificial Sequence
  derived and/or modified sequence opt5 from hemagglutinin__InfluenzaA__ADW10897
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgagcaucuccgaccagaaaacccuguaccauacagagaacgccuacgugucugucguuagcucccacuauagcagaaaguucacccccgaaauugcuaagcggccuaaagugcgcgaucaggagggcagaaucaauuacuauuggacgcuucuggagcccggggacacaauuaucuuugaagccaacggaaaucucauugcgccucgguacgccuucgcucugucucgcggcuuuggguccggaaucauuaacagcaaugcccccauggauaagugugacaccaaaugccagacaccgcaaggcgcuaucaacucuagccuuccuuuccagaaugugcaucccgucaccaucggcgaguguccuaaguaugugagauccgccaaacugcggaugguuaccgggcuccgcaacauucccucuauccagagcagaggacuguuuggcgcgauugccggguucaucgaaggaggcuggacagggaugguggauggaugguacggcuaucaccaccagaaugagcaaggcuccggguacgcugccgaccaaaagagcacgcagaacgcuauuaauggaaucaccaacaaagucaauucugugaucgaaaagaugaacacacaguuuaccgccguuggcaaggaguucaauaaacuggagcggcgcauggaaaaccucaacaagaaaguggaugacggguucauugauaucuggacauacaaugccgagcugcuuguccugcucgaaaacgagagaacccuggacuuucaugacuccaaugugaagaaccuuuaugaaaaagucaagagccagcugaagaauaacgcuaaagaggugggaaauggcugcuucgaguuuuaccacaaguguaacgaugaaugcauggagucuguuaaaaaugggacguaugacuaccccaaguauuccgaagagagcaaacucaaccgggagaagauugauggcgugaagcuggaauccaugggagucuaccagauccuggcgauuuauucuacaguggccagcucccucguucugcuugugucucugggcgcuaucagcuucuggaugugcuccaaugggagccuccagugucgcaucugcauuuga

SEQ ID NO: 189458 - RNA, 1701 nt, Artificial Sequence
  derived and/or modified sequence opt5 from hemagglutinin__InfluenzaA__ADW23115
augaagaccaucauugcccugagcuacauccucugccugguguucgcucagaaacuucccggcaacggaaauuccacagccacgcugugucucgggcaccaugcggucccuaacggcaccauuguuaagacaaucaccaaugaccaaauugaggugacaaacgcuaccgaacuggugcagucuagcuccacaggggagaucugcgauucuccgcaccagauccuugacggagaaaauuguacccugauugaugcccuccugggcgacccccagugcgauggguuucaaaacaaaaagugggaccuguucgucgagagaagcaaagccuauuccaauuguuacccuuaugaugugcccgacuacgcuucucuccggagccugguugccuccagcggaacgcuugaauuuaacaaugagucuuucaacuggaccggcgugacacagaauggcaccuccagcgcuugcauccgcagaucuaacaauuccuuuuucagccggcugaacuggcucacacauucuaaguuuaaguauccugcccugaaugucaccaugcccaacaacgagcaguucgauaaacuuuacauuuggggagugcaccauccugggacggacaaugaucagaucuuucuguaugcgcaagccuccggccgcauuacaguuagcaccaagagaucccagcagacagugaucccgaacauugggucucggccccgcgucagaaauaucccuagccggaucuccauuuacuggaccaucgugaaacccggagacauucuccugaucaacagcaccggcaaucugauugcuccucgcggguacuucaagaucagaucuggaaaauccagcaucaugcggucugaugcccccauuggcaaguguaacagcgaaugcaucacaccgaauggcuccauuccuaacgacaagcccuuucagaaugugaaccgcaucacguauggggcuuguccuagauacgucaaacaaaauacccucaagcuggccacaggaaugcggaacguucccgagaaacagacccgcggcauuuucggggcgaucgccggauuuaucgaaaauggcugggaggggaugguggacggaugguauggcuucagacaccagaacucugagggccgggggcaagcugccgaucuuaagagcacacaggcugccauugaccagaucaauggaaaacugaacagacucauuggcaagaccaacgaaaaauuccaccagaucgagaaggaauuuuccgagguggaagggcgcauucaagaucuggagaaguacgucgaggacacgaaaaucgaucuuuggagcuauaaugccgaacugcucguggcucuggagaaccagcauacaauugaccugaccgauucugaaaugaauaagcuguucgagaaaaccaagaaacagcugcgggaaaacgcggaggacaugggaaauggcugcuuuaagaucuaccacaagugugauaacgccugcaucggguccauuagaaauggcacauaugaccaugauguuuaccgcgacgaggcucuuaacaaucgguuccagaucaaaggaguggaacucaagagcggcuacaaagacuggauucucuggaucucuuuugccauuuccugcuuccugcuuugugucgcccugcucggguuuaucaugugggcuugccaaaagggaaacaucagauguaauauuugcaucuga

SEQ ID NO: 189459 - RNA, 1701 nt, Artificial Sequence
  derived and/or modified sequence opt5 from hemagglutinin__InfluenzaA__ADW54481
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccacagccgaucaacagucucucuaccagaacgcugacaccuacguguucgugggcacgagcagauauuccaagaaauuuaagccugagauugccauccggccgaaaguccgcgaucaggaggggagaaugaauuacuauuggacacugguugaacccggagacaagauuaccuucgaggcuacaggcaaccugguggugccucgguacgccuuugcgauggaacgcaacgccgggagcggaaucauuaucucugauacccccguccaugacugcaauaccacaugucaaacgccuaaaggcgcuaucaacaccucccuccccuuccagaauauucacccgaucacaauuggcaagugcccuaaguaugugaaaagcaccaagcugagacuugccacagggcugcggaacguucccucuauccagagccgcggacucuuuggcgcuauugccggguucaucgagggaggcuggaccgggaugguggacggaugguacggcuaucaucaccagaaugaacaaggcuccggguacgccgcugaucugaaaucuacgcagaacgcgaucgacaagauuacaaauaaagucaacagcgugaucgagaagaugaauacccaguuuaccgccguuggaaaggaguucaaccaccuugagaaaagaauugagaaucugaacaagaaaguggaugacggcuuccucgauaucuggacauacaaugcugaacugcugguccuccuggagaacgaacggacccuugacuaucaugauuccaaugugaagaaccuguacgagaaaguccgcaaccagcucaagaauaacgccaaggagauugggaauggauguuuugaguucuaucacaaaugcgacaacacauguauggaaagcgugaagaauggcacguacgauuauccuaaauacucugaagaggccaagcugaacagagaagagaucgacgggguuaaacuugaguccacccggaucuaucaaauucuggcuaucuacagcacaguggccucuucccucguccuggugguuagccugggcgcgauuuccuuuuggaugugcucuaauggaagccuccagugccgcaucuguauuuga

SEQ ID NO: 189460 - RNA, 1701 nt, Artificial Sequence
  derived and/or modified sequence opt5 from hemagglutinin__InfluenzaA__ADW54512
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucaagcgcuuugaaaucuuccccaagaccagcucuuggccuaaucacgauuccaacaaaggagugacaaccgccuguccccaugcuggcgccaagagcuuuuauaaaaaucugaucuggcucguuaagaaaggcaacucuuacccuaagcuguccaagagcuauauuaaugacaaagggaaggaggugcuuguccuguggggaauccaccaucccccuacauccgcggaucaacagucucucuaccagaacgccgacgcuuacguguucgugggcaccagcagauauuccaaaaaguuuaaaccggaaauugccauccggcccaagguccgcgaucaggaggggagaaugaauuacuauuggacgcugguugagccuggagacaaaauuacauucgaagcuaccggcaaccugguggugccccgguacgccuuugcgauggagcgcaacgccgggagcggaaucauuaucucugauacaccuguccacgacugcaauaccaccugucaaacacccaagggcgcuaucaacacgucccucccguuccagaauauucacccuaucaccauuggcaagugccccaaauaugugaaaagcacaaaacugagacuugccaccgggcugcggaacguuccuucuauccagagccgcggacucuuuggcgcuauugccggguucaucgaaggaggcuggacagggaugguggacggaugguacggcuaucaucaccagaaugagcaaggcuccggguacgccgcugaucugaagucuacccagaacgcgaucgacgaaauuacgaauaaagucaacagcgugaucgagaagaugaauacacaguuuaccgccguuggaaaggaguucaaccaccuugaaaagagaauugagaaucugaacaagaaaguggaugacggcuuccucgauaucuggaccuacaaugcugaacugcugguccuccuggagaacgaacggacacuugacuaucaugauuccaaugugaagaaccuguacgagaaaguccgcagccagcucaagaacaaugccaaggagauugggaacggauguuuugaguucuaucacaaaugcgacaauaccuguauggagucugugaagaacggcacauacgauuaucccaaauacuccgaagaggccaagcugaauagagaagagaucgacgggguuaaacuugagagcacgcggaucuaucaaauucuggcuaucuacucuaccguggccuccagccucguccuggugguuucccugggcgcgauuucuuuuuggaugugcagcaacggaucccuccagugccgcaucuguauuuga

SEQ ID NO: 189461 - RNA, 1701 nt, Artificial Sequence
  derived and/or modified sequence opt5 from hemagglutinin__InfluenzaA__ADW54527
augaaggccauccuggugguccuccuguacaccuucgcuacagccagcgcggacacgcuuugcauuggcuaucacgcuaacaauuccaccgauacaguugacaccgugcuggagaaaaacgugacagucacccauucugugaaucuccuggaagauaagcacaacgggaaacuuuguaagcugagaggaguugcuccccuccaucugggcaaaugcaauaucgccggguggauucugggaaacccugagugugaaagccucuccacagccucuagcugguccuacaucguggagaccucuagcuccgacaauggcacgugcuauccgggggauuuuauugacuacgaagaacugcgggagcagcuuagcucugucuccagcuucgaacgcuuugagaucuuccccaagaccucuuccuggccuaaccacgauagcaauaagggagugacaaccgccuguccccaugcuggcgccaaaucuuuuuauaagaaccugaucuggcucguuaaaaagggcaauuccuacccuaaacugagcaaguccuauauuaacgacaaggggaaagaagugcuuguccuguggggaauccaccaucccccuacaucugcggaucaacagagccucuaccagaaugccgacgcuuacguguucgugggcaccuccagauauagcaagaaauuuaagccggagauugccauccggcccaaaguccgcgaucaggaggggagaaugaacuacuauuggacgcugguugaaccuggagacaagauuacauucgaggcuaccggcaaucugguggugccccgguacgccuuugcgauggaacgcaacgccgggucuggaaucauuaucuccgauacaccuguccacgacugcaacaccaccugucaaacacccaauggcgcuaucaacacgagccucccguuccagaauauucacccuaucaccauuggcaaaugccccaaguaugugaagucuacaaaacugagacuugccaccgggcugcggaacguuccuagcauccagucccgcggacucuuuggcgcuauugccggguucaucgagggaggcuggacagggaugguggacggaugguacggcuaucaucaccagaaugaacaaggcucuggguacgccgcugaucuuaagagcacccagaacgcgaucgacgagauuacgaauaaagucaacuccgugaucgagaagaugaauacacaguuuaccgccguuggaaaagaguucaaccaccuggagaagagaauugaaaaucugaacaagaaaguggaugacggcuuccucgauaucuggaccuacaaugcugagcugcugguccuccuggaaaacgagcggacacuugacuaucaugauagcaaugugaagaaccuguacgagaaaguccgcucucagcucaagaacaaugccaaagaaauugggaacggauguuuugaguucuaucacaagugcgacaauaccuguauggaauccgugaagaacggcacauacgauuaucccaaauacagcgaggaagccaagcugaauagagaggagaucgacgggguuaaacuugaaucuacgcggaucuaucaaauucuggcuaucuacuccaccguggccagcucccucguccuggugguuucucugggcgcgauuagcuuuuggaugugcuccaacggaucucuccagugccgcaucuguauuuga

SEQ ID NO: 189462 - RNA, 1701 nt, Artificial Sequence; identical to SEQ ID NO: 189459
  derived and/or modified sequence opt5 from hemagglutinin__InfluenzaA__ADW65825

SEQ ID NO: 189463 - RNA, 1701 nt, Artificial Sequence
  derived and/or modified sequence opt5 from hemagglutinin__InfluenzaA__ADW82135
augaagaccaucauugcccugagcuacauccucugccugguguucgcucagaaacuucccggcaacgacaauuccacagccacgcugugucucgggcaccaugcggucccuaacggaaccguugugaagacaauuaccaaugaucaaaucgaggugacaaacgcuaccgaacugguccagucuagcuccacaggcgagauuugcgacucuccgcaccagauccuugaugggaaaaauuguacccugaucgacgcccuccugggagauccccagugcgacggcuuucaaaacaagaaaugggaucuguucguggaaagaagcaaggccuauuccaauuguuacccuuaugacguucccgauuacgcuucucuccggagccugguggccuccagcgggacgcuugaguuuaacaaugaaucuuucaacuggaccggagucacacagaauggcaccuccagcgcuugcauucgcagaucuaagaacuccuuuuucagccggcugaauuggcucacacaucugaacuuuaaauauaccgcccuuaaugugacgaugccuaacaacgagcaguucgacaagcuguacaucuggggcguucaccaucccgggacagauaaagaccagauuuuucucuaugcgcaagccucuggacgcaucaccguguccacaaagagaagccagcagaccgucauuccuaauaucggcucccggccgcgcgugagaaacauucccucucggaucagcaucuacuggaccauugugaaaccuggggauauccugcugauuaauuccacaggaaaccucaucgcuccccgcggcuacuucaagauuagaagcgggaagucuuccaucaugcggagcgacgccccuaucggaaaauguaauucugagugcauuacgcccaacggcagcaucccgaaugacaagccuuuucagaacgucaaucgcauuaccuauggcgcuugucccagauacguuaaacaaaacacacugaaacuugccaccgggaugcggaaugugccugaaaaacagacacgcggaaucuucggcgcgauugccggguuuaucgagaacggaugggaaggcaugguggaugggugguauggauucagacaccaaaauuccgagggccggggccaggcugccgaccugaagucuacccaggcugccaucgaucagauuaacgggaaacucaauagacugaucggaaagacgaacgagaaguuccaccagauugaaaaagaguuuagcgaagucgagggccgcauccaagaccuugaaaaguacguggaggauacaaaaauugaccugugguccuauaacgccgagcuccugguugcucuggaaaaucagcauaccaucgaucucaccgacagcgagaugaacaagcuguucgaaaagacaaagaagcagcuucgggagaaugcggaagauauggggaacggaugcuuuaaaauuuaccacaagugugacaaugccugcaucggcucuaucagaaacgggaccuaugaucaugacguguaccgcgacgaggcucugaauaaccgguuccagauuaaaggcgucgagcucaaguccggauacaaagauuggauccuguggauuagcuuugccaucucuugcuuccuucuguguguggcccuccugggcuuuauuaugugggcuugccaaaaggggaauaucagauguaacaucugcauuuga

SEQ ID NO: 189464 - RNA, 1701 nt, Artificial Sequence; identical to SEQ ID NO: 189463
  derived and/or modified sequence opt5 from hemagglutinin__InfluenzaA__ADW82155

SEQ ID NO: 189465 - RNA, 1701 nt, Artificial Sequence; identical to SEQ ID NO: 189463
  derived and/or modified sequence opt5 from hemagglutinin__InfluenzaA__ADW82166

SEQ ID NO: 189466 - RNA, 1701 nt, Artificial Sequence; identical to SEQ ID NO: 189463
  derived and/or modified sequence opt5 from hemagglutinin__InfluenzaA__ADW82177

SEQ ID NO: 189467 - RNA, 1701 nt, Artificial Sequence; identical to SEQ ID NO: 185693
  derived and/or modified sequence opt5 from hemagglutinin__InfluenzaA__ADW82188

SEQ ID NO: 189468 - RNA, 1701 nt, Artificial Sequence; identical to SEQ ID NO: 185693
  derived and/or modified sequence opt5 from hemagglutinin__InfluenzaA__ADW82198

SEQ ID NO: 189469 - RNA, 1701 nt, Artificial Sequence; identical to SEQ ID NO: 185693
  derived and/or modified sequence opt5 from hemagglutinin__InfluenzaA__ADW82208

SEQ ID NO: 189470 - RNA, 1701 nt, Artificial Sequence; identical to SEQ ID NO: 185693
  derived and/or modified sequence opt5 from hemagglutinin__InfluenzaA__ADW82218

SEQ ID NO: 189471 - RNA, 1701 nt, Artificial Sequence; identical to SEQ ID NO: 185693
  derived and/or modified sequence opt5 from hemagglutinin__InfluenzaA__ADW82228

SEQ ID NO: 189472 - RNA, 1701 nt, Artificial Sequence; identical to SEQ ID NO: 185693
  derived and/or modified sequence opt5 from hemagglutinin__InfluenzaA__ADW82238

SEQ ID NO: 189473 - RNA, 1701 nt, Artificial Sequence; identical to SEQ ID NO: 185693
  derived and/or modified sequence opt5 from hemagglutinin__InfluenzaA__ADW82248

SEQ ID NO: 189474 - RNA, 1701 nt, Artificial Sequence; identical to SEQ ID NO: 185693
  derived and/or modified sequence opt5 from hemagglutinin__InfluenzaA__ADW82258

SEQ ID NO: 189475 - RNA, 1701 nt, Artificial Sequence
  derived and/or modified sequence opt5 from hemagglutinin__InfluenzaA__ADW82268
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggauccaucaaauucuggccaucuauuccacgguggcgagcucccucguccuggugguuucucugggcgcuauuagcuuuuggaugugcuccaacggaucucuccagugccgcaucuguauuuga

SEQ ID NO: 189476 - RNA, 1701 nt, Artificial Sequence; identical to SEQ ID NO: 189463
  derived and/or modified sequence opt5 from hemagglutinin__InfluenzaA__ADW93760

SEQ ID NO: 189477 - RNA, 1701 nt, Artificial Sequence
  derived and/or modified sequence opt5 from hemagglutinin__InfluenzaA__ADW95319
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuaaguccuauauuaaugacaagggaaaagaagugcuuguccuguggggcauccaccaccccagcaccacagccgaucaacagucccucuaccagaacgcugacaccuacguguucguggggacgucuagauauagcaagaaauuuaagccugagauugccauccggccgaaaguccgcgaucaggagggaagaaugaauuacuauuggacacugguugaacccggcgacaagauuaccuucgaggcuacagggaaccugguggugccucgguacgccuuugcgauggaacgcaacgccggauccggcaucauuaucagcgauacccccguccaugacugcaauaccacaugucaaacgccuaaaggcgcuaucaacaccucucuccccuuccagaauauucacccgaucacaauugggaagugcccuaaguaugugaaauccaccaagcugagacuugccacaggacugcggaacguucccagcauccagucucgcggccucuuuggggcuauugccggauucaucgagggcggguggaccggaaugguggacggcugguacggcuaucaucaccagaaugaacaagggagcggauacgccgcugaucugaaauccacgcagaacgcgaucgacgagauuacaaauaaggucaacucugugaucgagaaaaugaauacccaguuuaccgccguuggcaaggaguucaaccaccuugagaagagaauugaaaaucugaacaaaaagguggaugacggguuccucgauaucuggacauacaaugcugagcugcugguccuccuggaaaacgagcggacccuugacuaucaugauagcaaugugaaaaaccuguacgagaagguccgcaaccagcucaaaaauaacgccaaggaaauuggaaauggcuguuuugaguucuaucacaagugcgacaacacauguauggaauccgugaaaaaugggacguacgauuauccuaaguacagcgaggaagccaaacugaacagagaggagaucgacggcguuaaacuugaaucuacccggaucuaucaaauucuggcuaucuacuccacaguggccagcucucucguccuggugguuucccugggagcgauuagcuuuuggaugugcuccaauggcucucuccagugccgcaucuguauuuga

SEQ ID NO: 189478 - RNA, 1701 nt, Artificial Sequence
  derived and/or modified sequence opt5 from hemagglutinin__InfluenzaA__ADW95332
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuaaguccuauauuaaugacaagggaaaagaagugcuuguccuguggggcauccaccaccccagcaccacagccgaucaacagucccucuaccagaacgcugacaccuacguguucguggggacgucuagauauagcaagaaauuuaagccugagauugccauccggccgaaaguccgcgaucaggagggaagaaugaauuacuauuggacacugguugaacccggcgacaagauuaccuucgaggcuacagggaaccugguggugccucgguacgccuuugcgauggaacgcaacgccggauccggcaucauuaucagcgauacccccguccaugacugcaauaccacaugucaaacgccuaaaggcgcuaucaacaccucucuccccuuccagaauauucacccgaucacaauugggaagugcccuaaguaugugaaauccaccaagcugagacuugccacaggacugcggaacguucccagcauccagucucgcggccucuuuggggcuauugccggauucaucgagggcggguggaccggaaugguggacggcugguacggcuaucaucaccagaaugaacaagggagcggauacgccgcugaucugaaauccacgcagaacgcgaucgacaagauuacaaauaaagucaacucugugaucgagaagaugaauacccaguuuaccgccguuggcaaggaguucaaccaccuugagaaaagaauugagaaucugaacaagaaaguggaugacggguuccucgauaucuggacauacaaugcugaacugcugguccuccuggagaacgaacggacccuugacuaucaugauagcaaugugaagaaccuguacgagaaaguccgcaaccagcucaagaauaacgccaaggagauuggaaauggcuguuuugaguucuaucacaaaugcgacaacacauguauggaauccgugaagaaugggacguacgauuauccuaaauacagcgaagaggccaagcugaacagagaagagaucgacggcguuaaacuugagucuacccggaucuaucaaauucuggcuaucuacuccacaguggccagcucucucguccuggugguuucccugggagcgauuagcuuuuggaugugcuccaauggcucucuccagugccgcaucuguauuuga

SEQ ID NO: 189479 - RNA, 1701 nt, Artificial Sequence
  derived and/or modified sequence opt5 from hemagglutinin__InfluenzaA__ADX21078
augaagaccaucauugcccugagcuacauccucugccugguguucgcucagaaacuucccggcaacgacaauuccacagccacgcugugucucgggcaccaugcggucccuaacggaaccguugugaagacaauuaccaaugaucaaaucgaggugacaaacgcuaccgaacugguccagucuagcuccacaggcgagauuugcgacucuccgcaccagauccuugaugggaaaaauuguacccugaucgacgcccuccugggagauccccagugcgacggcuuucaaaacaagaaaugggaucuguucguggaaagaagcaaggccuauuccaauuguuacccuuaugacguucccgauuacgcuucucuccggagccugguggccuccagcgggacgcuugaguuuaacaaugaaucuuucaacuggaccggagucacacagaauggcaccuccagcgcuugcauucgcagaucuaagaacuccuuuuucagccggcugaauuggcucacacaucugaacuuuaaauauaccgcccuuaaugugacgaugccuaacaacgagcaguucgacaagcuguacaucuggggcguucaccaucccgggacagauaaagaccagauuuuucucuaugcgcaagccucuggacgcaucaccguguccacaaagagaagccagcagaccgucauuccuaauaucggcucccggccgcgcgugagaaacauucccucucggaucagcaucuacuggaccauugugaaaccuggggauauccugcugauuaauuccacaggaaaccucaucgcuccccgcggcuacuucaagauuagaagcgggaagucuuccaucaugcggagcgacgccccuaucggaaaauguaauucugagugcauuacgcccaacggcagcaucccgaaugacaagccuuuucagaacgucaaucgcauuaccuauggcgcuugucccagauacguuaaacaaaacacacugaaacuugccaccgggaugcggaaugugccugaaaaacagacacgcggaaucuucggcgcgauugccggguuuaucgagaacggaugggaaggcaugguggaugggugguauggauucagacaccaaaauuccgagggccggggccaggcugccgaccugaagucuacccaggcugccaucgaucagauuaacgggaaacucaauagacugauccgcaagacgaacgagaaguuccaccagauugaaaaagaguuuagcgaagucgagggacggauccaagaccuugaaaaguacguggaggauacaaaaauugaccugugguccuauaacgccgagcuccugguugcucuggaaaaucagcauaccaucgaucucaccgacagcgagaugaacaagcuguucgaaaagacaaagaagcagcuuagagagaaugcggaagauaugggcaacgggugcuuuaaaauuuaccacaagugugacaaugccugcaucggaucuauccgcaacggcaccuaugaucaugacguguaccgggacgaggcucugaauaacagauuccagauuaaaggggucgagcucaaguccggcuacaaagauuggauccuguggauuagcuuugccaucucuugcuuccuucuguguguggcccuccugggauuuauuaugugggcuugccaaaagggcaauauccgcuguaacaucugcauuuga

SEQ ID NO: 189480 - RNA, 1701 nt, Artificial Sequence; identical to SEQ ID NO: 189479
  derived and/or modified sequence opt5 from hemagglutinin__InfluenzaA__ADX21088

SEQ ID NO: 189481 - RNA, 1701 nt, Artificial Sequence
  derived and/or modified sequence opt5 from hemagglutinin__InfluenzaA__ADX21098
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcagcacaaccugucaaaccccuaaaggcgccaucaauacaucucuccccuuccagaacauucacccgaucacgauuggcaagugcccuaaguaugugaaaagcaccaagcugagacuugcuacagggcugcggaauguucccuccauccagucucgcggacucuuuggcgccauugccggguucaucgagggaggcuggaccgggaugguggacggaugguacggcuaucaucaccagaacgaacaaggcagcggguacgcugcggaucugaaauccacacagaaugccaucgacgagauuaccaacaaggucaauagcgugaucgagaaaaugaacacgcaguuuacagcuguuggaaaggaguucaaucaccuugagaagagaauugaaaaccugaauaaaaagguggaugacggcuuccucgauaucuggaccuacaacgccgagcugcugguccuccuggaaaaugagcggacccuugacuaucaugauucuaacgugaaaaaucuguacgagaagguccgcucccagcucaaaaacaacgccaaggaaauugggaauggauguuuugaguucuaucacaagugcgacaacacauguauggaaagcgugaaaaauggcaccuacgauuauccuaaguacucugaggaagcuaaacugaacagagaggagaucgacgggguuaaacuugaauccacacggauccaucaaauucuggccaucuauagcacgguggcguccucucucguccuggugguuagccugggcgcuauuuccuuuuggaugugcucuaauggaagccuccagugccgcaucuguauuuga

SEQ ID NO: 189482 - RNA, 1701 nt, Artificial Sequence; identical to SEQ ID NO: 186612
  derived and/or modified sequence opt5 from hemagglutinin__InfluenzaA__ADX36109

SEQ ID NO: 189483 - RNA, 1701 nt, Artificial Sequence
  derived and/or modified sequence opt5 from hemagglutinin__InfluenzaA__ADX96278
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaggcuuuuauaagaaucuuauuuggcugguuaaaaaggggaacagcuacccuaaacucucuaaguccuauaucaaugacaagggaaaagaagugcugguccuuuggggcauucaccaccccagcaccuccgccgaucaacagucucuguaccagaacgcugacgccuacguguucguggggagcuccagauauagcaagaaauuuaagccugagaucgcuauucggccgaaaguccgcgaucaggagggaagaaugaauuacuauuggacacucguugaacccggcgacaagaucaccuucgaggccacggggaaccugguggugccucgguacgcguuugccauggaacgcaacgcuggaucuggcauuaucaucuccgauacacccguccaugacugcaauaccacaugucaaaccccuaaaggcgccgugaacaccagccugcccuuccagaauauucacccgaucacaauugggaagugcccuaaguauguuaaaucuacgaagcucagacuggcuaccggacuucggaacgugcccagcauccagucccgcggccuguuuggggccauugccggauucaucgagggcggguggacaggaauggucgacggcugguacggcuaucaucaccagaaugaacaagggucuggauacgcugcggaucucaaaagcacccagaacgccaucgacgagauuacaaauaaggugaacuccguuaucgagaaaaugaauacccaguuuacggcugugggcaaggaguucaaccaccuggagaagagaauugaaaaucuuaacaaaaaggucgaugacggguuccuggauaucuggacauacaaugccgagcuccuggugcugcucgaaaacgagcggacccuggacuaucaugauagcaaugucaaaaaccuuuacgagaaggugcgcucucagcugaaaaacaaugccaaggaaguuggaaacggcuguuuugaguucuaucacaagugcgacaauaccuguauggaauccgugaaaaacgggacauacgauuauccuaaguacagcgaggaagcuaaacucaauagagaggagauugacggcgucaagcuggaaucuacccggaucuaucaaauccuugccauuuacuccacagcggcuagcucccuggugcucguugugucucugggagccaucagcuuuuggaugugcuccaacggcucucugcagugccgcauuuguaucuga

SEQ ID NO: 189484 - RNA, 1701 nt, Artificial Sequence
  derived and/or modified sequence opt5 from hemagglutinin__InfluenzaA__ADX96288
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaacaaggcaacagcuacccuaagcucuccaaaagcuauaucaaugacaaggggaaggaagugcugguccuuuggggcauucaccaccccuccaccucugccgaucagcagagccuguaccagaacgcugacgccuacguguucgugggauccagcagauauucuaaaaaguuuaaaccugagaucgcuauucggccgaagguccgcgaucaagaggggagaaugaauuacuauuggacacucguugaacccggagacaaaaucaccuucgaggccacgggcaaccugguggugccucgguacgcguuugccauggaacgcaacgcuggguccggaauuaucaucagcgauacacccguccaugacugcaauaccacaugucagaccccuaagggcgccauuaacaccucucugcccuuccagaauauccacccgauuacaaucggcaaaugcccuaaguauguuaagagcacgaaacucagacuggcuaccgggcuucggaacgugcccuccauucagucucgcggacuguuuggcgccaucgccggguucaucgagggaggcuggacagggaugguggacggaugguacggcuaucaucaccaaaaugaacagggcagcggguacgcugcggaucucaaguccacccagaacgccauugacgagaucacaaauaaagucaacagcgugauugagaagaugaauacccaguuuacggcuguuggaaaagaguucaaccaccuggagaagagaaucgaaaaucuuaacaagaaaguggaugacggcuuccuggauauuuggacauacaaugccgagcuccugguccugcucgaaaacgagcggacccuggacuaucaugauucuaaugugaagaaccuuuacgagaaaguccgcucccaacugaagaacaaugccaaagaaguggggaacggauguuuugaguucuaucacaagugcgacaauaccuguauggaaagcguuaagaacggcacauacgauuauccuaaauacucugaggaagcuaagcucaauagagaggagaucgacggggugaaacuggaauccacccggaucuaucagauucuugccaucuacagcacagcggcuuccucucugguccucgugguuagccugggcgccauuuccuuuuggaugugcucuaacggaagccugcagugccgcaucuguauuuga

SEQ ID NO: 189485 - RNA, 1701 nt, Artificial Sequence
  derived and/or modified sequence opt5 from hemagglutinin__InfluenzaA__ADX96298
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggaacauccagauauagcaagaaauuuaagccugagaucgucauucggccgaaaguucgcgaucaggaggggagaaugaauuacuauuggacccucguggaacccggagacaagaucacguucgaggcuacaggcaaccugguggucccucgguacgccuuugcgauggaacgcaacgccgggucuggaauuaucaucuccgauacccccgugcaugacugcaauacaaccugucaaaccccuaaaggcgcuauuaacacaagccugcccuuccagaauauccacccgauuacgaucggcaagugcccuaaguauguuaaaucuaccaagcucagacuggccacagggcuucggaacgugcccagcauucagucccgcggacuguuuggcgcuaucgccggguucaucgagggaggcuggaccgggauggucgacggaugguacggcuaucaucaccagaaugaacaaggcucuggguacgccgcugaucucaaaagcacacagaacgcgauugacgagaucaccaauaaggugaacuccguuauugagaaaaugaauacgcaguuuacagccgugggaaaggaguucaaccaccuggagaagagaaucgaaaaucuuaacaaaaaggucgaugacggcuuccuggauauuuggaccuacaaugcugagcuccuggugcugcucgaaaacgagcggacccuggacuaucaugauagcaaugucaaaaaccuuuacgagaaggugcgcucucagcugaaaaacaaugccaaggaaaucgggaacggauguuuugaguucuaucacaagugcgacaauacauguauggaauccguuaaaaacggcaccuacgauuauccuaaguacagcgaggaagccaaacucaauagagaggagaucgacggggugaagcuggaaucuacacggauuuaucaaauccuugcuauuuacuccacggucgccagcucccuggugcucguugugucucugggcgcgaucagcuuuuggaugugcuccaccggaucucugcagugccgcauuuguaucuga

SEQ ID NO: 189486 - RNA, 1701 nt, Artificial Sequence; identical to SEQ ID NO: 187290
  derived and/or modified sequence opt5 from hemagglutinin__InfluenzaA__ADX96308

SEQ ID NO: 189487 - RNA, 1701 nt, Artificial Sequence
  derived and/or modified sequence opt5 from hemagglutinin__InfluenzaA__ADX96318
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacuccuacguguucgugggcacaagcagauauucuaagaaauuuaagccugagauugccauccggccgaaaguccgcgaucaggaggggagaaugaauuacuauuggacccugguugaacccggagacaagauuacguucgaggcuacaggcaaccugguggugccucgguacgccuuugcgauggaacgcaacgccggguccggaaucauuaucagcgauacccccguccaugacugcaauacaaccugucaaaccccuaaaggcgcuaucaacacaucucuccccuuccagaauauucacccgaucacgauuggcaagugcccuaaguaugugaaaagcaccaagcugagacuugccacagggcugcggaacguucccuccauccagucucgcggacucuuuggcgcuauugccggguucaucgagggaggcuggaccgggaugguggacggaugguacggcuaucaucaccagaaugaacaaggcagcggguacgccgcugaucugaaauccacacagaacgcgaucgacaagauuaccaauaaagucaacagcgugaucgagaagaugaauacgcaguuuacagccguuggaaaggaguucaaccaccuugagaaaagaauugagaaucugaacaagaaaguggaugacggcuuccucgauaucuggaccuacaaugcugaacugcugguccuccuggagaacgaacggacccuugacuaucaugauucuaaugugaagaaccuguacgagaaaguccgcucccagcucaagaacaaugccaaggagauugggaacggauguuuugaguucuaucacaaaugcgacaauacauguauggaaagcgugaagaacggcaccuacgauuauccuaaauacucugaagaggccaagcugaauagagaagagaucgacgggguuaaacuugaguccacacggaucuaucaaauucuggcuaucuacagcacgguggccuccucucucguccuggugguuagccugggcgcgauuuccuuuuggaugugcucuaacggaagccuccagugccgcaucuguauuuga

SEQ ID NO: 189488 - RNA, 1701 nt, Artificial Sequence
  derived and/or modified sequence opt5 from hemagglutinin__InfluenzaA__ADX96328
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggcgccucgguacgccuuugcuauggaacgcaacgccgggucuggaaucauuaucuccgauacccccgugcaugacugcaauacaaccugucaaaccccuaaaggcgcuaucaacacaagccuccccuuccagaauauucacccgaucacgauuggcaagugcccuaaguaugucaaaucuaccaagcugagacuugccacagggcugcggaacgugcccagcauccagucccgcggacucuuuggcgccauugcuggguucaucgagggaggcuggaccgggaugguugacggaugguacggcuaucaucaccagaaugaacaaggcucuggguacgcggccgaucugaaaagcacacagaacgcuaucgacaagauuaccaauaaagugaacuccgucaucgagaagaugaauacgcaguuuacagccgugggaaaggaguucaaccaccuugagaaaagaauugagaaucugaacaagaaaguugaugacggcuuccucgauaucuggaccuacaaugccgaacugcuggugcuccuggagaacgaacggacccuugacuaucaugauagcaaugucaagaaccuguacgagaaagugcgcucucagcucaagaacaaugcuaaggagauugggaacggauguuuugaguucuaucacaaaugcgacaauacauguauggaauccgucaagaacggcaccuacgauuauccuaaauacagcgaagaggccaagcugaauagagaagagaucgacggggugaaacuugagucuacacggaucuaucaaauucuggcgaucuacuccacgguugcuagcucccucgugcuggucgugucucugggcgccauuagcuuuuggaugugcuccaacggaucucuccagugccgcaucuguauuuga

SEQ ID NO: 189489 - RNA, 1701 nt, Artificial Sequence
  derived and/or modified sequence opt5 from hemagglutinin__InfluenzaA__ADX96347
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccauaauugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggacggaugguacggcuaucaucaccagaacgaacaaggcucuggguacgcugcggaccugaaaagcacacagaaugccaucgauaagauuaccaacaaagucaauuccgugaucgagaagaugaacacgcaguuuacagcuguuggaaaggaguucaaucaccuugagaaaagaauugagaaccugaauaagaaaguggacgauggcuuccucgacaucuggaccuacaacgccgaacugcugguccuccuggagaaugaacggacccuugauuaucaugacagcaacgugaagaaccuguacgagaaaguccgcucucagcucaagaauaacgccaaggagauugggaauggauguuuugaguucuaucacaaaugcgauaacacauguauggaauccgugaagaauggcaccuacgacuauccuaaauacagcgaagaggcuaagcugaacagagaagagaucgaugggguuaaacuugagucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 189490 - RNA, 1701 nt, Artificial Sequence
  derived and/or modified sequence opt5 from hemagglutinin__InfluenzaA__ADX96357
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggaacauccagauauagcaagaaauuuaagccugagaucgucauucggccgaaaguucgcgaucaggaggggagaaugaauuacuauuggacccucguggaacccggagacaagaucacguucgaggcuacaggcaaccugguggucccucgguacgccuuugcgauggaacgcaacgccgggucuggaauuaucaucuccgauacccccgugcaugacugcaauacaaccugucaaaccccuaaaggcgcuauuaacacaagccugcccuuccagaauauccacccgauuacgaucggcaagugcccuaaguauguuaaaucuaccaagcucagacuggccacagggcuucggaacgugcccagcauucagucccgcggacuguuuggcgcuaucgccggguucaucgagggaggcuggaccgggauggucgacggaugguacggcuaucaucaccagaaugaacaaggcucuggguacgccgcugaucucaaaagcacacagaacgcgauugacgagaucaccaauaaggugaacuccguuauugagaaaaugaauacgcaguuuacagccgugggaaaggaguucaaccaccuggagaagagaaucgaaaaucuuaacaaaaaggucgaugacggcuuccuggauauuuggaccuacaaugcugagcuccuggugcugcucgaaaacgagcggacccuggacuaucaugauagcaaugucaaaaaccuuuacgagaaggugcgcucucagcugaaaaacaaugccaaggaaaucgggaacggauguuuugaguucuaucacaagugcgacaauacauguauggaauccguuaaaaacggcaccuacgauuauccuaaguacagcgaggaagccaaacucaauagagaggagaucgacggggugaagcuggaaucuacacggauuuaucaaauccuugcuauuuacuccacggucgccagcucccuggugcucguugugucucugggcgcgaucagcuuuuggaugugcuccaacggaucucugcagugccgcauuuguaucuga

SEQ ID NO: 189491 - RNA, 1701 nt, Artificial Sequence; identical to SEQ ID NO: 188630
  derived and/or modified sequence opt5 from hemagglutinin__InfluenzaA__ADX96367

SEQ ID NO: 189492 - RNA, 1701 nt, Artificial Sequence
  derived and/or modified sequence opt5 from hemagglutinin__InfluenzaA__ADX96378
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccauccaugacugcaauacaaccugucaaaccccuaaaggcgccauuaacacaagccuccccuuccagaauauccacccgauuacgaucggcaagugcccuaaguaugucaaaucuaccaagcugagacuugcuacagggcugcggaacgugcccagcauucagucccgcggacucuuuggcgccaucgccggguucaucgagggaggcuggaccgggaugguugacggaugguacggcuaucaucaccagaaugaacaaggcucuggguacgcugcggaucugaaaagcacacagaacgccauugacgagaucaccaauaaggugaacuccgucauugagaaaaugaauacgcaguuuacagcugugggaaaggaguucaaccaccuugagaagagaaucgaaaaucugaacaaaaagguugaugacggcuuccucgauauuuggaccuacaaugccgagcugcuggugcuccuggaaaacgagcggacccuugacuaucaugauagcaaugucaaaaaccuguacgagaaggugcgcucucagcucaaaaacaaugccaaggaaaucgggaacggauguuuugaguucuaucacaagugcgacaauacauguauggaauccgucaaaaacggcaccuacgauuauccuaaguacagcgaggaagcuaaacugaauagagaggagaucgacggggugaaacuugaaucuacacggauuuaucaaauccuggccauuuacuccacgguugcgagcucccucgugcuggucgugucucugggcgcuaucagcuuuuggaugugcuccaacggaucucuccagugccgcauuuguaucuga

SEQ ID NO: 189493 - RNA, 1701 nt, Artificial Sequence; identical to SEQ ID NO: 189492
  derived and/or modified sequence opt5 from hemagglutinin__InfluenzaA__ADX96398

SEQ ID NO: 189494 - RNA, 1701 nt, Artificial Sequence
  derived and/or modified sequence opt5 from hemagglutinin__InfluenzaA__ADX96408
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggaacauccagauauagcaagaaauuuaagccugagaucgcuauucggccgaaaguccgcgaucaggaggggagaaugaauuacuauuggacccucguugaacccggagacaagaucacguucgaggccacaggcaaccugguggugccucgguacgcguuugccauggaacgcaacgcugggucuggaauuaucaucuccgauacccccauucaugacugcaauacaaccugucaaaccccuaaaggcgccaucaacacaagccugcccuuccagaauauucacccgaucacgauuggcaagugcccuaaguaugucaaaucuaccaagcucagacuggcuacagggcuucggaacgugcccagcauccagucccgcggacuguuuggcgccaucgccggguucauugagggaggcuggaccgggaugguugacggaugguacggcuaucaucaccagaaugaacaaggcucuggguacgcugcggaucucaaaagcacacagaacgccaucgacgagauuaccaauaaggugaacuccgucaucgagaaaaugaauacgcaguuuacagcugugggaaaggaguucaaccaccuggagaagagaauugaaaaucuuaacaaaaagguugaugacggcuuccuggauaucuggaccuacaaugccgagcuccuggugcugcucgaaaacgagcggacccuggacuaucaugauagcaaugucaaaaaccuuuacgagaaggugcgcucucagcugaaaaacaaugccaaggaaaucgggaacggauguuuugaguucuaucacaagugcgacaauacauguauggaauccgucaaaaacggcaccuacgauuauccuaaguacagcgaggaagcuaaacucaauagagaggagauugacggggugaagcuggaaucuacacggaucuaucaaauucuugccaucuacuccacgguugcgagcucccuggugcucgucgugucucugggcgcuauuagcuuuuggaugugcuccaacggaucucugcagugccgcaucuguauuuga

SEQ ID NO: 189495 - RNA, 1701 nt, Artificial Sequence; identical to SEQ ID NO: 186006
  derived and/or modified sequence opt5 from hemagglutinin__InfluenzaA__ADX96427

SEQ ID NO: 189496 - RNA, 1701 nt, Artificial Sequence
  derived and/or modified sequence opt5 from hemagglutinin__InfluenzaA__ADX96437
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggauccagcagauauucuaagaaauuuaagccugagaucgcuauucggccgaaaguccgcgaucaggaggggagaaugaauuacuauuggacacucguugaacccggagacaagaucaccuucgaggccacgggcaaccugguggugccucgguacgcguuugccauggaacgcaacgcuggguccggaauuaucaucagcgauacacccguccaugacugcaauaccacaugucaaaccccuaaaggcgccauuaacaccucucugcccuuccagaauauccacccgauuacaaucggcaagugcccuaaguaugugaaaagcacgaagcucagacuggcuaccgggcuucggaacguucccuccauucagucucgcggacuguuuggcgccaucgccggguucaucgagggaggcuggacagggaugguggacggaugguacggcuaucaucaccagaaugaacaaggcagcggguacgcugcggaucucaaauccacccagaacgccauugacgagaucacaaauaaggucaacagcgugauugagaaaaugaauacccaguuuacggcuguuggaaaggaguucaaccaccuggagaagagacuugaaaaucugaacaaaaagguggaugacggcuuccucgauaucuggacauacaaugccgagcugcugguccuccuggaaaacgagcggacccuugacuaucaugauucuaaugugaaaaaccuguacgagaagguccgcucccagcucaaaaacaaugccaaggaaguggggaacggauguuuugaguucuaucacaagugcgacaauaccuguauggaaagcguuaaaaacggcacauacgauuauccuaaguacucugaggaagcuaaacugaauagagaggagauugacggggugaaacuugaauccacccggaucuaucaaauccuggccauuuacagcacagcggcuuccucucucguccuggugguuagccugggcgccaucuccuuuuggaugugcucuaacggaagccuccagugccgcauuuguaucuga

SEQ ID NO: 189497 - RNA, 1701 nt, Artificial Sequence; identical to SEQ ID NO: 185680
  derived and/or modified sequence opt5 from hemagglutinin__InfluenzaA__ADX96447

SEQ ID NO: 189498 - RNA, 1701 nt, Artificial Sequence; identical to SEQ ID NO: 185693
  derived and/or modified sequence opt5 from hemagglutinin__InfluenzaA__ADX96497

SEQ ID NO: 189499 - RNA, 1701 nt, Artificial Sequence
  derived and/or modified sequence opt5 from hemagglutinin__InfluenzaA__ADX96507
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggaucuaucaaauucuggccaucuacuccacgguggcgagcucccucguccuggugguuucucugggcgcuauuagcuuuuggaugugcuccaccggaucucuccagugccgcaucuguauuuga

SEQ ID NO: 189500 - RNA, 1701 nt, Artificial Sequence; identical to SEQ ID NO: 189499
  derived and/or modified sequence opt5 from hemagglutinin__InfluenzaA__ADX96517

SEQ ID NO: 189501 - RNA, 1701 nt, Artificial Sequence
  derived and/or modified sequence opt5 from hemagglutinin__InfluenzaA__ADX96527
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuuucacaagugcgacaauacauguauggaauccgugaaaaacggcaccuaugauuacccuaaguauagcgaggaagcuaaacugaauagagaggagaucgacgggguuaaacuugaaucuacacggaucuaccaaauucuggccaucuauuccacgguggcgagcucccucguccuggugguuucucugggcgcuauuagcuucuggaugugcuccaacggaucucuccagugccgcaucuguauuuga

SEQ ID NO: 189502 - RNA, 1701 nt, Artificial Sequence; identical to SEQ ID NO: 185693
  derived and/or modified sequence opt5 from hemagglutinin__InfluenzaA__ADX96537

SEQ ID NO: 189503 - RNA, 1701 nt, Artificial Sequence; identical to SEQ ID NO: 185693
  derived and/or modified sequence opt5 from hemagglutinin__InfluenzaA__ADX96547

SEQ ID NO: 189504 - RNA, 1701 nt, Artificial Sequence; identical to SEQ ID NO: 186794
  derived and/or modified sequence opt5 from hemagglutinin__InfluenzaA__ADX96557

SEQ ID NO: 189505 - RNA, 1701 nt, Artificial Sequence; identical to SEQ ID NO: 185693
  derived and/or modified sequence opt5 from hemagglutinin__InfluenzaA__ADX96587

SEQ ID NO: 189506 - RNA, 1701 nt, Artificial Sequence; identical to SEQ ID NO: 185680
  derived and/or modified sequence opt5 from hemagglutinin__InfluenzaA__ADX96597

SEQ ID NO: 189507 - RNA, 1701 nt, Artificial Sequence; identical to SEQ ID NO: 185680
  derived and/or modified sequence opt5 from hemagglutinin__InfluenzaA__ADX96607

SEQ ID NO: 189508 - RNA, 1701 nt, Artificial Sequence
  derived and/or modified sequence opt5 from hemagglutinin__InfluenzaA__ADX96627
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaaaagaacgcugggucuggaaucauuaucuccgauacccccguccaugacugcaauacaaccugucaaaccccuaagggcgccaucaacacaagccuccccuuccagaauauucacccgaucacgauuggcaagugcccuaaauaugugaagucuaccaaacugcgccuugcuacagggcugagaaacguucccagcauccagucccggggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaagucaacuccgugaucgagaagaugaauacgcaguuuacagcuguuggaaaggaguucaaccaccuugagaaacgcauugaaaaucugaacaagaaaguggaugacggcuuccucgauaucuggaccuacaaugccgagcugcugguccuccuggaaaacgagagaacccuugacuaucaugauagcaaugugaagaaccuguacgagaaaguccggucucagcucaagaacaaugccaaggaaauugggaacggauguuuugaguucuaucacaaaugcgacaauacauguauggaauccgugaagaacggcaccuacgauuauccuaaauacagcgaggaagcuaagcugaaucgcgaggagaucgacgggguuaaacuugaaucuacaagaaucuaucaaauucuggccaucuacuccacgguggcgagcucccucguccuggugguuucucugggcgcuauuagcuuuuggaugugcuccaccggaucucuccagugccggaucuguauuuga

SEQ ID NO: 189509 - RNA, 1701 nt, Artificial Sequence; identical to SEQ ID NO: 186140
  derived and/or modified sequence opt5 from hemagglutinin__InfluenzaA__ADX96637

SEQ ID NO: 189510 - RNA, 1701 nt, Artificial Sequence; identical to SEQ ID NO: 185693
  derived and/or modified sequence opt5 from hemagglutinin__InfluenzaA__ADX96647

SEQ ID NO: 189511 - RNA, 1701 nt, Artificial Sequence; identical to SEQ ID NO: 185680
  derived and/or modified sequence opt5 from hemagglutinin__InfluenzaA__ADX96657

SEQ ID NO: 189512 - RNA, 1701 nt, Artificial Sequence; identical to SEQ ID NO: 185693
  derived and/or modified sequence opt5 from hemagglutinin__InfluenzaA__ADX96667

SEQ ID NO: 189513 - RNA, 1701 nt, Artificial Sequence
  derived and/or modified sequence opt5 from hemagglutinin__InfluenzaA__ADX96677
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacaguuguggaacccggagacaagauuaccuucgaggccacgggcaaccugguggucccucgguacgcguuugccauggaacgcaacgcuggguccggaaucauuaucagcgauacacccgugcaugacugcaauaccacaugucaaaccccuaaaggcgccaucaacaccucucugcccuuccacaauauucauccgaucacaauuggcaagugcccuaaguauguuaaaagcacgaagcucagacuggcuaccgggcuucggaacgugcccuccauccagucucgcggacuguuuggcgccauugccggguucaucgagggaggcuggacagggauggucgacggaugguacggcuaucaccaccagaaugaacagggcagcggguacgcugcggaucucaaauccacccaaaacgccaucgacgagauuacaaauaaggugaacagcguuaucgagaaaaugaauacccaguuuacggcugugggaaaggaguucaaccaucuggagaagagaauugaaaaucuuaacaaaaaggucgaugacggcuuccuggauaucuggacauacaaugccgagcuccuggugcugcucgaaaacgagcggacccuggacuaucacgauucuaaugucaaaaaccuuuacgagaaggugcgcucccagcugaaaaacaaugccaaggaaauugggaacggauguuuugaguucuaucauaagugcgacaauaccuguauggaaagcguuaaaaacggcacauacgauuauccuaaguacucugaggaagcuaaacucaauagagaggagaucgacggggugaagcuggaauccacccggaucuaucagauucuugccaucuacagcacagucgcguccucucuggugcucguugugagccugggcgcuauuuccuuuuggaugugcucuaacggaagccugcaaugccgcaucuguauuuga

SEQ ID NO: 189514 - RNA, 1701 nt, Artificial Sequence
  derived and/or modified sequence opt5 from hemagglutinin__InfluenzaA__ADX96687
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaaaugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgggagcagcuuuccagcgucucuuccuucaagcgcuuugaaaucuuccccaagaccagcucuuggccuaaucacgauuccaacaaaggagugacagccgcuuguccccaugccggcgccaagagcuuuuauaaaaaucugaucuggcucguuaagaaaggcaacucuuacccuaagcuguccaagagcuauauuaaugacaaagggaaggaggugcuuguccuguggggaauccaccaccccuccaccucugccgaucaacagagccucuaccagaacgcugacgccuacguguucgugggcacauccagauauagcaaaaaguuuaaaccugaaauugcuauccggccgaagguccgcgaucaggaggggagaaugaauuacuauuggacccugguugagcccggagacaaaauuacguucgaagccacaggcaaccugguggugccucgguacgcguuugccauggagcgcaacgcugggucuggaaucauuaucuccgauacccccgucuaugacugcaauacaaccugucaaaccccuaagggcgccaucaacacaagccuccccuuccagaauauucauccgaucacgauuggcaagugcccuaaauacgugaagucuaccaaacugagacuugcuacagggcugcggaacguucccagcauccagucccgcggacucuuuggcgccauugccggguucaucgaaggaggcuggaccgggaugguggacggaugguauggcuaccaccaucagaaugagcaaggcucuggguacgcugcggaucugaaaagcacacagaacgccaucgacgaaauuaccaauaaagucaacuccgugaucgagaagaugaauacgcaguuuacagcuguuggaaaggaguucaaccaccuugaaaagagaauugagaaucugaacaagaaaguggaugacggcuuccucgauaucuggaccuauaaugccgaacugcugguccuccuggagaacgaacggacccuugacuaccacgauagcaaugugaagaaccuguaugagaaaguccgcucucagcucaagaacaaugccaaggagauugggaacggauguuuugaguucuaccauaaaugcgacaauacauguauggaguccgugaagaacggcaccuaugauuacccuaaauauagcgaagaggcuaagcugaauagagaagagaucgacgggguuaaacuugagucuacacggaucuaccaaauucuggccaucuacuccacgguggcgagcucccucguccuggugguuucucugggcgcuauuagcuuuuggaugugcuccaacggaucucuccagugccgcaucuguauuuga

SEQ ID NO: 189515 - RNA, 1701 nt, Artificial Sequence; identical to SEQ ID NO: 185693
  derived and/or modified sequence opt5 from hemagglutinin__InfluenzaA__ADX96697

SEQ ID NO: 189516 - RNA, 1701 nt, Artificial Sequence
  derived and/or modified sequence opt5 from hemagglutinin__InfluenzaA__ADX96707
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcgacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggauggaugguacggcuaucaucaccagaacgaacaaggcucuggguacgcugcggaccugaaaagcacacagaaugccaucgauaagauuaccaacaaagucaauuccgugaucgagaagaugaacacgcaguuuacagcuguuggaaaggaguucaaucaccuugagaaaagaauugagaaccugaauaagaaaguggacgauggcuuccucgacaucuggaccuacaacgccgaacugcugguccuccuggagaaugaacggacccuugauuaucaugacagcaacgugaagaaucuguacgagaaaguccgcucucagcucaagaacaacgccaaggagauugggaauggauguuuugaguucuaucacaaaugcgauaacacauguauggaauccgugaagaauggcaccuacgacuauccuaaauacagcgaagaggcuaagcugaacagagaagagaucgaugggguuaaacuugagucuacacggaucuaucaaauucuggccaucuacuccacgguggcgagcucccucguccuggugguuucucugggcgcuauuagcuuuuggaugugcuccaccggaucucuccagugccgcaucuguauuuga

SEQ ID NO: 189517 - RNA, 1701 nt, Artificial Sequence; identical to SEQ ID NO: 186853
  derived and/or modified sequence opt5 from hemagglutinin__InfluenzaA__ADX96727

SEQ ID NO: 189518 - RNA, 1701 nt, Artificial Sequence
  derived and/or modified sequence opt5 from hemagglutinin__InfluenzaA__ADX96737
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaagucaaggagcaggaagggcgcaugaauuacuauuggacccugguugagcccggagauaaaauuacguucgaagccacaggcaaccugguggugccuagauacgcguuugccauggagcggaaggcugggucuggaaucauuaucuccgacacccccguccaugauugcaacacaaccugucaaaccccuaagggcgccaucaauacaagccuccccuuccagaacauucacucuaucacgauuggcaaaugcccgaaguaugugaaaagcaccaagcugcgccuugcuacagggcugagaaauguuccuuccauccagucucggggacucuuuggcgccauugccggguucaucgaaggaggcuggaccgggaugguggacggaugguacggcuaucaucaccagaacgagcaaggcagcggguacgcugcggaccugaaauccacacagaaugccaucgaugagauuaccaacaaggucaauagcgugaucgaaaagaugaacacgcaguuuacagcuguuggaaaagaguucaaucaccuugaaaagcgcauugagaaccugaauaaaaagguggacgauggcuuccucgacaucuggaccuacaacgccgaacugcugguccuccuggagaaugagagaacccuugauuaucaugacucuaacgugaaaaaucuguacgaaaagguccggucccagcucaagaacaacgccaaagagauugggaauggauguuuugaguucuaucacaagugcgauaacacauguauggagagcgugaaaaauggcaccuacgacuaucccaaguacucugaagaggcuaaacugaaccgcgaggaaaucgaugggguuaaacuugaguccacaagaaucuaucaaauucuggccaucuacagcacgguggcguccucucucguccuggugauuagccugggcgcuaucuccuuuuggaugugcucuaccggaagccuccagugccggauuuguaucuga

SEQ ID NO: 189519 - RNA, 1701 nt, Artificial Sequence; identical to SEQ ID NO: 185693
  derived and/or modified sequence opt5 from hemagglutinin__InfluenzaA__ADX96747

SEQ ID NO: 189520 - RNA, 1701 nt, Artificial Sequence
  derived and/or modified sequence opt5 from hemagglutinin__InfluenzaA__ADX96757
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcggcaacgggacgugcuauccgggagacuuuauugauuacgaagaacugcgggagcagcuuuccagcgucucuuccuucgaacgcuuugagaucuuccccaagaccagcucuuggccuaaucacgacuccaacaagggcgugacagccgcuuguccccaugccggcgcgaaaucuuuuuauaagaaucugaucuggcucguuaaaaaggggaacagcuacccuaaacuguccaagagcuauauuaaugauaagggaaaagaagugcuuguccuguggggcauccaccaccccuccaccucugccgaccaacagagccucuaccagaacgcugaugccuacguguucguggggacauccagauauagcaagaaauuuaagccugagauugcuauccggccgaaaguccgcgaccaggagggaagaaugaauuacuauuggacccugguugugcccggcgauaagauuacguucgaagccacagggaaccugguggucccucgguacgcguuugccauggagcgcaacgcuggaucuggcaucauuaucuccgacacccccgugcaugauugcaauacaaccugucaaaccccuaaaggcgccaucaacacaagccuccccuuccagaauauucacccgaucacgauugggaagugcccuaaguauguuaaaucuaccaagcugagacuugcuacaggacugcggaacgugcccagcauccagucccgcggccucuuuggggccauugccggauucaucgaaggcggguggaccggaauggucgacggcugguacggcuaucaucaccagaaugagcaagggucuggauacgcugcggaccugaaaagcacacagaacgccaucgaugaaauuaccaauaaggugaacuccguuaucgagaaaaugaauacgcaguuuacagcugugggcaaggaguucaaccaccuugaaaagagaauugagaaucugaacaaaaaggucgacgauggguuccucgacaucuggaccuacaaugccgaacugcuggugcuccuggagaacgaacggacccuugauuaucaugacagcaaugucaaaaaccuguacgagaaggugcgcucucagcucaaaaacaaugccaaggagauuggaaacggcuguuuugaguucuaucacaagugcgauaauacauguauggaguccguuaaaaacgggaccuacgacuauccuaaguacagcgaagaggcuaaacugaauagagaagagaucgauggcgugaaacuugagucuacacggaucuaucaaauucuggccaucuacuccacggucgcgagcucccucgugcugguugugucucugggagcuauuagcuuuuggaugugcuccaccggcucucuccagugccgcaucuguauuuga

SEQ ID NO: 189521 - RNA, 1701 nt, Artificial Sequence
  derived and/or modified sequence opt5 from hemagglutinin__InfluenzaA__ADX96767
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaaucuggagacaagauuacguucgaggccacaggcaaccugguggugccccgguacgcguuugccauggaacgcaacgcuggguccggaaucauuaucagcgauaccccuguccaugacugcaauacaaccugucaaacccccaaaggcgccaucaacacaucucucccuuuccagaauauucaccccaucacgauuggcaagugcccgaaguaugugaaaagcaccaagcugagacuugcuacagggcugcggaacguuccuuccauccagucucgcggacucuuuggcgccauugccggguucaucgagggaggcuggaccgggaugguggacggaugguacggcuaucaucaccagaaugaacaaggcagcggguacgcugcggaucugaaauccacacagaacgccaucgacgagauuaccaauaaggucaacagcgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauucuaaugugaaaaagcuguacgagaaaguccgcucccagcucaagaacaacgccaaggaaauugggaauggauguuuugaguucuaucacaaaugcgacaacacauguauggaaagcgugaagaauggcaccuacgauuaucccaaauacucugaggaagcuaagcugaacagagaggagaucgacgggguuaaacuugaauccacacggaucuaucaaauucuggccaucuacagcacgguggcguccucucucguccuggugguuagccugggcgcuauuuccuuuuggaugugcucuaccggaagccuccagugccgcaucuguauuuga

SEQ ID NO: 189522 - RNA, 1701 nt, Artificial Sequence
  derived and/or modified sequence opt5 from hemagglutinin__InfluenzaA__ADX96777
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugugcccggagacaagauuacguucgaagccacaggcaaccugguggucccucgguacgcguuugccauggagcgcaacgcugggucuggaaucauuaucuccgauacccccgugcaugacugcaauacaaccugucaaaccccuaaaggcgccaucaacacaagccuccccuuccagaauauucacucuaucacgauuggcaagugcccgaaguauguuaaaagcaccaagcugagacuugcuacagggcugcggaacgugccuuccauccagucucgcggacucuuuggcgccauugccggguucaucgaaggaggcuggaccgggauggucgacggaugguacggcuaucaucaccagaaugagcaaggcagcggguacgcugcggaucugaaauccacacagaacgccaucgacgaaauuaccaauaaggugaacagcguuaucgagaaaaugaauacgcaguuuacagcugugggaaaggaguucaaccaccuugaaaagagaauugagaaucugaacaaaaaggucgaugacggcuuccucgauaucuggaccuacaaugccgaacugcuggugcuccuggagaacgaacggacccuugacuaucaugauucuaaugucaaaaaccuguacgagaaggugcgcucccagcucaaaaacaaugccaaggagauugggaacggauguuuugaguucuaucacaagugcgacaauacauguauggagagcguuaaaaacggcaccuacgauuaucccaaguacucugaagaggcuaaacugaauagagaagagaucgacggggugaaacuugaguccacacggaucuaucaaauucuggccaucuacagcacggucgcguccucucucgugcugguugugagccugggcgcuauuuccuuuuggaugugcucuaacggaagccuccagugccgcaucuguauuuga

SEQ ID NO: 189523 - RNA, 1701 nt, Artificial Sequence; identical to SEQ ID NO: 185693
  derived and/or modified sequence opt5 from hemagglutinin__InfluenzaA__ADX96787

SEQ ID NO: 189524 - RNA, 1701 nt, Artificial Sequence; identical to SEQ ID NO: 188920
  derived and/or modified sequence opt5 from hemagglutinin__InfluenzaA__ADX96797

SEQ ID NO: 189525 - RNA, 1701 nt, Artificial Sequence
  derived and/or modified sequence opt5 from hemagglutinin__InfluenzaA__ADX96807
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggauccagcagauuuucuaagaaauucaagccugagaucgcuauucggccgaaaguccgcgaucaggaggggagaaugaauuauuacuggacacucguugaacccggagacaagaucaccuuugaggccacgggcaaccugguggugccucgguaugcguucgccauggaacgcaacgcuggguccggaauuaucaucagcgauacacccguccaugacugcaauaccacaugucaaaccccuaaaggcgccauuaacaccucucugcccuuucagaauauccacccgauuacaaucggcaagugcccuaaguacgugaaaagcacgaagcucagacuggcuaccgggcuucggaacguucccuccauucagucucgcggacuguucggcgccaucgccggguuuaucgagggaggcuggacagggaugguggacggaugguauggcuaccaucaccagaaugaacaaggcagcggguaugcugcggaucucaaauccacccagaacgccauugacgagaucacaaauaaggucaacagcgugauugagaaaaugaauacccaguucacggcuguuggaaaggaguucaaccaccuggagaagagaaucgaaaaucuuaacaaaaagguggaugacggcuuucuggauauuuggacauacaaugccgagcuccugguccugcucgaaaacgagcggacccuggacuaccaugauucuaaugugaaaaaccuuuaugagaagguccgcucccagcugaaaaacaaugccaaggaaguggggaacggauguuucgaguuuuaccacaagugcgacaauaccuguauggaaagcguuaaaaacggcacauaugauuacccuaaguauucugaggaagcuaaacucaauagagaggagaucgacggggugaagcuggaauccacccggaucuaccaaauucuugccaucuauagcacagucgcguccucucuggugcucguugugagccugggcgcuauuuccuucuggaugugcucuaacggaagccugcagugccgcaucuguauuuga

SEQ ID NO: 189526 - RNA, 1701 nt, Artificial Sequence; identical to SEQ ID NO: 185680
  derived and/or modified sequence opt5 from hemagglutinin__InfluenzaA__ADX96817

SEQ ID NO: 189527 - RNA, 1701 nt, Artificial Sequence
  derived and/or modified sequence opt5 from hemagglutinin__InfluenzaA__ADX96837
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuugucccuaugccggcgcgaaaucuuuuuacaagaaucuuauuuggcugguuaaaaagggcaacagcuauccuaaacucuccaagagcuacaucaaugacaaggggaaagaagugcugguccuuuggggcauucaucaccccuccaccucugccgaucaacagagccuguaccagaacgcugacgccuauguguucgugggauccagcagauacucuaagaaauuuaagccugagaucgcuauucggccgaaaguccgcgaucaggaggggagaaugaauuauuacuggacacucguugaacccggagacaagaucaccuucgaggccacgggcaaccugguggugccucgguaugcguuugccauggaacgcaacgcuggguccggaauuaucaucagcgauacacccguccacgacugcaauaccacaugucaaaccccuaaaggcgccauuaacaccucucugcccuuccagaauauccauccgauuacaaucggcaagugcccuaaguacgugaaaagcacgaagcucagacuggcuaccgggcuucggaacguucccuccauucagucucgcggacuguuuggcgccaucgccggguucaucgagggaggcuggacagggaugguggacggaugguauggcuaccaccaucagaaugaacaaggcagcggguacgcugcggaucucaaauccacccagaacgccauugacgagaucacaaauaaggucaacagcgugauugagaaaaugaauacccaguuuacggcuguuggaaaggaguucaaccaccuggagaagagaaucgaaaaucuuaacaaaaagguggaugacggcuuccuggauauuuggacauauaaugccgagcuccugguccugcucgaaaacgagcggacccuggacuaccacgauucuaaugugaaaaaccuuuaugagaagguccgcucccagcugaaaaacaaugccaaggaaguggggaacggauguuuugaguucuaccauaagugcgacaauaccuguauggaaagcguuaaaaacggcacauaugauuacccuaaguauucugaggaagcuaaacucaauagagaggagaucgacggggugaagcuggaauccacccggaucuaccaaauucuugccaucuacagcacagucgcguccucucuggugcucguugugagccugggcgcuauuuccuuuuggaugugcucuacgggaagccugcagugccgcaucuguauuuga

SEQ ID NO: 189528 - RNA, 1701 nt, Artificial Sequence; identical to SEQ ID NO: 185693
  derived and/or modified sequence opt5 from hemagglutinin__InfluenzaA__ADX96847

SEQ ID NO: 189529 - RNA, 1701 nt, Artificial Sequence; identical to SEQ ID NO: 185693
  derived and/or modified sequence opt5 from hemagglutinin__InfluenzaA__ADX96857

SEQ ID NO: 189530 - RNA, 1701 nt, Artificial Sequence; identical to SEQ ID NO: 185873
  derived and/or modified sequence opt5 from hemagglutinin__InfluenzaA__ADX96867

SEQ ID NO: 189531 - RNA, 1701 nt, Artificial Sequence; identical to SEQ ID NO: 188630
  derived and/or modified sequence opt5 from hemagglutinin__InfluenzaA__ADX96877

SEQ ID NO: 189532 - RNA, 1701 nt, Artificial Sequence
  derived and/or modified sequence opt5 from hemagglutinin__InfluenzaA__ADX96897
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccauccaugacugcaauacaaccugucaaaccccuaaaggcgccauuaacacaagccuccccuuccagaauauccacccgauuacgaucggcaagugcccuaaguaugucaaaucuaccaagcugagacuugcuacagggcugcggaacgugcccagcauucagucccgcggacucuuuggcgccaucgccggguucaucgagggaggcuggaccgggaugguugacggaugguacggcuaucaucaccagaaugaacaaggcucuggguacgcugcggaucugaaaagcacacagaacgccauugacaagaucaccaauaaagugaacuccgucauugagaagaugaauacgcaguuuacagcugugggaaaggaguucaaccaccuugagaaaagaaucgagaaucugaacaagaaaguugaugacggcuuccucgauauuuggaccuacaaugccgaacugcuggugcuccuggagaacgaacggacccuugacuaucaugauagcaaugucaagaaccuguacgagaaagugcgcucucagcucaagaacaaugccaaggagaucgggaacggauguuuugaguucuaucacaaaugcgacaauacauguauggaauccgucaagaacggcaccuacgauuauccuaaauacagcgaagaggcuaagcugaauagagaagagaucgacggggugaaacuugagucuacacggauuuaucaaauccuggccauuuacuccacgguugcgagcucccucgugcuggucgugucucugggcgcuaucagcuuuuggaugugcuccaacggaucucuccagugccgcauuuguaucuga

SEQ ID NO: 189533 - RNA, 1701 nt, Artificial Sequence
  derived and/or modified sequence opt5 from hemagglutinin__InfluenzaA__ADX96907
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacucugggaaacuuuguaagcugagaggaguugcuccccuccaucugggcaaaugcaauaucgccggguggauucugggaaacccugagugugaaagccucuccacagccucuagcugguccuacaucguggagaccucuagcuccgacaauggcacgugcuauccgggggauuuuauugacuacgaagaacugcgggagcagcuuagcucugucuccagcuucgaacgcuuugagaucuuccccaagaccucuuccuggccuaaccacgauagcucuaagggagugacagccgcuuguccccaugccggcgcgaaauccuuuuauaagaaucugaucuggcucguuaaaaagggcaacagcuacccuaaacuguccaagucuuauauuaaugacaaggggaaagaagugcuuguccuguggggaauccaccaccccagcaccuccgccgaucaacagagccucuaccagaacgcugacgccuacguguucgugggcacaucuagauauuccaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaaugcugggagcggaaucauuaucucugauacccccguccaugacugcaacacaaccugucaaaccccuaaaggcgccaucaacacaagccuccccuuccagaauauucacccgaucacgauuggcaagugcccuaaguaugugaaauccaccaagcugagacuugcuacagggcugcggaacguucccucuauccagagccgcggacucuuuggcgccauugccggguucaucgagggaggcuggaccgggaugguggacggaugguacggcuaucaucaccagaaugaacaaggcuccggguacgcugcggaucugaaaagcacacagaacgccaucgacaagauuaccaauaaagucaacucugugaucgagaagaugaauacgcaguuuacagcuguuggaaaggaguucaaccaccuugagaaaagaauugagaaucugaacaagaaaguggaugacggcuuccucgauaucuggaccuacaaugccgaacugcugguccuccuggagaacgaacggacccuugacuaucaugauuccaaugugaagaaccuguacgagaaaguccgcagccagcucaagaauaacgccaaggagauugggaacggauguuuugaguucuaucacaaaugcgacaauacauguauggaaucugugaagaacggcaccuacgauuauccuaaauacuccgaagaggcuaagcugaauagagaagagaucgacgggguuaaacuugagagcacacggaucuaucaaauucuggccaucuacuccacgguggcgucuagccucguccuggugguuucccugggcgcuauuucuuuuuggaugugcagcaacggaucccuccagugccgcaucuguauuuga

SEQ ID NO: 189534 - RNA, 1701 nt, Artificial Sequence
  derived and/or modified sequence opt5 from hemagglutinin__InfluenzaA__ADX96927
augaaggccauccuggugguccuccuguacaccuucgcuacagccaacgcggacacgcuuugcauuggcuaucacgcuaauaacagcaccgauacaguugacacccugcucgagaaaaaugugacagugacccauuccgucaaccugcuugaagauaagcacaaugggaaacuguguaagcucagaggaguggcuccccugcaucugggcaaaugcaacaucgccggguggauucucggaaauccugagugugaaucucugagcacagccuccucuuggagcuacaucguugagaccuccucuagcgacaacggcacgugcuauccgggggauuuuauugacuacgaagaacuucgggagcagcuguccagcgugucuuccuucgaacgcuuugagaucuuccccaagaccagcucuuggccuaaucacgauuccaacaagggagucacagccgcuuguccccaugccggcgcgaaaucuuuuuauaagaaucucaucuggcuggugaaaaagggcaacagcuacccuaaacuuuccaagagcuauauuaaugacaaggggaaagaaguucuggugcucuggggaauccaccaccccuccaccucugccgaucaacagagccuguaccagaacgcugacgccuacgucuucgugggcacauccagauauagcaagaaauuuaagccugagauugcuauccggccgaaagugcgcgaucaggaggggagaaugaauuacuauuggacccuggucgaacccggagacaagauuacguucgaggccacaggcaaccucguugugccucgguacgcguuugccauggaucgcaacgcugggucuggaaucauuaucuccgacacccccgugcaugacugcaauacaaccugucaaaccccuaaaggcgccaucaacacaagccugcccuuccagaauauucacccgaucacgauuggcaagugcccuaaguaugucaaaucuaccaaacuuagacuggcuacagggcuccggaacgugcccagcauccagucccgcggacuguuuggcgccauugccggguucaucgaaggaggcuggaccgggaugguugauggaugguacggcuaucaucaccagaaugagcaaggcucuggguacgcugcggaccuuaagagcacacagaacgccaucgaugaaauuaccaauaaggugaacuccgucaucgagaaaaugaauacgcaguuuacagcugugggaaaggaguucaaccaccuggaaaagagaauugagaaucucaacaaaaagguugacgauggcuuccuggacaucuggaccuacaaugccgaacugcucgugcugcuugagaacgaacggacccuggauuaucaugacagcaaugucaaaaaccucuacgagaaggugcgcucucagcugaaaaacaaugccaaggagauugggaacggauguuuugaguucuaucacaagugcgauaauacauguauggaguccgucaaaaacggcaccuacgacuauccuaaguacagcgaagaggcuaaacuuaauagagaagagaucgauggggugaagcuggagucuacacggaucuaucaaauucucgccaucuacuccacgguugcgagcucccuggugcuggucgugucucucggcgcuauuagcuuuuggaugugcuccaacggaucucugcagugccgcaucuguauuuga

SEQ ID NO: 189535 - RNA, 1701 nt, Artificial Sequence; identical to SEQ ID NO: 187113
  derived and/or modified sequence opt5 from hemagglutinin__InfluenzaA__ADX96937

SEQ ID NO: 189536 - RNA, 1701 nt, Artificial Sequence; identical to SEQ ID NO: 185680
  derived and/or modified sequence opt5 from hemagglutinin__InfluenzaA__ADX96947

SEQ ID NO: 189537 - RNA, 1701 nt, Artificial Sequence; identical to SEQ ID NO: 186857
  derived and/or modified sequence opt5 from hemagglutinin__InfluenzaA__ADX96957

SEQ ID NO: 189538 - RNA, 1701 nt, Artificial Sequence; identical to SEQ ID NO: 186006
  derived and/or modified sequence opt5 from hemagglutinin__InfluenzaA__ADX96967

SEQ ID NO: 189539 - RNA, 1701 nt, Artificial Sequence; identical to SEQ ID NO: 185873
  derived and/or modified sequence opt5 from hemagglutinin__InfluenzaA__ADX96977

SEQ ID NO: 189540 - RNA, 1701 nt, Artificial Sequence
  derived and/or modified sequence opt5 from hemagglutinin__InfluenzaA__ADX96987
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggauccagcagauauucuaagaaauuuaagccugagaucgcuauucggccgaaaguccgcgaucaggaggggagaaugaauuacuauuggacacucguugaacccggagacaagaucaccuucgaggccacgggcaaccugguggugccucgguacgcguuugccauggaacgcaacgcuggguccggaauuaucaucagcgauacacccguccaugacugcaauaccacaugucaaaccccuaaaggcgccauuaacaccucucugcccuuccagaauauccacccgauuacaaucggcaagugcccuaaguaugugaaaagcacgaagcucagacuggcuaccgggcuucggaacguucccuccauucagucucgcggacuguuuggcgccaucgccggguucaucgagggaggcuggacagggaugguggacggaugguacggcuaucaucaccagaaugaacaaggcagcggguacgcugcggaucucaaauccacccagaacgccauugacgagaucacaaauaaggucaacagcgugauugagaaaaugaauacccaguuuacggcuguuggaaaggaguucaaccaccuggagaagagaaucgaaaaucuuaacaaaaagguggaugacggcuuccuggauauuuggacauacaaugccgagcuccugguccugcucgaaaacgagcggacccuggacuaucaugauucuaaugugaaaaaccuuuacgagaagguccgcucccagcugaaaaacaaugccaaggaaaucgggaacggauguuuugaguucuaucacaagugcgacaauaccuguauggaaagcgugaaaaacggcacauacgauuauccuaaguacucugaggaagcuaaacucaauagagaggagaucgacgggauuaagcuggaauccacccggaucuaucaaauucuugccaucuacagcacaguugcguccucucuggugcucgucgugagccugggcgcuauuuccuuuuggaugugcucuaacggaagccugcagugccgcaucuguauuuga

SEQ ID NO: 189541 - RNA, 1701 nt, Artificial Sequence; identical to SEQ ID NO: 185873
  derived and/or modified sequence opt5 from hemagglutinin__InfluenzaA__ADX96997

SEQ ID NO: 189542 - RNA, 1701 nt, Artificial Sequence
  derived and/or modified sequence opt5 from hemagglutinin__InfluenzaA__ADX97007
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgaugcccccguccaugacugcaauaccacaugucaaaccccuaaaggcgcuaucaacaccagccuccccuuccagaauauucacccgaucacaauuggcaagugcccuaaguaugugaaaucuacgaagcugagacuugccaccgggcugcggaacguucccagcauccagucccgcggacucuuuggcgccauugcuggguucaucgagggaggcuggacagggaugguggacggaugguacggcuaucaucaccagaaugaacaaggcucuggguacgcggccgaucugaaaagcacccagaacgcuaucgacgagauuacaaauaaggucaacuccgugaucgagaaaaugaauacccaguuuacggccguuggaaaggaguucaaccaccuugagaagagaauugaaaaucugaacaaaaagguggaugacggcuuccucgauaucuggacauacaaugccgagcugcugguccuccuggaaaacgagcggacccuugacuaucaugauagcaaugugaaaaaccuguacgagaagguccgcucucagcucaaaaacaaugcuaaggaaauugggaacggauguuuugaguucuaucacaagugcgacaauaccuguauggaauccgugaaaaacggcacauacgauuauccuaaguacagcgaggaagccaaacugaauagagaggagaucgacgggguuaaacuugaaucuacccggaucuaucaaauucuggcgaucuacuccacaguggcuagcucccucguccuggugguuucucugggcgccauuagcuuuuggaugugcuccaacggaucucuccagugccgcaucuguauuuga

SEQ ID NO: 189543 - RNA, 1701 nt, Artificial Sequence; identical to SEQ ID NO: 189492
  derived and/or modified sequence opt5 from hemagglutinin__InfluenzaA__ADX97018

SEQ ID NO: 189544 - RNA, 1701 nt, Artificial Sequence
  derived and/or modified sequence opt5 from hemagglutinin__InfluenzaA__ADX97028
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaacaaggcaacagcuacccuaagcucuccaaaagcuauaucaaugacaaggggaaggaagugcugguccuuuggggcauucaccaccccuccaccacagccgaucagcagucucuguaccagaacgcugacgccuacguguucgugggaagcuccagauauagcaaaaaguuuaaaccugagaucgcuauucggccgaagguccgcgaucaagaggggagaaugaauuacuauuggacccucguugaacccggagacaaaaucacguucgaggccacaggcaaccugguggugccucgguacgcguuugccauggaacgcaacgcugggucuggaauuaucaucuccgauacccccguccaugacugcaauacaaccugucagaccccuaagggcgccauuaacacaagccugcccuuccagaauauccacccgauuacgaucggcaaaugcccuaaguaugugaagucuaccaaacucagacuggcuacagggcuucggaacguucccagcauucagucccgcggacuguuuggcgccaucgccggguucaucgagggaggcuggaccgggaugguggacggaugguacggcuaucaucaccaaaaugaacagggcucuggguacgcugcggaucucaagagcacacagaacgccauugacgagaucaccaauaaagucaacuccgugauugagaagaugaauacgcaguuuacagcuguuggaaaagaguucaaccaccuggagaagagaaucgaaaaucuuaacaagaaaguggaugacggcuuccuggauauuuggaccuacaaugccgagcuccugguccugcucgaaaacgagcggacccuggacuaucaugauagcaaugugaagaaccuuuacgagaaaguccgcucucaacugaagaacaaugccaaagaaguggggaacggauguuuugaguucuaucacaagugcgacaauacauguauggaauccguuaagaacggcaccuacgauuauccuaaauacagcgaggaagcuaagcucaauagagaggagaucgacggggugaaacuggaaucuacacggaucuaucagauucuugccaucuacuccacggcggcuagcucccugguccucgugguuucucugggcgccauuagcuuuuggaugugcuccaacggaucucugcagugccgcaucuguauuuga

SEQ ID NO: 189545 - RNA, 1701 nt, Artificial Sequence; identical to SEQ ID NO: 188246
  derived and/or modified sequence opt5 from hemagglutinin__InfluenzaA__ADX98640

SEQ ID NO: 189546 - RNA, 1701 nt, Artificial Sequence; identical to SEQ ID NO: 187245
  derived and/or modified sequence opt5 from hemagglutinin__InfluenzaA__ADX98650

SEQ ID NO: 189547 - RNA, 1701 nt, Artificial Sequence
  derived and/or modified sequence opt5 from hemagglutinin__InfluenzaA__ADX98665
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcggcaacgggacgugcuauccgggagacuuuauugauuacgaagaacugcgggagcagcuuuccagcgucucuuccuucgaacgcuuugagaucuuccccaagaccagcucuuggccuaaucacgacuccaacaagggcgugacagccgcuuguccccaugccggcgcgaaaucuuuuuauaagaaucugaucuggcucguuaaaaaggggaacagcuacccuaaacuguccaagagcuauauuaaugauaagggaaaagaagugcuuguccuguggggcauccaccaccccuccaccucugccgaccaacagagccucuaccagaacgcugaugccuacguguucguggggacauccagauauagcaagaaauuuaagccugagauugcuauccggccgaaaguccgcgaccaggagggaagaaugaauuacuauuggacccugguugaacccggcgauaagauuacguucgaggccacagggaaccugguggugccucgguacgcguuugccauggaacgcaacgcuggaucuggcaucauuaucuccgacacccccguccaugauugcaauacaaccugucaaaccccuaaaggcgccaucaacacaagccuccccuuccagaauauucacccgaucacgauugggaagugcccuaaguaugugaaaucuaccaagcugagacuugcuacaggacugcggaacguucccagcauccagucccgcggccucuuuggggccauugccggauucaucgagggcggguggaccggaaugguggacggcugguacggcuaucaucaccagaaugaacaagggucuggauacgcugcggaccugaaaagcacacagaacgccaucgaugagauuaccaauaaggucaacuccgugaucgagaaaaugaauacgcaguuuacagcuguuggcaaggaguucaaccaccuugagaagagaauugaaaaucugaacaaaaagguggacgauggguuccucgacaucuggaccuacaaugccgagcugcugguccuccuggaaaacgagcggacccuugauuaucaugacagcaaugugaaaaaccuguacgagaagguccgcucucagcucaaaaacaaugccaaggaaauuggaaacggcuguuuugaguucuaucacaagugcgauaauacauguauggaauccgugaaaaacgggaccuacgacuauccuaaguacagcgaggaagcuaaacugaauagagaggagaucgauggcguuaaacuugaaucuacacggaucuaucaaauucuggccaucuacuccacggcggcuagcucccucgugcuggucgugucucugggagccauuagcuuuuggaugugcuccaacggcucucuccagugccgcaucuguauuuga

SEQ ID NO: 189548 - RNA, 1701 nt, Artificial Sequence; identical to SEQ ID NO: 186857
  derived and/or modified sequence opt5 from hemagglutinin__InfluenzaA__ADX98675

SEQ ID NO: 189549 - RNA, 1701 nt, Artificial Sequence; identical to SEQ ID NO: 186857
  derived and/or modified sequence opt5 from hemagglutinin__InfluenzaA__ADX98695

SEQ ID NO: 189550 - RNA, 1701 nt, Artificial Sequence; identical to SEQ ID NO: 187245
  derived and/or modified sequence opt5 from hemagglutinin__InfluenzaA__ADX98729

SEQ ID NO: 189551 - RNA, 1701 nt, Artificial Sequence; identical to SEQ ID NO: 188576
  derived and/or modified sequence opt5 from hemagglutinin__InfluenzaA__ADX98739

SEQ ID NO: 189552 - RNA, 1701 nt, Artificial Sequence; identical to SEQ ID NO: 188325
  derived and/or modified sequence opt5 from hemagglutinin__InfluenzaA__ADX98748

SEQ ID NO: 189553 - RNA, 1701 nt, Artificial Sequence; identical to SEQ ID NO: 185693
  derived and/or modified sequence opt5 from hemagglutinin__InfluenzaA__ADX98758

SEQ ID NO: 189554 - RNA, 1701 nt, Artificial Sequence; identical to SEQ ID NO: 186046
  derived and/or modified sequence opt5 from hemagglutinin__InfluenzaA__ADX98767

SEQ ID NO: 189555 - RNA, 1701 nt, Artificial Sequence; identical to SEQ ID NO: 187290
  derived and/or modified sequence opt5 from hemagglutinin__InfluenzaA__ADX98777

SEQ ID NO: 189556 - RNA, 1701 nt, Artificial Sequence
  derived and/or modified sequence opt5 from hemagglutinin__InfluenzaA__ADX98785
augaaggccauccuggugguccuccuguacacccuugcuacagccaacgcggacacgcugugcauuggcuaucacgcuaauaacagcaccgauacaguugacaccgugcucgagaaaaaugugacagucacccauuccgugaaccugcuugaagauaagcacaaugggaaacuguguaagcucagaggaaucgcuccccugcaucugggcaaaugcaacauugccggguggauccucggaaauccugagugugaaucucugagcacagccuccucuuggagcuacauuguugagaccuccucuagcgacaacggcacgugcuauccgggggauuucaucgacuacgaggaacuucgggagcagcuguccagcgugucuuccuuugaacgcuucgagaucuuucccaagaccagcucuuggccuaaucacgauuccaacaagggagucacagccgcuuguccccaugccggcgcgaaaucuuucuauaagaaucucauuuggcuggugaaaaagggcaacagcuacccuaaacuuuccaagagcuauaucaaugacaaggggaaagaaguucuggugcucuggggcauucaccaccccuccaccucugccgaucaacagagccuguaccagaacgcugacgccuacgucuuugugggaacauccagauauagcaagaaauucaagccugagaucgcuauucggccgaaagugcgcgaucaggaggggagaaugaauuacuauuggacccuggucgaacccggagacaagaucacguuugaggccacaggcaaccucguugugccucgguacgcguucgccauggaacgcaacgcugggucuggaauuaucaucuccgauacccccgugcaugacugcaauacaaccugucaaaccccuaaaggcgccauuaacacaagccugcccuuucagaauauccacccgauuacgaucggcaagugcccuaaguaugucaaaucuaccaaacuuagacuggcuacagggcuccggaacgugcccagcauucagucccgcggacuguucggcgccaucgccggguuuaucgagggaggcuggaccgggaugguugacggaugguacggcuaucaucaccagaaugaacaaggcucuggguacgcugcggaucuuaagagcacacagaacgccauugacgagaucaccaauaaggugaacuccgucauugagaaaaugaauacgcaguucacagcugugggaaaggaauuuaaccaccuggagaagagaaucgaaaaucucaacaaaaagguugaugacggcuuccuggauauuuggaccuacaaugccgagcugcucgugcugcuugaaaacgagcggacccuggacuaucaugauagcaaugucaaaaaccucuacgagaaggugcgcucucagcugaaaaacaaugccaaggaaaucgggaacggauguuucgaguuuuaucacaagugcgacaauacauguauggaauccgucaaaaacggcaccuacgauuauccuaaguacagcgaggaagcuaaacuuaauagagaggagaucgggggcgugaagcuggaaucuacacggauuuaucaaauccucgccauuuacuccacgguugcgagcucccuggugcuggucgugucucucggagcuaucagcuucuggaugugcuccaacggcucucugcagugccgcauuuguaucuga

SEQ ID NO: 189557 - RNA, 1701 nt, Artificial Sequence; identical to SEQ ID NO: 186794
  derived and/or modified sequence opt5 from hemagglutinin__InfluenzaA__ADX98792

SEQ ID NO: 189558 - RNA, 1701 nt, Artificial Sequence; identical to SEQ ID NO: 186794
  derived and/or modified sequence opt5 from hemagglutinin__InfluenzaA__ADX98806

SEQ ID NO: 189559 - RNA, 1701 nt, Artificial Sequence; identical to SEQ ID NO: 188734
  derived and/or modified sequence opt5 from hemagglutinin__InfluenzaA__ADX98818

SEQ ID NO: 189560 - RNA, 1701 nt, Artificial Sequence; identical to SEQ ID NO: 185693
  derived and/or modified sequence opt5 from hemagglutinin__InfluenzaA__ADX98828

SEQ ID NO: 189561 - RNA, 1701 nt, Artificial Sequence; identical to SEQ ID NO: 189084
  derived and/or modified sequence opt5 from hemagglutinin__InfluenzaA__ADX98843

SEQ ID NO: 189562 - RNA, 1701 nt, Artificial Sequence
  derived and/or modified sequence opt5 from hemagglutinin__InfluenzaA__ADX98853
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcaucgccuccucuuggagcuacauuguggagacauccucuagcgacaacggaaccugcuauccgggggauuuuaucgacuacgaagaacugcgggagcagcuuuccagcgucucuuccuucgaacgcuuugagaucuuccccaagacgagcucuuggccuaaucacgauuccaacaagggagugaccgccgcuuguccccaugccggcgcgaaaucuuuuuauaagaaucugauuuggcucguuaaaaagggcaacagcuacccuaaacuguccaagagcuauaucaaugacaaggggaaagaagugcuuguccuguggggcauucaccaccccuccacaucugccgaucaacagagccucuaccagaacgcugacgccuacguguucgugggcaccuccagauauagcaagaaauuuaagccugagaucgcuauucggccgaaaguccgcgaucaggaggggagaaugaauuaccauuggacacugguugaacccggagacaagaucaccuucgaggccacgggcaaccugguggugccucgguaugcguuugccauggaacgcaacgcugggucuggaauuaucaucuccgauacacccguccacgacugcaauaccacaugucaaaccccuaaaggcgccauuaacaccagccuccccuuccagaauauccauccgauuacaaucggcaagugcccuaaguacgugaaaucuacgaagcugagacuugcuaccgggcugcggaacguucccagcauucagucccgcggacucuuuggcgccaucgccggguucaucgagggaggcuggacagggaugguggacggaugguauggcuaccaccaccagaaugaacaaggcucuggguaugcugcggaucugaaaagcacccagaacgccauugacaagaucacaaauaaagucaacuccgugauugagaagaugaauacccaguuuacggcuguuggaaaggaguucaaccaucuugagaaaagaaucgagaaucugaacaagaaaguggaugacggcuuccucgauauuuggacauacaaugccgaacugcugguccuccuggagaacgaacggacccuugacuaccacgauagcaaugugaagaaccuguaugagaaaguccgcucucagcucaagaacaaugccaaggagaucgggaacggauguuuugaguucuaccauaaaugcgacaauaccuguauggaauccgugaagaacggcacauaugauuacccuaaauauagcgaagaggcuaagcugaauagagaagagaucgacgggguuaaacuugagucuacccggauuuaccaaauccuggccauuuauuccacaguggcgagcucccucguccuggugguuucucugggcgcuaucagcuuuuggaugugcuccaacggaucucuccagugccgcauuuguaucuga

SEQ ID NO: 189563 - RNA, 1701 nt, Artificial Sequence; identical to SEQ ID NO: 186857
  derived and/or modified sequence opt5 from hemagglutinin__InfluenzaA__ADX98860

SEQ ID NO: 189564 - RNA, 1701 nt, Artificial Sequence; identical to SEQ ID NO: 188245
  derived and/or modified sequence opt5 from hemagglutinin__InfluenzaA__ADX98870

SEQ ID NO: 189565 - RNA, 1701 nt, Artificial Sequence
  derived and/or modified sequence opt5 from hemagglutinin__InfluenzaA__ADX98880
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccaucauugagaaaaugaauacgcaguuuacagcugugggaaaggaguucaaccaccuugagaagagaaucgaaaaucugaacaaaaagguugaugacggcuuccucgauauuuggaccuacaaugccgagcugcuggugcuccuggaaaacgagcggacccuugacuaucaugauagcaaugucaaaaaccuguacgagaaggugcgcucucagcucaaaaacaaugccaaggaaaucgggaacggauguuuugaguucuaucacaagugcgacaauacauguauggaauccgucaaaaacggcaccuacgauuauccuaaguacagcgaggaagcuaaacugaauagagaggagaucgacggggugaaacuugaaucuacacggauuuaucaaauccuggccauuuacuccacgguugcgagcucccucgugcuggucgugucucugggcgcuaucagcuuuuggaugugcuccaacggaucucuccagugccgcauuuguaucuga

SEQ ID NO: 189566 - RNA, 1701 nt, Artificial Sequence
  derived and/or modified sequence opt5 from hemagglutinin__InfluenzaA__ADX98890
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugagucugggaucauuaucuccgauacccccguccaugacugcaauacaaccugucaaaccccuaaaggagccaucaacacaagccuccccuuccagaauauucacccgaucacgauuggcaagugcccuaaguaugugaaaucuaccaagcugagacuugcuacaggccugcggaacguucccagcauccagucccgcgggcucuuuggagccauugccggcuucaucgaagggggauggaccggcaugguggacgggugguacggauaucaucaccagaaugagcaaggcucuggcuacgcugcggaucugaaaagcacacagaacgccaucgacaagauuaccaauaaagucaacuccgugaucgagaagaugaauacgcaguuuacagcuguugggaaggaguucaaccaccuugagaaaagaauugaaaaucugaacaagaaaguggaugacggauuccucgauaucuggaccuacaaugccgagcugcugguccuccuggaaaacgagcggacccuugacuaucaugauagcaaugugaagaaccuguacgagaaaguccgcucucagcucaagaacaaugccaaggaaauuggcaacggguguuuugaguucuaucacaaaugcgacaauacauguauggaauccgugaagaacggaaccuacgauuauccuaaauacagcgaggaagcuaagcugaauagagaggagaucgacggcguuaaacuugaaucuacacggaucuaucaaauucuggccaucuacuccacgguggcgagcucccucguccuggugguuucucugggggcuauuagcuuuuggaugugcuccaacggcucucuccagugccgcaucuguauuuga

SEQ ID NO: 189567 - RNA, 1701 nt, Artificial Sequence; identical to SEQ ID NO: 187245
  derived and/or modified sequence opt5 from hemagglutinin__InfluenzaA__ADX98900

SEQ ID NO: 189568 - RNA, 1701 nt, Artificial Sequence
  derived and/or modified sequence opt5 from hemagglutinin__InfluenzaA__ADX98910
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccaucuccuggucuuacauuguggagaccagcuccucugacaacggcacgugcuauccgggggauuuuaucgacuacgaagaacugcgggagcagcuuagcuccgucagcucuuucgaacgcuuugagaucuuccccaagaccuccagcuggccuaaucacgauucuaacaagggagugacagccgcuuguccccaugccggcgcgaaauccuuuuauaagaaucugauuuggcucguuaaaaagggcaacagcuacccuaaacugucuaaguccuauaucaaugacaaggggaaagaagugcuuguccuguggggcauucaccaccccagcaccuccgccgaucaacagucucucuaccagaacgcugacgccuacguguucgugggaacaagcagauauuccaagaaauuuaagccugagaucgcuauucggccgaaaguccgcgaucaggaggggagaaugaauuacuauuggacccugguugaacccggagacaagaucacguucgaggccacaggcaaccugguggugccucgguacgcguuugccauggaacgcaacgcugggagcggaauuaucaucucugauacccccguccaugacugcaauacaaccugucaaaccccuaaaggcgccauuaacacaucccuccccuuccagaauauccacccgauuacgaucggcaagugcccuaaguaugugaaaagcaccaagcugagacuugcuacagggcugcggaacguucccucuauucagagccgcggacucuuuggcgccaucgccggguucaucgagggaggcuggaccgggaugguggacggaugguacggcuaucaucaccagaaugaacaaggcuccggguacgcugcggaucugaaaucuacacagaacgccauugacaagaucaccaauaaagucaacagcgugauugagaagaugaauacgcaguuuacagcuguuggaaaggaguucaaccaccuugagaaaagaaucgagaaucugaacaagaaaguggaugacggcuuccucgauauuuggaccuacaaugccgaacugcugguccuccuggagaacgaacggacccuugacuaucaugauuccaaugugaagaaccuguacgagaaaguccgcagccagcucaagaacaaugccaaggagaucgggaacggauguuuugaguucuaucacaaaugcgacaauacauguauggaaucugugaagaacggcaccuacgauuauccuaaauacuccgaagaggcuaagcugaauagagaagagaucgacgggguuaaacuugagagcacacggauuuaucaaauccuggccauuuacucuacgguggcguccagccucguccuggugguuucccugggcgcuaucucuuuuuggaugugcagcaacggaucccuccagugccgcauuuguaucuga

SEQ ID NO: 189569 - RNA, 1701 nt, Artificial Sequence; identical to SEQ ID NO: 187245
  derived and/or modified sequence opt5 from hemagglutinin__InfluenzaA__ADX98920

SEQ ID NO: 189570 - RNA, 1701 nt, Artificial Sequence; identical to SEQ ID NO: 186857
  derived and/or modified sequence opt5 from hemagglutinin__InfluenzaA__ADX98930

SEQ ID NO: 189571 - RNA, 1701 nt, Artificial Sequence; identical to SEQ ID NO: 186484
  derived and/or modified sequence opt5 from hemagglutinin__InfluenzaA__ADX98940

SEQ ID NO: 189572 - RNA, 1701 nt, Artificial Sequence; identical to SEQ ID NO: 188313
  derived and/or modified sequence opt5 from hemagglutinin__InfluenzaA__ADX98950

SEQ ID NO: 189573 - RNA, 1701 nt, Artificial Sequence; identical to SEQ ID NO: 188294
  derived and/or modified sequence opt5 from hemagglutinin__InfluenzaA__ADX98960

SEQ ID NO: 189574 - RNA, 1701 nt, Artificial Sequence
  derived and/or modified sequence opt5 from hemagglutinin__InfluenzaA__ADX98970
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagggccucuaccagaacgcugacgccuacguguucguggggacaagcagauauuccaagaaauuuaagccugagauugcuauccggccgaaaguccgcgaucaggagggaagaaugaauuacuauuggacccugguugaacccggcgacaagauuacguucgaggccacagggaaccugguggugccucgguacgcguuugccauggaacgcaacgcuggaagcggcaucauuaucucugauacccccguccaugacugcaauacaaccugucaaaccccuaaaggcgccaucaacacaucccuccccuuccagaauauucacccgaucacgauugggaagugcccuaaguaugugaaaagcaccaagcugagacuugcuacaggacugcggaacauccccucuauucagagccgcggccucuuuggggccaucgccggauucaucgagggcggguggaccggaaugguugacggcugguacggcuaucaucaccagaaugaacaaggguccggauacgcugcggaucugaaaucuacacagaacgccauugacaagaucaccaauaaagugaacagcgucauugagaagaugaauacgcaguuuacagcugugggcaaggaguucaaccaccuugagaaaagaaucgagaaucugaacaagaaaguugaugacggguuccucgauauuuggaccuacaaugccgaacugcuggugcuccuggagaacgaacggacccuugacuaucaugauuccaaugucaagaaccuguacgagaaagugcgcagccagcucaagaacaaugccaaggagaucggaaacggcuguuuugaguucuaucacaaaugcgacaauacauguauggaaucugucaagaacgggaccuacgauuauccuaaauacuccgaagaggcuaagcugaauagagaagagaucgacggcgugaaacuugagagcacacggauuuaucaaauccuggccauuuacucuacgguugcguccagccucgugcuggucgugucccugggagcuaucucuuuuuggaugugcagcaacggcucccuccagugccgcauuuguaucuga

SEQ ID NO: 189575 - RNA, 1701 nt, Artificial Sequence; identical to SEQ ID NO: 186794
  derived and/or modified sequence opt5 from hemagglutinin__InfluenzaA__ADX98980

SEQ ID NO: 189576 - RNA, 1701 nt, Artificial Sequence; identical to SEQ ID NO: 185693
  derived and/or modified sequence opt5 from hemagglutinin__InfluenzaA__ADX98990

SEQ ID NO: 189577 - RNA, 1701 nt, Artificial Sequence; identical to SEQ ID NO: 186857
  derived and/or modified sequence opt5 from hemagglutinin__InfluenzaA__ADX99000

SEQ ID NO: 189578 - RNA, 1698 nt, Artificial Sequence
  derived and/or modified sequence opt5 from hemagglutinin__InfluenzaA__ADX99581
augaaggccaaccugcucgugcugcuuagcgcucuggccgcggcugacgccgauaccaucugcauuggcuaccacgccaauaacuccacagacacggucgauaccguucucgagaaaaaugugacagugacccauucugucaaccugcuugaagacagccacaaugggaagcuguguagacucaaaggaaucgcuccccugcagcugggcaagugcaacauugccggguggcuccugggaaauccugagugugauccgcuucugcccgugcgguccuggucuuauaucguugaaacaccuaacagcgagaauggcauuugcuaccccggggacuucaucgauuaugaagaacuccgcgagcaacuguccucugugagcuccuuugaaagauucgagaucuuuccuaaagaaagcucuuggcccaaccauaauaccaacggagucacagcugccuguucccacgagggcaagagcucuuucuaccggaaucuucuguggcucaccgagaaggaaggcuccuauccuaaacugaagaacagcuacgugaauaaaaaggggaaagagguucuggugcucuggggcauucaucacccgcccaacucuaaggaacagcagaaccuguaucagaaugagaacgcguacgucuccguggugacgagcaauuacaaccgcagauuuaccccugaaaucgccgagcggcccaagguccgcgaccaagcuggaagaaugaauuauuacuggacacuucugaaaccuggggauaccauuaucuucgaggccaacggaaaucucauugcucccauguaugccuuugcgcugucccggggcuucgggucuggaaucauuacaagcaacgccuccaugcacgaaugcaauaccaagugucagacgccgcuuggcgcuaucaacagcucucugccuuaccagaauauccaucccguuacaauuggcgagugcccuaaauaugugcgcuccgccaagcucagaauggugaccgggcugcggaacacacccagcauccagucucgcggacuguuuggcgcuauugccggguucaucgaaggaggcuggaccgggaugauugacggaugguacggcuaucaccaucaaaaugagcagggcagcggguacgccgcugaucagaaauccacccagaacgcgaucaauggaaucacaaacaaggucaacacggugauugagaaaaugaauauccaauuuaccgccguuggcaaggaguucaacaagcucgagaaaagaauggaaaaucugaacaagaaaguggacgauggguuucuugacauuuggacauacaaugcugagcugcucguccugcuugaaaacgagcggacccuggacuuccacgauucuaaugugaagaaccucuaugaaaaaguuaagagccagcugaagaauaacgccaaagagaucggaaauggcuguuucgaguuuuaccacaagugcgacaacgaauguauggaguccgugcgcaaugggacauaugauuaccccaaauauagcgaagagucuaagcugaacagagagaaagucgacggcgugaagcucgaauccaugggaauuuaccagauccuggccaucuauagcaccgucgcuucuucccuugugcugcucguuagccugggcgccauuuccuucuggaugugcucuaaugggagccugcaaugccggaucuguauuuga

SEQ ID NO: 189579 - RNA, 1698 nt, Artificial Sequence; identical to SEQ ID NO: 189578
  derived and/or modified sequence opt5 from hemagglutinin__InfluenzaA__ADX99592

SEQ ID NO: 189580 - RNA, 1698 nt, Artificial Sequence; identical to SEQ ID NO: 189578
  derived and/or modified sequence opt5 from hemagglutinin__InfluenzaA__ADX99603

SEQ ID NO: 189581 - RNA, 1698 nt, Artificial Sequence
  derived and/or modified sequence opt5 from hemagglutinin__InfluenzaA__ADX99614
augaaggccaaccugcucgugcugcuuagcgcucuggccgcggcugacgccgauaccaucugcauuggcuaccacgccaauaacuccacagacacggucgauaccguucucgagaaaaaugugacagugacccauucugucaaccugcuugaagacagccacaaugggaagcuguguagacucaaaggaaucgcuccccugcagcugggcaagugcaacauugccggguggcuccugggaaauccugagugugauccgcuucugcccgugcgguccuggucuuauaucguugaaacaccuaacagcgagaauggcauuugcuaccccggggacuucaucgauuaugaagaacuccgcgagcaacuguccucugugagcuccuuugaaagauucgagaucuuuccuaaagaaagcucuuggcccaaccauaauaccaacggagucacagcugccuguucccacgagggcaagagcucuuucuaccggaaucuucuguggcucaccgagaagaaaggcuccuauccuaagcugaaaaacagcuacgugaauaagaaagggaaggaaguucuggugcucuggggcauucaucacccgcccaacucuaaggagcagcagaaccuguaucagaaugaaaacgcguacgucuccguggugacgagcaauuacaaccgcagauuuaccccugagaucgccgaacggcccaaaguccgcgaccaagcuggaagaaugaauuauuacuggacacuucugaagccuggggauaccauuaucuucgaggccaacggaaaucucauugcucccauguaugccuuugcgcugucccggggcuucgggucuggaaucauuacaagcaacgccuccaugcacgagugcaauaccaaaugucagacgccgcuuggcgcuaucaacagcucucugccuuaccagaauauccaucccguuacaauuggcgaaugcccuaaguaugugcgcuccgccaaacucagaauggugaccgggcugcggaacacacccagcauccagucucgcggacuguuuggcgcuauugccggguucaucgagggaggcuggaccgggaugauugacggaugguacggcuaucaccaucaaaaugaacagggcagcggguacgccgcugaucagaaguccacccagaacgcgaucaauggaaucacaaacaaagucaacacggugauugagaagaugaauauccaauuuaccgccguuggcaaggaguucaacaaacucgagaagagaauggagaaucugaacaaaaagguggacgauggguuucuugacauuuggacauacaaugcugaacugcucguccugcuugagaacgaacggacccuggacuuccacgauucuaaugugaaaaaccucuaugagaagguuaagagccagcugaaaaauaacgccaaggaaaucggaaauggcuguuucgaguuuuaccacaaaugcgacaacgaguguauggaauccgugcgcaaugggacauaugauuaccccaaguauagcgaggaaucuaaacugaacagagagaaggucgacggcgugaagcucgaguccaugggaauuuaccagauccuggccaucuauagcaccgucgcuucuucccuugugcugcucguuagccugggcgccauuuccuucuggaugugcucuaaugggagccugcaaugccggaucuguauuuga

SEQ ID NO: 189582 - RNA, 1698 nt, Artificial Sequence
  derived and/or modified sequence opt5 from hemagglutinin__InfluenzaA__ADX99625
augaaggccaaccugcucgugcugcuuagcgcucuggccgcggcugacgccgauaccaucugcauuggcuaccacgccaauaacuccacagacacggucgauaccguucucgagaaaaaugugacagugacccauucugucaaccugcuugaagacagccacaaugggaagcuguguagacucaaaggaaucgcuccccugcagcugggcaagugcaacauugccggguggcuccugggaaauccugagugugauccgcuucugcccgugcgguccuggucuuauaucguugaaacaccuaacagcgagaauggcauuugcuaccccggggacuucaucgauuaugaagaacuccgcgagcaacuguccucugugagcuccuuugaaagauucgagaucuuuccuaaagaaagcucuuggcccaaccauaauaccaacggagucacagcugccuguucccacgagggcaagagcucuuucuaccggaaucuucuguggcucaccgagaaggaaggcuccuauccuaaacugaagaacagcuacgugaauaaaaaggggaaagagguucuggugcucuggggcauucaucacccgcccaacucuaaggaacagcagaaccuguaucagaaugagaacgcguacgucuccguggugacgagcaauuacaaccgcagauuuaccccugaaaucgccgagcggcccaagguccgcgaccaagcuggaagaaugaauuauuacuggacacuucugaaaccuggggauaccauuaucuucggagccaacggcaaucucauugcucccauguaugccuuugcgcugucccggggguucggaucuggcaucauuacaagcaacgccuccaugcacgagugcaauaccaagugucagacgccgcuuggcgcuaucaacagcucucugccuuaccagaauauccaucccguuacaauuggggaaugcccuaaauaugugcgcuccgccaagcucagaauggugaccggacugcggaacacacccagcauccagucucgcggccuguuuggggcuauugccggauucaucgagggcggguggaccggaaugauugacggcugguacggcuaucaccaucaaaaugaacaggggagcggauacgccgcugaucagaaauccacccagaacgcgaucaauggcaucacaaacaaggucaacacggugauugagaaaaugaauauccaauuuaccgccguugggaaggaguucaacaagcucgagaaaagaauggagaaucugaacaagaaaguggacgauggauuucuugacauuuggacauacaaugcugaacugcucguccugcuugagaacgaacggacccuggacuuccacgauucuaaugugaagaaccucuaugagaaaguuaagagccagcugaagaauaacgccaaagaaaucggcaauggguguuucgaguuuuaccacaagugcgacaacgaguguauggaauccgugcgcaauggcacauaugauuaccccaaauauagcgaggaaucuaagcugaacagagagaaagucgacggagugaagcucgaguccaugggcauuuaccagauccuggccaucuauagcaccgucgcuucuucccuugugcugcucguuagccugggggccauuuccuucuggaugugcucuaauggaagccugcaaugccggaucuguauuuga

SEQ ID NO: 189583 - RNA, 1698 nt, Artificial Sequence
  derived and/or modified sequence opt5 from hemagglutinin__InfluenzaA__ADX99636
augaaggccaaccugcucgugcugcuuagcgcucuggccgcggcugacgccgauaccaucugcauuggcuaccacgccaauaacuccacagacacggucgauaccguucucgagaaaaaugugacagugacccauucugucaaccugcuugaagacagccacaaugggaagcuguguagacucaaaggaaucgcuccccugcagcugggcaagugcaacauugccggguggcuccugggaaauccugagugugauccgcuucugcccgugcgguccuggucuuauaucguugaaacaccuaacagcgagaauggcauuugcuaccccggggacuucaucgauuaugaagaacuccgcgagcaacuguccucugugagcuccuuugaaagauucgagaucuuuccuaaagaaagcucuuggcccaaccauaauaccaacggagucacagcugccuguucccacgagggcaagagcucuuucuaccggaaucuucuguggcucaccaagaaagagggcuccuauccuaagcugaaaaacagcuacgugaauaagaaagggaaggaaguucuggugcucuggggcauucaucacccgcccaacucuaaggagcagcagaaccuguaucagaaugaaaacgcguacgucuccguggugacgagcaauuacaaccgcagauuuaccccugagaucgccgaacggcccaaaguccgcgaccaagcuggaagaaugaauuauuacuggacacuucugaagccuggggauaccauuaucuucgaggccaacggaaaucucauugcucccauguaugccuuugcgcugucccggggcuucgggucuggaaucauuacaagcaacgccuccaugcacgagugcaauaccaaaugucagacgccgcuuggcgcuaucaacagcucucugccuuaccagaauauccaucccguuacaauuggcgaaugcccuaaguaugugcgcuccgccaaacucagaauggugaccgggcugcggaacacacccagcauccagucucgcggacuguuuggcgcuauugccggguucaucgagggaggcuggaccgggaugauugacggaugguacggcuaucaccaucaaaaugaacagggcagcggguacgccgcugaucagaaguccacccagaacgcgaucaauggaaucacaaacaaagucaacacggugauugagaagaugaauauccaauuuaccgccguuggcaaggaguucaacaaacucgagaagagaauggagaaucugaacaaaaagguggacgauggguuucuugacauuuggacauacaaugcugaacugcucguccugcuugagaacgaacggacccuggacuuccacgauucuaaugugaaaaaccucuaugagaagguuaagagccagcugaaaaauaacgccaaggaaaucggaaauggcuguuucgaguuuuaccacaaaugcgacaacgaguguauggaauccgugcgcaaugggacauaugauuaccccaaguauagcgaggaaucuaaacugaacagagagaaggucgacggcgugaagcucgaguccaugggaauuuaccagauccuggccaucuauagcaccgucgcuucuucccuugugcugcucguuagccugggcgccauuuccuucuggaugugcucuaaugggagccugcaaugccggaucuguauuuga

SEQ ID NO: 189584 - RNA, 1698 nt, Artificial Sequence; identical to SEQ ID NO: 186302
  derived and/or modified sequence opt5 from hemagglutinin__InfluenzaA__ADX99647

SEQ ID NO: 189585 - RNA, 1698 nt, Artificial Sequence
  derived and/or modified sequence opt5 from hemagglutinin__InfluenzaA__ADX99680
augaaggccaaccugcucgugcugcuuugcgcucuggccgcggcugacgccgauaccaucuguauuggcuaccacgccaauaacagcacagacacggucgauaccguucucgagaaaaaugugacagugacccauuccgucaaccugcuugaagacucucacaaugggaagcugugcagacucaaaggaaucgcuccccugcagcugggcaaguguaacauugccggguggcuccugggaaauccugagugcgauccgcuucugcccgugcggagcugguccuauaucguugaaacaccuaacucugagaauggcauuuguuaccccggggacuucaucgauuaugaagaacuccgcgagcaacugagcuccgugucuagcuuugaaagauucgagaucuuuccuaaagaauccagcuggucuaaccauaauaccaacggagucacagcugccugcucccacgagggcaagagcucuuucuaccggaaucuucuguggcucaccgagaaggaaggcuccuaucccaaacugaagaacagcuacgugaauaaaaaggggaaagagguucuggugcucuggggcauucaucacccuccgaacucuaaggaacagcagaaccuguaucagaaugagaacgcguacgucuccguggugacgagcaauuacaaccgcagauuuacccccgaaaucgccgagcggccuaagguccgcgaccaagcuggaagaaugaauuauuacuggacacuucugaaacccggggauaccauuaucuucgaggccaacggaaaucucauugcuccuauguaugccuuugcgcugucccggggcuucgggucuggaaucauuacaagcaacgccuccaugcacgaauguaauaccaagugccagacgccccuuggcgcuaucaacagcucucugccguaccagaauauccauccuguuacaauuggcgagugucccaaauaugugcgcuccgccaagcucagaauggugaccgggcugcggaacaucccuagcauucagucucgcggacuguuuggcgcuaucgccggguucauugaaggaggcuggacagggaugaucgacggaugguacggcuaucaccaucaaaaugagcagggcagcggguacgccgcugaucagaaauccacccagaacgcgaucaauggaauuaccaacaaggucaacacagugaucgagaaaaugaauauucaauuuacggccguuggcaaggaguucaacaagcucgagaaaagaauggaaaaucugaacaagaaaguggacgauggguuucuugacaucuggaccuacaaugcugagcugcucguccugcuugaaaacgagcggacacuggacuuccacgauucuaaugugaagaaccucuaugaaaaaguuaagagccagcugaagaauaacgccaaagagauuggaaauggcugcuucgaguuuuaccacaagugugacaacgaaugcauggaguccgugcgcaaugggaccuaugauuaccccaaauauagcgaagagucuaagcugaacagagagaaagucgacggcgugaagcucgaauccaugggaaucuaccagauccuggccauuuauagcacagucgcuucuucccuugugcugcucguuagccugggcgccaucuccuucuggaugugcucuaaugggagccugcaaugucggauuugcaucuga

SEQ ID NO: 189586 - RNA, 1698 nt, Artificial Sequence
  derived and/or modified sequence opt5 from hemagglutinin__InfluenzaA__ADX99702
augaaggccaaccugcucgugcugcuuugcgcucuggccgcggcugacgccgauaccaucuguauuggcuaccacgccaauaacagcacagacacggucgauaccguucucgagaaaaaugugacagugacccauuccgucaaccugcuugaagacucucacaaugggaagcugugcagacucaaaggaaucgcuccccugcagcugggcaaguguaacauugccggguggcuccugggaaauccugagugcgauccgcuucugcccgugcggagcugguccuauaucguugaaacaccuaacucugagaauggcauuuguuaccccggggacuucaucgauuaugaggaacuccgcgagcaacugagcuccgugucuagcuuugaaagauucgagaucuuuccuaaagaauccagcuggcccaaccauaauaccaacggagucacagcugccugcucucacgagggcaaguccagcuucuaccggaaucuucuguggcucaccgagaaggaaggcucuuauccuaaacugaagaaauccuacgugaacaagaaagggaaggagguucuggugcucuggggcauucaucacccgcccaauagcaaggaacagcagaaccuguaucagaacgagaaugcguacgucucuguggugacguccaacuacaaucgcagauuuaccccugaaaucgccgagcggcccaaaguccgcgaccaagcuggaagaaugaacuauuacuggacacuucugaagccuggggauaccauuaucuucgaggccaauggaaaccucauugcucccauguaugccuuugcgcugagccggggcuucggguccggaaucauuacaucuaaugccagcaugcacgaauguaacaccaaaugccagacgccgcuuggcgcuaucaauuccagccugccuuaccagaacauccaucccguuacaauuggcgaguguccuaaguaugugcgcucugccaaacucagaauggugaccgggcugcggaauauccccuccauucagagccgcggacuguuuggcgcuaucgccggguucauugaaggaggcuggacagggaugaucgacggaugguacggcuaucaccaucaaaacgagcagggcucuggguacgccgcugaucaaaagagcacccagaaugcgaucaacggaauuaccaauaaagucaacacagugaucgaaaagaugaacauucaguuuacggccguuggcaaggaguucaauaaacucgagaagagaauggaaaaccugaauaaaaagguggacgauggguuucuugacaucuggaccuacaacgcugagcugcucguccugcuugaaaaugagcggacacuggacuuccacgauuccaacgugaaaaaucucuaugaaaagguuaagucucagcugaaaaacaaugccaaggagauuggaaacggcugcuucgaguuuuaccacaaaugugacaaugaaugcauggagagcgugcgcaacgggaccuaugauuaccccaaguauuccgaagagagcaaacugaauagagagaaggucgacggcgugaagcucgaaucuaugggaaucuaccagauccuggccauuuauuccacagucgcuagcucucuugugcugcucguuucccugggcgccaucagcuucuggaugugcuccaacgggucucugcaaugucggauuugcaucuga

SEQ ID NO: 189587 - RNA, 1698 nt, Artificial Sequence; identical to SEQ ID NO: 189586
  derived and/or modified sequence opt5 from hemagglutinin__InfluenzaA__ADX99843

SEQ ID NO: 189588 - RNA, 1698 nt, Artificial Sequence
  derived and/or modified sequence opt5 from hemagglutinin__InfluenzaA__ADX99854
augaaggccaaccugcucgugcugcuuugcgcucuggccgcggcugacgccgauaccaucuguauuggcuaccacgccaauaacagcacagacacggucgauaccguucucgagaaaaaugugacagugacccauuccgucaaccugcuugaagacucucacaaugggaagcugugcagacucaaaggaaucgcuccccugcagcugggcaaguguaacauugccggguggcuccugggaaauccugagugcgauccgcuucugcccgugcggagcugguccuauaucguugaaacaccuaacucugagaauggcauuuguuaccccggggacuucaucgauuaugaagaacuccgcgagcaacugagcuccgugucuagcuuugaaagauucgagaucuuuccuaaagaauccagcuggcccaaccauaauaccaacggagucacagcugccugcucucacgagggcaaguccagcuucuaccggaaucuucuguggcucaccgagaaggaaggcucuuaucugaaacugaagaacuccuacgugaauaaaaaggggaaagagguucucgugcuguggggcauucaucacccuccgaacagcaaggaacagcagaaccuuuaucagaaugagaacgcguacgucucuguggugacguccaauuacaaccgcagauuuacccccgaaaucgccgagcggccuaagguccgcgaccaagcuggaagaaugaauuauuacuggacacugcucaaacccggggauaccauuaucuucgaggccaacggaaaucugauugcuccuauguaugccuuugcgcuuagccggggcuucggguccggaaucauuacaucuaacgccagcaugcacgaauguaauaccaagugccagacgccccugggcgcuaucaacuccagccucccguaccagaauauccauccuguuacaauuggcgagugucccaaauaugugcgcucugccaagcugagaauggugaccgggcugcggaacaucccuuccauucagagccgcggacucuuuggcgcuaucgccggguucauugaaggaggcuggacagggaugaucgacggaugguacggcuaucaccaucaaaaugagcagggcucuggguacgccgcugaucagaaaagcacccagaacgcgaucaauggaauuaccaacaaggucaacacagugaucgagaaaaugaauauucaauuuacggccguuggcaaggaguucaacaagcuggagaaaagaauggaaaaucuuaacaagaaaguggacgauggguuucuggacaucuggaccuacaaugcugagcuccugguccuucuggaaaacgagcggacacucgacuuccacgauuccaaugugaagaaccuguaugaaaaaguuaagucucagcugaagaauaacgccaaagagauuggaaauggcugcuucgaguuuuaccacaagugugacaacgaaugcauggagagcgugcgcaaugggaccuaugauuaccccaaauauuccgaagagagcaagcucaacagagagaaagucgacggcgugaagcuggaaucuaugggaaucuaccagauccuugccauuuauuccacagucgcuagcucucuggugcuccugguuucccugggcgccaucagcuucuggaugugcuccaaugggucucuucaaugucggauuugcaucuga

SEQ ID NO: 189589 - RNA, 1698 nt, Artificial Sequence
  derived and/or modified sequence opt5 from hemagglutinin__InfluenzaA__ADX99865
augaaggccaaccugcucgugcugcuuugcgcucuggccgcggcugacgccgauaccaucuguauuggcuaccacgccaauaacagcacagacacggucgauaccguucucgagaaaaaugugacagugacccauuccgucaaccugcuugaagacucucacaaugggaagcugugcagacucaaaggaaucgcuccccugcagcugggcaaguguaacauugccggguggcuccugggaaauccugagugcgauccgcuucugcccgugcggagcugguccuauaucguugaaacaccuaacucugagaauggcauuuguuaccccggggacuucaucgauuaugaagaacuccgcgagcaacugagcuccgugucuagcuuugaaagauucgagaucuuuccuaaagaauccagcuggcccaaccauaauaccaacggagucacagcugccugcucucacgagggcaaguccagcuucuaccggaaucuucuguggcucaccgagaaggaaggcucuuauccuaaacagaagaacuccuacgugaauaaaaaggggaaagagguucuggugcuguggggcauucaucacccgcccaacagcaaggaacagcagaaccucuaucaaaaugagaacgcguacgucucuguggugacguccaauuacaaccgcagauuuaccccugaaaucgccgagcggcccaagguccgcgaccaggcuggaagaaugaauuauuacuggacacugcuuaaaccuggggauaccauuaucuucgaggccaacggaaaucugauugcucccauguaugccuuugcgcucagccggggcuucggguccggaaucauuacaucuaacgccagcaugcacgaauguaauaccaagugccagacgccgcugggcgcuaucaacuccagccuuccuuaccagaauauccaucccguuacaauuggcgaguguccuaaauaugugcgcucugccaagcugagaauggugaccgggcuccggaacauccccuccauucaaagccgcggacuguuuggcgcuaucgccggguucauugaaggaggcuggacagggaugaucgacggaugguacggcuaucaccaucagaaugagcagggcucuggguacgccgcugaucagaaaagcacccaaaacgcgaucaauggaauuaccaacaaggucaacacagugaucgagaaaaugaauauucaguuuacggccguuggcaaggaguucaacaagcuggagaaaagaauggaaaaucucaacaagaaaguggacgauggguuucuggacaucuggaccuacaaugcugagcuucugguccuccuggaaaacgagcggacacuugacuuccacgauuccaaugugaagaaccuguaugaaaaaguuaagucucagcucaagaauaacgccaaagagauuggaaauggcugcuucgaguuuuaccacaagugugacaacgaaugcauggagagcgugcgcaaugggaccuaugauuaccccaaauauuccgaagagagcaagcugaacagagagaaagucgacggcgugaagcuggaaucuaugggaaucuaccaaauccucgccauuuauuccacagucgcuagcucucuggugcuucugguuucccucggcgccaucagcuucuggaugugcuccaaugggucucugcagugucggauuugcaucuga

SEQ ID NO: 189590 - RNA, 1698 nt, Artificial Sequence
  derived and/or modified sequence opt5 from hemagglutinin__InfluenzaA__ADX99887
augaaggccaaccugcucgugcugcuuugcgcucuggccgcggcugacgccgauaccaucuguauuggcuaccacgccaauaacagcacagacacggucgauaccguucucgagaaaaaugugacagugacccauuccgucaaccugcuugaagacucucacaaugggaagcugugcagacucaaaggaaucgcuccccugcagcugggcaaguguaacauugccggguggcuccugggaaauccugagugcgauccgcuucugcccgugcggagcugguccuauaucguugaaacaccuaacucugagaauggcauuuguuaccccggggacuucaucgauuaugaggaacuccgcgagcaacugagcuccgugucuagcuuugaaagauucgagaucuuuccuaaagaauccagcuggcccaaccauaauaccaacggagucacagcugccugcucucacgagggcaaguccagcuucuaccggaaucuucuguggcucaccgagaaggaaggcucuuauccuaaacuggagaacuccuacgugaauaagaaagggaaggaaguucuggugcucuggggcauucaucacccgcccaacagcaaagagcagcagaaccuguaucagaaugaaaacgcguacgucucuguggugacguccaauuacaaccgcagauuuaccccugagaucgccgagcggagcaagguccgcgaccaagcuggaagaaugaauuauuacuggacacuucugaagcccggggauaccauuaucuucgaagccaacggaaaucucauugcuccuauguaugccuuugcgcugucccggggcuucgggucuggaaucauuacaagcaacgccuccaugcacgaguguaauaccaaaugccagacgccccuuggcgcuaucaacagcucucugccguaccagaauauccauccuguuacaauuggcgaaugucccaaguaugugcgcuccgccaaacucagaauggugaccgggcugcggaacaucccuagcauucagucucgcggacuguuuggcgcuaucgccggguucauugagggaggcuggacagggaugaucgacggaugguacggcuaucaccaucaaaaugaacagggcagcggguacgccgcugaucagaaguccacccagaacgcgaucaauggaauuaccaacaaagucaacacagugaucgagaagaugaauauucaauuuacggccguuggcaaagaguucaacaagcucgaaaagagaauggagaaucugaacaaaaagguggacgauggguuucuugacaucuggaccuacaaugcugaacugcucguccugcuugagaacgaacggacacuggacuuccacgauucuaaugugaaaaaccucuaugagaagguuaaaagccagcugaagaauaacgccaaggagauuggaaauggcugcuucgaauuuuaccacaaaugugacaacgagugcauggaauccgugcgcaaugggaccuaugauuaccccaaguauagcgaggagucuaaacugaacagagaaaaggucgacggcgugaaacucgaguccaugggaaucuaccagauccuggccauuuauagcacagucgcuucuucccuugugcugcucguuagccugggcgccaucuccuucuggaugugcucuaaugggagccugcaaugucggauuugcaucuga

SEQ ID NO: 189591 - RNA, 1698 nt, Artificial Sequence
  derived and/or modified sequence opt5 from hemagglutinin__InfluenzaA__ADX99898
augaaggccaaccugcucgugcugcuuugcgcucuggccgcggcugacgccgauaccaucuguauuggcuaccacgccaauaacagcacagacacggucgauaccguucucgagaaaaaugugacagugacccauuccgucaaccugcuugaagacucucacaaugggaagcugugcagacucaaaggaaucgcuccccugcagcugggcaaguguaacauugccggguggcuccugggaaauccugagugcgauccgcuucugcccgugcggagcugguccuauaucguugaaacaccuaacucugagaauggcauuuguuaccccggggacuucaucgauuaugaagaacuccgcgagcaacugagcuccgugucuagcuuugaaagauucgagaucuuuccuaaagaauccagcuggcccaaccauaauaccaacggagucacagcugccugcucucacgagggcaaguccagcuucuaccggaaucuucuguggcucaccgagaaggaaggcucuuauccuaaacugaagaacuacuaugugaauaaaaaggggaaagagguucuggugcucuggggcauucaucacccgcccaacuccaaggaacagcagaaccuguaccagaaugagaacgcguacgucagcguggugacgucuaauuauaaccgcagauuuaccccugaaaucgccgagcggcccaagguccgcgaccaagcuggaagaaugaauuacuauuggacacuucugaaaccuggggauaccauuaucuucgaggccaacggaaaucucauugcucccauguacgccuuugcgcugucccggggcuucgggagcggaaucauuacauccaacgccucuaugcacgaauguaauaccaagugccagacgccgcuuggcgcuaucaacagcucccugccuuaucagaauauccaucccguuacaauuggcgaguguccuaaauacgugcgcagcgccaagcucagaauggugaccgggcugcggaacauccccucuauucagucccgcggacuguuuggcgcuaucgccggguucauugaaggaggcuggacagggaugaucgacggaugguauggcuaccaccaucaaaaugagcagggcagcggguacgccgcugaucagaaaucuacccagaacgcgaucaauggaauuaccaacaaggucaacacagugaucgagaaaaugaauauucaauuuacggccguuggcaaggaguucaacaagcucgagaaaagaauggaaaaucugaacaagaaaguggacgauggguuucuugacaucuggaccuauaaugcugagcugcucguccugcuugaaaacgagcggacacuggacuuccacgauagcaaugugaagaaccucuacgaaaaaguuaagucccagcugaagaauaacgccaaagagauuggaaauggcugcuucgaguuuuaucacaagugugacaacgaaugcauggagucugugcgcaaugggaccuacgauuaucccaaauacagcgaagaguccaagcugaacagagagaaagucgacggcgugaagcucgaaagcaugggaaucuaucagauccuggccauuuacucuacagucgcuuccagccuugugcugcucguuucucugggcgccaucuccuucuggaugugcagcaaugggucccugcaaugucggauuugcaucuga

SEQ ID NO: 189592 - RNA, 1698 nt, Artificial Sequence
  derived and/or modified sequence opt5 from hemagglutinin__InfluenzaA__ADX99909
augaaggccaaccugcucgugcugcuuugcgcucuggccgcggcugacgccgauaccaucuguauuggcuaccacgccaauaacagcacagacacggucgauaccguucucgagaaaaaugugacagugacccauuccgucaaccugcuugaagacucucacaaugggaagcugugcagacucaaaggaaucgcuccccugcagcugggcaaguguaacauugccggguggcuccugggaaauccugagugcgauccgcuucugcccgugcggagcugguccuauaucguugaaacaccuaacucugagaauggcauuuguuaccccggggacuucaucgauuaugaagaacuccgcgagcaacugagcuccgugucuagcuuugaaagauucgagaucuuuccuaaagaauccagcuggcccaaccauaauaccaacggagucacagcugccugcucucacgagggcaaguccagcuucuaccggaaucuucuguggcucaccgagaaggaaggcucuuauccuaaacugaagaacuuuuacgugaauaaaaaggggaaagagguucuggugcucuggggcauucaucacccgcccaacuccaaggaacagcagaaccuguaucagaaugagaacgcguacgucagcguggugacgucuaauuacaaccgcagauucaccccugaaaucgccgagcggcccaagguccgcgaccaagcuggaagaaugaauuauuacuggacacuucugaaaccuggggauaccauuaucuuugaggccaacggaaaucucauugcucccauguaugccuucgcgcugucccggggcuuugggagcggaaucauuacauccaacgccucuaugcacgaauguaauaccaagugccagacgccgcuuggcgcuaucaacagcucccugccuuaccagaauauccaucccguuacaauuggcgaguguccuaaauaugugcgcagcgccaagcucagaauggugaccgggcugcggaacauccccucuauucagucccgcggacuguucggcgcuaucgccggguuuauugaaggaggcuggacagggaugaucgacggaugguacggcuaucaccaucaaaaugagcagggcagcggguacgccgcugaucagaaaucuacccagaacgcgaucaauggaauuaccaacaaggucaacacagugaucgagaaaaugaauauucaauucacggccguuggcaaggaguuuaacaagcucgagaaaagaauggaaaaucugaacaagaaaguggacgauggguuccuugacaucuggaccuacaaugcugagcugcucguccugcuugaaaacgagcggacacuggacuuccacgauagcaaugugaagaaccucuaugaaaaaguuaagucccagcugaagaauaacgccaaagagauuggaaauggcugcuuugaguucuaccacaagugugacaacgaaugcauggagucugugcgcaaugggaccuaugauuaccccaaauauagcgaagaguccaagcugaacagagagaaagucgacggcgugaagcucgaaagcaugggaaucuaccagauccuggccauuuauucuacagucgcuuccagccuugugcugcucguuucucugggcgccaucuccuuuuggaugugcagcaaugggucccugcaaugucggauuugcaucuga

SEQ ID NO: 189593 - RNA, 1698 nt, Artificial Sequence; identical to SEQ ID NO: 189592
  derived and/or modified sequence opt5 from hemagglutinin__InfluenzaA__ADX99920

SEQ ID NO: 189594 - RNA, 1698 nt, Artificial Sequence
  derived and/or modified sequence opt5 from hemagglutinin__InfluenzaA__ADX99931
augaaggccaaccugcucgugcugcuuugcgcucuggccgcggcugacgccgauaccaucuguauuggcuaccacgccaauaacagcacagacacggucgauaccguucucgagaaaaaugugacagugacccauuccgucaaccugcuugaagacucucacaaugggaagcugugcagacucaaaggaaucgcuccccugcagcugggcaaguguaacauugccggguggcuccugggaaauccugagugcgauccgcuucugcccgugcggagcugguccuauaucguugaaacaccuaacucugagaauggcauuuguuaccccggggacuucaucgauuaugaggaacuccgcgagcaacugagcuccgugucuagcuuugaaagauucgagaucuuuccuaaagaauccagcuggcccaaccauaauaccaacggagucacagcugccugcucucacgagggcaaguccagcuucuaccggaaucuucuguggcucaccgagaaggaaggcucuuauccuaaacuggagaacuccuacgugaauaagaaagggaaggaaguucuggugcucuggggcauucaucacccgcccaacagcaaagagcagcagaaccuguaucagaaugaaaacgcguacgucucuguggugacguccaauuacaaccgcagauuuaccccugagaucgccggacggcccaagguccgcgaccaagcugggagaaugaauuauuacuggacacuucugaagccuggagauaccauuaucuucgaggccaacggcaaucucauugcucccauguaugccuuugcgcugagccggggguucggauccggcaucauuacaucuaacgccagcaugcacgaauguaauaccaaaugccagacgccgcuuggcgcuaucaacuccagccugccuuaccagaauauccaucccguuacaauuggggaguguccuaaguaugugcgcucugccaaacucagaauggugaccggacugcggaacauccccuccauucagagccgcggccuguuuggggcuaucgccggauucauugaaggcggguggacaggaaugaucgacggcugguacggcuaucaccaucaaaaugagcaggggucuggauacgccgcugaucaaaagagcacccagaacgcgaucaauggcauuaccaacaaagucaacacagugaucgaaaagaugaauauucaguuuacggccguugggaaagaguucaacaagcucgagaagagaauggaaaaucugaacaaaaagguggacgauggauuucuugacaucuggaccuacaaugcugagcugcucguccugcuugaaaacgagcggacacuggacuuccacgauuccaaugugaaaaaccucuaugaaaagguuaaaucucagcugaagaauaacgccaaggagauuggcaaucgcugcuucgaguuuuaccacaaaugugacaacgaaugcauggagagcgugagaaaugggaccuaugauuaccccaaguauuccgaagagagcaaacugaaccgggagaaggucgacggcgugaaacucgaaucuaugggaaucuaccagauccuggccauuuauuccacagucgcuagcucucuugugcugcucguuucccugggcgccaucagcuucuggaugugcuccaaugggucucugcaauguagaauuugcaucuga

SEQ ID NO: 189595 - RNA, 1698 nt, Artificial Sequence
  derived and/or modified sequence opt5 from hemagglutinin__InfluenzaA__ADX99964
augaaggccaaccugcucgugcugcuuugcgcucuggccgcggcugacgccgauaccaucuguauuggcuaccacgccaauaacagcacagacacggucgauaccguucucgagaaaaaugugacagugacccauuccgucaaccugcuugaagacucucacaaugggaagcugugcagacucaaaggaaucgcuccccugcagcugggcaaguguaacauugccggguggcuccugggaaauccugagugcgauccgcuucugcccgugcggagcugguccuauaucguugaaacaccuaacucugagaauggcauuuguuaccccggggacuucaucgauuaugaggaacuccgcgagcaacugagcuccgugucuagcuuugaaagauucgagaucuuuccuaaagaauccagcuggcccaagcauaacaccaauggagucacagcugccugcucucacgagggcaaguccagcuucuaccggaaccuucuguggcucaccgagaaagaaggcucuuauccuaagcugaaaaauuccuacgugaacaagaaagggaaggagguucuggugcucuggggcauucaucacccgcccaauagcaaggaacagcagaaccuguaucagaacgagaaugcguacgucucuguggugacguccaacuacaaucgcagauuuaccccugaaaucgccgagcggcccaaaguccgcgaccaagcuggaagaaugaacuauuacuggacacuucugaagccuggggauaccauuaucuucgaggccaauggaaaccucauugcucccauguaugccuuugcgcugagccggggcuucggguccggaaucauuacaucuaaugccagcaugcacgaauguaacaccaaaugccagacgccgcuuggcgcuaucaauuccagccugccuuaccagaacauccaucccguuacaauuggcgaguguccuaaguaugugcgcucugccaaacucagaauggugaccgggcugcggaauauccccuccauucagagccgcggacuguuuggcgcuaucgccggguucauugaaggaggcuggacagggaugaucgacggaugguacggcuaucaccaucaaaacgagcagggcucuggguacgccgcugaucaaaagagcacccagaaugcgaucaacggaauuaccaauaaagucaacacagugaucgaaaagaugaacauucaguuuacggccguuggcaaggaguucaauaaacucgagaagagaauggaaaaccugaauaaaaagguggacgauggguuucuugacaucuggaccuacaacgcugagcugcucguccugcuugaaaaugagcggacacuggacuuccacgauuccaacgugaaaaaucucuaugaaaagguuaagucucagcugaaaaacaaugccaaggagauuggaaacggcugcuucgaguuuuaccacaaaugugacaaugaaugcauggagagcgugcgcaacgggaccuaugauuaccccaaguauuccgaagagagcaaacugaauagagagaaggucgacggcgugaagcucgaaucuaugggaaucuaccagauccuggccauuuauuccacagucgcuagcucucuugugcugcucguuucccugggcgccaucagcuucuggaugugcuccaacgggucucugcaaugucggauuugcaucuga

SEQ ID NO: 189596 - RNA, 1698 nt, Artificial Sequence
  derived and/or modified sequence opt5 from hemagglutinin__InfluenzaA__ADX99975
augaaggccaaccugcucgugcugcuuugcgcucuggccgcggcugacgccgauaccaucuguauuggcuaccacgccaauaacagcacagacacggucgauaccguucucgagaaaaaugugacagugacccauuccgucaaccugcuugaagacucucacaaugggaagcugugcagacucaaaggaaucgcuccccugcagcugggcaaguguaacauugccggguggcuccugggaaauccugagugcgauccgcuucugcccgugcggagcugguccuauaucguugaaacaccuaacucugagaauggcauuuguuaccccggggacuucaucgauuaugaggaacuccgcgagcaacugagcuccgugucuagcuuugaaagauucgagaucuuuccuaaagaauccagcuggcccaaccauaauaccaacggagucacagcuaccugcucucacgagggcaaguccagcuucuaccggaaucuucuguggcucacggagaaggaaggcucuuauccugagcugaaaaacuccuacgugaauaagaaagggaaggaaguucuggugcucuggggcauucaucacccgcccaacagcaaagagcagcagaaccuguaucagaaugaaaacgccuacgucucuguggugaccuccaauuacaaccgcagauuuacaccugagaucgcggagcggcccaagguccgcgaccaagccggaagaaugaauuauuacuggacccuucugaagccuggggauacaauuaucuucgaagcuaacggaaaucucauugcccccauguaugcuuuugcccugagccggggcuucggguccggaaucauuaccucuaacgcgagcaugcacgaguguaauacgaaaugccagacaccgcuuggcgccaucaacuccagccugccuuaccagaauauccaucccguuaccauuggcgaauguccuaaguaugugcgcucugcuaaacucagaauggugacagggcugcggaacauccccuccauucagagccgcggacuguuuggcgccaucgcuggguucauugagggaggcuggaccgggaugaucgacggaugguacggcuaucaccaucaaaaugaacagggcucuggguacgccgccgaucaaaagagcacccagaacgcuaucaauggaauuacaaacaaagucaacacggugaucgagaagaugaauauucaguuuaccgcgguuggcaaagaguucaacaagcucgaaaagagaauggagaaucugaacaaaaagguggacgauggguuucuugacaucuggacauacaaugccgaacugcucguccugcuugagaacgaacggacccuggacuuccacgauuccaaugugaaaaaccucuaugagaagguuaaaucucagcugaagaauaacgcuaaggagauuggaaauggcugcuucgaauuuuaccacaaaugugacaacgagugcauggaaagcgugcgcaaugggacauaugauuaccccaaguauuccgaggagagcaaacugaacagagaaaaggucgacggcgugaaacucgagucuaugggaaucuaccagauccuggccauuuauuccaccgucgccagcucucuugugcugcucguuucccugggcgcuaucagcuucuggaugugcuccaaugggucucugcaaugucggauuugcaucuga

SEQ ID NO: 189597 - RNA, 1698 nt, Artificial Sequence
  derived and/or modified sequence opt5 from hemagglutinin__InfluenzaA__ADX99986
augaaggccaaccugcucgugcugcuuugcgcucuggccgcggcugacgccgauaccaucuguauuggcuaccacgccaauaacagcacagacacggucgauaccguucucgagaaaaaugugacagugacccauuccgucaaccugcuugaagacucucacaaugggaagcugugcagacucaaaggaaucgcuccccugcagcugggcaaguguaacauugccggguggcuccugggaaauccuaaaugcgauccgcuucugcccgugcggagcugguccuauaucguugagacaccuaacucugaaaauggcauuuguuaccccggggacuucaucgauuaugaggaacuccgcgagcaacugagcuccgugucuagcuuugagagauucgaaaucuuuccuaaggaguccagcuggcccaaccauaauaccaacggagucacagcugccugcucucacgaaggcaaguccagcuucuaccggaaucuucuguggcucaccgagaaagagggcucuuauccuaagcuggaaaacuccuacgugaauaaaaaggggaaagagguucuggugcucuggggcauucaucacccgcccaacagcaaggaacagcagaaccuguaucagaaugagaacgcguacgucucuguggugacguccaauuacaaccgcagauuuaccccugaaaucgccgagcggcccaagguccgcgaccaagcuggaagaaugaauuauuacuggacacuucugaaaccuggggauaccauuaucuucgaggccaacggaaaucucauugcucccauguaugccuuugcgcugagccggggcuucggguccggaaucauuacaucuaacgccagcaugcacgaauguaauaccaagugccagacgccgcuuggcgcuaucaacuccagccugccuuaccagaauauccaucccguuacaauuggcgaguguccuaaauaugugcgcucugccaagcucagaauggugaccgggcugcggaacauccccuccauucagagccgcggacuguuuggcgcuaucgccggguucauugaaggaggcuggacagggaugaucgacggaugguacggcuaucaccaucaaaaugagcagggcucuggguacgccgcugaucagaaaagcacccagaacgcgaucaauggaauuaccaacaaggucaacacagugaucgaaaagaugaauauucaauuuacggccguuggcaaagaguucaacaagcucgagaaaagaauggaaaaucugaacaagaaaguggacgauggguuucuugacaucuggaccuacaaugcugagcugcucguccugcuugaaaacgagcggacacuggacuuccacgauuccaaugugaagaaccucuaugaaaaaguuaagucucagcugaagaauaacgccaaagagauuggaaauggcugcuucgaguuuuaccacaagugugacaacgaaugcauggagagcgugcgcaaugggaccuaugauuaccccaaauauuccgaagagagcaagcugaacagagagaaagucgacggcgugaagcucgaaucuaugggaaucuaccagauccuggccauuuauuccacagucgcuagcucucuugugcugcucguuucccugggcgccaucagcuucuggaugugcuccaaugggucucugcaaugucggauuugcaucuga

SEQ ID NO: 189598 - RNA, 1698 nt, Artificial Sequence
  derived and/or modified sequence opt5 from hemagglutinin__InfluenzaA__ADX99997
augaaggccaaccugcucgugcugcuuugcgcucuggccgcggcugacgccgauaccaucuguauuggcuaccacgccaauaacagcacagacacggucgauaccguucucgagaaaaaugugacagugacccauuccgucaaccugcuugaagacucucacaaugggaagcugugcagacucaaaggaaucgcuccccugcagcugggcaaguguaacauugccggguggcuccugggaaauccugagugcgauccgcuucugcccgugcggagcugguccuauaucguugaaacaccuaacucugagaauggcauuuguuaccccggggacuucaucgauuaugaagaacuccgcgagcaacugagcuccgugucuagcuuugaaagauucgagaucuuuccuaaagaauccagcuggcccaaccauaauaccaacggagucacagcugccugcucucacgagggcaaguccagcuucuaccggaaucuucuguggcucaccgagaaggaaggcucuuauccuaaacuggagaacuccuacgugaauaagaaagggaaggaaguucuggugcucuggggcauucaucacccgcccaacagcaaagagcagcagaaccuguaucagaaugaaaacgcguacgucucuguggugacguccaauuacaaccgcagauuuaccccugagaucgccgagcggcccaagguccgcgaccaagcuggaagaaugaaguauuacuggacacuucugaaaccuggggauaccauuaucuucgaagccaauggaaaccucauugcucccauguaugccuuugcgcugagccggggcuucggguccggaaucauuacaucuaaugccagcaugcacgaguguaacaccaagugccagacgccgcuuggcgcuaucaauuccagccugccuuaccagaacauccaucccguuacaauuggcgaauguccuaaauaugugcgcucugccaagcucagaauggugaccgggcugcggaauauccccuccauucagagccgcggacuguuuggcgcuaucgccggguucauugagggaggcuggacagggaugaucgacggaugguacggcuaucaccaucaaaacgaacagggcucuggguacgccgcugaucagaaaagcacccagaaugcgaucaacggaauuaccaauaaggucaacacagugaucgagaaaaugaacauucaauuuacggccguuggcaaggaguucaauaagcucgagaaaagaauggagaaccugaauaagaaaguggacgauggguuucuugacaucuggaccuacaacgcugaacugcucguccugcuugagaaugaacggacacuggacuuccacgauuccaacgugaagaaucucuaugagaaaguuaagucucagcugaagaacaaugccaaagagauuggaaacggcugcuucgaauuuuaccacaagugugacaaugagugcauggaaagcgugcgcaacgggaccuaugauuaccccaaauauuccgaggagagcaagcugaauagagaaaaagucgacggcgugaagcucgagucuaugggaaucuaccagauccuggccauuuauuccacagucgcuagcucucuugugcugcucguuucccugggcgccaucagcuucuggaugugcuccaacgggucucugcaaugucggauuugcaucuga

SEQ ID NO: 189599 - RNA, 1698 nt, Artificial Sequence
  derived and/or modified sequence opt5 from hemagglutinin__InfluenzaA__ADY00009
augaaggccaaccugcucgugcugcuuugcgcucuggccgcggcugacgccgauaccaucuguauuggcuaccacgccaauaacagcacagacacggucgauaccguucucgagaaaaaugugacagugacccauuccgucaaccugcuugaagacucucacaaugggaagcugugcagacucaaaggaaucgcuccccugcagcugggcaaguguaacauugccggguggcuccugggaaauccugagugcgauccgcuucugcccgugcggagcugguccuauaucguugaaacaccuaacucugagaauggcauuuguuaccccggggacuucaucgauuaugaagaacuccgcgagcaacugagcuccgugucuagcuuugaaagauucgagaucuuuccuaaagaauccagcuggcccaaccauaauaccaacggagucacagcugccugcucucacgagggcaaguccagcuucuaccggaaucuucuguggcucaccgagaagaaaggcucuuauccuaagcuggaaaacuccuacgugaauaaaaaggggaaagagguucuggugcucuggggcauucaucacccgcccaacagcaaggaacagcagaaccuguaucagaaugagaacgcguacgucucuguggugacguccaauuacaaccgcagauuuaccccugaaaucgccgagcggcccaagguccgcgaccaagcuggaagaaugaauuauuacuggacacuucugaaaccuggggauaccauuaucuucgaggccaacggaaaucucauugcucccauguaugccuuugcgcugagccggggcuucggguccggaaucauuacaucuaacgccagcaugcacgaauguaauaccaagugccagacgccgcuuggcgcuaucaacuccagccugccuuaccagaauauccaucccguuacaauuggcgaguguccuaaauaugugcgcucugccaagcucagaauggugaccgggcugcggaacauccccuccauucagagccgcggacuguuuggcgcuaucgccggguucauugaaggaggcuggacagggaugaucgacggaugguacggcuaucaccaucaaaaugagcagggcucuggguacgccgcugaucagaaaagcacccagaacgcgaucaauggaauuaccaacaaggucaacacagugaucgagaaaaugaauauucaauuuacggccguuggcaaggaguucaacaagcucgagaaaagaauggaaaaucugaacaagaaaguggacgauggguuucuugacaucuggaccuacaaugcugagcugcucguccugcuugaaaacgagcggacacuggacuuccacgauuccaaugugaagaaccucuaugaaaaaguuaagucucagcugaagaauaacgccaaagagauuggaaauggcugcuucgaguuuuaccacaagugugacaacgaaugcauggagagcgugcgcaaugggaccuaugauuaccccaaauauuccgaagagagcaagcugaacagagagaaagucgacggcgugaagcucgaaucuaugggaaucuaccagauccuggccauuuauuccacagucgcuagcucucuugugcugcucguuucccugggcgccaucagcuucuggaugugcuccaaugggucucugcaaugucggauuugcaucuga

SEQ ID NO: 189600 - RNA, 1698 nt, Artificial Sequence; identical to SEQ ID NO: 186302
  derived and/or modified sequence opt5 from hemagglutinin__InfluenzaA__ADY00020

SEQ ID NO: 189601 - RNA, 1698 nt, Artificial Sequence
  derived and/or modified sequence opt5 from hemagglutinin__InfluenzaA__ADY04727
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaagggaagcucuuggccuaaucauaccgucacaggcguguccgcuagcugcucucacaacggcaaguccagcuuuuaccgcaaucugcuuuggcugaccgggaaaaacggacucuaucccaaucugucuauguccuacguuaacaauaaggagaaagaagugcugguccucuggggcgugcaucacccuccgaacaucgggaaccagagagcccuguaccacacagagaaugcuuaugugagcgucguuuccucucauuacagccggcgcuucacccccgaaauugccaagagaccuaaagugcgggaucaggagggacgcaucaacuauuacuggacgcuucuggaacccggcgacacaauuaucuuugaggcgaaugggaaccucauugccccuugguaugcuuucgcccuguccagaggauuuggcagcggcaucauuaccucuaaugcucccaugggggagugugaugccaagugccagacaccgcaaggagcgaucaacuccagccuuccuuuccagaaugugcaccccgucaccaucggcgaauguccuaaguacgugcggucugccaaacugcgcaugguuaccgggcucagaaacauucccagcauccagucccggggacuguuuggcgcuauugccggguucaucgagggaggcuggacaggcaugguggacgggugguauggauaccaucaccagaaugaacaaggcucuggguacgcugccgaucaaaagagcacgcagaacgccauuaauggaaucaccaacaaagucaauuccgugaucgagaagaugaacacacaguuuaccgcuguuggcaaagaguucaauaagcuggaacgcagaauggagaaccucaacaaaaagguggacgauggguuccuggacauuuggacauauaaugcggaacuucugguccuccuggagaacgaacggacccuugauuuucacgacagcaaucugaagaaccucuacgagaaagugaagucucagcugaaaaauaacgccaaggaaaucggcaauggaugcuucgaguuuuaucauaaauguaacaaugagugcauggaauccgucaagaacggcacguacgacuaucccaaguacagcgaggaaucuaaacugaaucgcgagaagauugauggggugaaacucgaguccaugggaguuuaucagauccuggcuauuuacagcacaguggccuccucucuuguccugcucgugagccugggcgccaucuccuucuggaugugcucuaacgggagccugcaguguagaaucugcauuuga

SEQ ID NO: 189602 - RNA, 1701 nt, Artificial Sequence; identical to SEQ ID NO: 186637
  derived and/or modified sequence opt5 from hemagglutinin__InfluenzaA__ADY11836

SEQ ID NO: 189603 - RNA, 1701 nt, Artificial Sequence; identical to SEQ ID NO: 186612
  derived and/or modified sequence opt5 from hemagglutinin__InfluenzaA__ADY17654

SEQ ID NO: 189604 - RNA, 1701 nt, Artificial Sequence
  derived and/or modified sequence opt5 from hemagglutinin__InfluenzaA__ADY17665
augaagaccaucauugcccugagcuacauccucugccugauuuucgcucagaaacuucccggcaacgacaauuccacagccacgcugugucucgggcaccaugcggugccuaacggaaccaucgucaagacaauuaccaaugaucaaaucgagguuacaaacgcuaccgaacuggugcagucuagcuccacaggcgagaucugcgacucuccgcaccagauucuugaugggaaaaauuguacccugaucgacgcccuccugggagauccccagugcgacggcuuucaaaacaagaaaugggaucuguucguggaaagaagcaaggccuauuccaauuguuacccuuaugacguccccgauuacgcuucucuccggagccugguggccuccagcgggacgcuugaguuuaacaaugaaucuuucaacuggaccggaguuacacaggacggcaccuccagcgcuugcauucgcagaucuaaaaauuccuuuuucagccggcugaacuggcucacacaucugaauuuuaaauauccugcccuuaacgugaccaugcccaauaacgagcaguucgauaagcuguacaucuggggcguccaccauccugggacggacaaagaucagauuuuucucuaugcgcaagccucuggacgcaucacaguguccaccaagagaagccagcagacagcuauuccgaacaucggcucccggccccgcguuagaaauaucccuucucggauuagcaucuacuggaccauugugaaacccggggacauccugcugauuaacuccaccggaaaucucaucgccccucgcggcuacuucaagaucagaagcgggaagucuuccauuaugcggagcgacgcucccaucggaaaauguaacucugagugcauuacaccgaauggcagcaucccuaacgauaagcccuuucagaaugucaaccgcauuacguauggcgccuguccuagauacgugaaacaaaauacccugaaacuugcgacagggaugcggaacgugcccgaaaagcagacccgcggaaucuucggcgccaucgcuggguuuauugagaauggaugggaaggcauggucgacgggugguauggauucagacaccagaacuccgagggccggggccaagccgcugaucugaagucuacacaggccgccaucgaccagauuaaugggaaacucaacagacugaucggaaagaccaaugagaaguuccaccagauugaaaaagaguuuagcgaaguugagggccgcauccaagaucuugaaaaguacguggaggacacgaaaauugaucugugguccuauaacgcugagcuccugguggcgcuggaaaaccagcauacaaucgaccucaccgauagcgagaugaauaagcuguucgaaaagaccaagaagcagcuucgggagaacgccgaagacauggggaauggaugcuuuaaaaucuaccacaagugugauaacgcuugcauuggcucuaucagaaaugggacauaugaccaugacgucuaccgcgaugaggcccugaacaaucgguuccagauuaaaggcguggagcucaaguccggauacaaagacuggauccuguggauuagcuuugccaucucuugcuuccuucuguguguugcucuccugggcuuuaucaugugggccugccaaaaggggaacauuagauguaauaucugcauuuga

SEQ ID NO: 189605 - RNA, 1701 nt, Artificial Sequence; identical to SEQ ID NO: 186637
  derived and/or modified sequence opt5 from hemagglutinin__InfluenzaA__ADY17676

SEQ ID NO: 189606 - RNA, 1701 nt, Artificial Sequence
  derived and/or modified sequence opt5 from hemagglutinin__InfluenzaA__ADY17687
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacaggacggcaccuccagcgcuugcauccgcagaucuaaaaauuccuuuuucagccggcugaacuggcucacacaucugaauuuuaaauauccugcccuuaacgucaccaugcccaauaacgagcaguucgauaagcuguacauuuggggcgugcaccauccugggacggacaaagaucagaucuuucucuaugcgcaagccucuggacgcauuacaguuuccaccaagagaagccagcagacagcuaucccgaacauuggcucccggccccgcgugagaaauaucccuucucggaucagcauuuacuggaccaucgucaaacccggggacauucugcugaucaacuccaccggaaaucucauugccccucgcggcuacuucaagaucagaagcgggaagucuuccaucaugcggagcgacgcucccauuggaaaauguaacucugagugcaucacaccgaauggcagcauuccuaacgauaagcccuuucagaaugugaaccgcaucacguauggcgccuguccuagauacgugaaacaaaauacccugaaacuugcgacagggaugcggaacguccccgaaaagcagacccgcggaauuuucggcgccaucgcuggguuuaucgagaauggaugggaaggcaugguugacgggugguauggauucagacaccagaacuccgagggccggggccaagccgcugaucugaagucuacacaggccgccauugaccagaucaaugggaaacucaacagacugauuggaaagaccaaugagaaguuccaccagaucgaaaaagaguuuagcgaaguggagggccgcauucaagaucuugaaaaguacguggaggacacgaaaaucgaucugugguccuauaacgcugagcuccuggucgcgcuggaaaaccagcauacaauugaccucaccgauagcgagaugaauaagcuguucgaaaagaccaagaagcagcuucgggagaacgccgaagacauggggaauggaugcuuuaaaaucuaccacaagugugauaacgcuugcaucggcucuauuagaaaugggacauaugaccaugacguguaccgcgaugaggcccugaacaaucgguuccagaucaaaggcguugagcucaaguccggauacaaagacuggauucuguggaucagcuuugccauuucuugcuuccuucugugugcugcccuccugggcuuuaucaugugggcgugccaaaaggggaacaucagauguaauauuugcaucuga

SEQ ID NO: 189607 - RNA, 1701 nt, Artificial Sequence; identical to SEQ ID NO: 186612
  derived and/or modified sequence opt5 from hemagglutinin__InfluenzaA__ADY17698

SEQ ID NO: 189608 - RNA, 1701 nt, Artificial Sequence
  derived and/or modified sequence opt5 from hemagglutinin__InfluenzaA__ADY38719
augaagaccaucauugcccugagcuacauccucugccugguguucacacagaaacuucccggcaacgacaauuccacggcuacccugugucucgggcaccaugccgucccuaacggaacaauuguuaagaccaucacaaaugaucaaauugaggugaccaacgcgacagaacuggugcagucuagcuccaccggcgagaucugcgacucuccgcaccagauccuugaugggaaaaauuguacgcugauugacgcucuccugggagauccccagugcgacggcuuucaaaacaagaaaugggaucuguucgucgaaagaagcaaggccuauuccaauuguuacccuuaugacgugcccgauuacgccucucuccggagccugguugcuuccagcgggacccuugaguuuaacaaugaaucuuucaacuggacaggagugacccagaauggcacauccagcgccugcauccgcagaucuaagaacuccuuuuucagccggcugaauuggcucacccaucugaacuuuaaauauccugcucuuaaugucacgaugcccaacaacgagcaguucgacaagcuguacauuuggggcgugcaccauccugggacagauaaagaccagaucuuucucuaugcccaagcgucuggacgcauuaccguuuccacaaagagaagccagcagaccgccaucccgaauauuggcucccggccccgcgugagaaacaucccuucucggaucagcauuuacuggaccaucgucaaacccggggauauucugcugaucaauuccacaggaaaccucauugcuccucgcggcuacuucaagaucagaagcgggaagucuuccaucaugcggagcgacgcccccauuggaaaauguaauucugagugcaucacgccgaacggcagcauuccuaaugacaagcccuuucagaacgugaaucgcaucaccuauggcgcuuguccuagauacgugaaacaaaacacacugaaacuugccaccgggaugcggaauguccccgaaaaacagacacgcggaauuuucggcgcgaucgccggguuuaucgagaacggaugggaaggcaugguugaugggugguauggauucagacaccaaaauuccgagggccggggccaggcugccgaccugaagucuacccaggcugccauugaucagaucaacgggaaacucaauagacugauuggaaagacgaacgagaaguuccaccagaucgaaaaagaguuuagcgaaguggagggccgcauucaagaccuugaaaaguacguggaggauacaaaaaucgaccugugguccuauaacgccgagcuccuggucgcucuggaaaaucagcauaccauugaucucaccgacagcgagaugaacaagcuguucgaaaagacaaagaagcagcuucgggagaaugcggaagauauggggaacggaugcuuuaaaaucuaccacaagugugacaaugccugcaucggcucuauuagaaacgggaccuaugaucaugacguguaccgcgacgaggcucugaauaaccgguuccagaucaaaggcguugagcucaaguccggauacaaagauuggauucuguggaucagcuuugccauuucuugcuuccuucuguguguggcccuccugggcuuuaucaugugggcuugccaaaaggggaauaucagauguaacauuugcaucuga

SEQ ID NO: 189609 - RNA, 1701 nt, Artificial Sequence; identical to SEQ ID NO: 185693
  derived and/or modified sequence opt5 from hemagglutinin__InfluenzaA__ADY38750

SEQ ID NO: 189610 - RNA, 1701 nt, Artificial Sequence; identical to SEQ ID NO: 186857
  derived and/or modified sequence opt5 from hemagglutinin__InfluenzaA__ADY38760

SEQ ID NO: 189611 - RNA, 1701 nt, Artificial Sequence
  derived and/or modified sequence opt5 from hemagglutinin__InfluenzaA__ADZ04607
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggguguaucaaauccuggccauuuacuccacggucgcgagcucccucgugcugguugugucucugggcgcuaucagcuuuuggaugugcuccaacggaucucuccagugccgcauuuguaucuga

SEQ ID NO: 189612 - RNA, 1698 nt, Artificial Sequence; identical to SEQ ID NO: 188987
  derived and/or modified sequence opt5 from hemagglutinin__InfluenzaA__ADZ05834

SEQ ID NO: 189613 - RNA, 1698 nt, Artificial Sequence
  derived and/or modified sequence opt5 from hemagglutinin__InfluenzaA__ADZ05845
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaagccgaaucccgagaacggcaccuguuauccugggcauuuugccgacuacgaggaacugagagagcaacucuccucugucagcuccuucgaacgguuugagaucuuccccaaggagagcucuuggccuaaucacacggugaccggaguuuccgccagcugcucucauaacggcgaaaauuccuuuuaucgcaaccugcuuuggcugacaggcaaaaaugggcucuaccccaaccugagcaagucuuaugcuaauaacaaagagaaggaagugcugguccucuggggagugcaccacccuccgaacauggccgaucagaaaacccuguaccauacagagaaugcuuacguguccgucguuagcucccacuauucuagaaaguucacccccgaaaucgccaagcggccuaaagugcgcgaccaggagggcagaauuaacuacuauuggacgcuucuggagcccggggauacaaucauuuuugaagcgaauggaaaccucaucgccccucgguacgcuuucgcccugagccgcggcuuuggguccggaauuaucaauagcaacgcucccauggacaagugugaugccaaaugccagaccccgcaaggcgcgauuaauucuucccuuccuuuccagaacgugcaucccgucacaaucggcgaguguccuaaguaugugagaagcgccaaacugcggaugguuaccgggcuccgcaauauccccucuauucagagcagaggacuguuuggcgcuaucgccggguucauugaaggaggcuggaccgggaugguggacggaugguacggcuaucaccaccagaacgagcaaggcuccggguacgcugccgaucagaagucuacacagaaugccaucaacggaauuacgaauaaagucaacagcgugaucgaaaagaugaauacccaguuuacagcuguuggcaaggaguucaacaaacuggagcggcgcauggaaaaccucaauaagaaaguggacgauggguucaucgacauuuggaccuacaacgcggagcugcuuguccugcucgaaaaugagagaacacuggacuuucaugauuccaacgugaagaaucuuuaugaaaaagucaagagccaacugaagaacaaugccaaagagaucggaaacggcugcuucgaguuuuaccacaaguguaaugacgaaugcauggagucugugaaaaacgggaccuaugauuaccccaaguauuccgaagagagcaaacucaaucgggagaagauugacggcguuaagcuggaaucuaugggaguguaccagauccuggcuauuuauuccacggucgccagcucccucgugcugcuuguuucucugggcgccaucagcuucuggaugugcuccaacgggucucuccagugucgcaucugcauuuga

SEQ ID NO: 189614 - RNA, 1701 nt, Artificial Sequence; identical to SEQ ID NO: 185458
  derived and/or modified sequence opt5 from hemagglutinin__InfluenzaA__ADZ05855

SEQ ID NO: 189615 - RNA, 1701 nt, Artificial Sequence
  derived and/or modified sequence opt5 from hemagglutinin__InfluenzaA__ADZ47838
augaaggccauccuggugguccuccuguacacccuugcuacagccaacgcggacacgcugugcauuggcuaucacgcuaauaacagcaccgauacaguugacaccgugcucgagaaaaaugugacagucacccauuccgugaaccugcuugaagauaagcacaaugggaaacuguguaagcucagaggaguugcuccccugcaucugggcaaaugcaacaucgccggguggauucucggaaauccugagugugaaucucugagcacagccuccucuuggagcuacaucguggagaccuccucuagcgacaacggcacgugcuauccgggggauuucauugacuacgaggaacuucgggagcagcuguccagcgucucuuccuuugaacgcuucgagaucuuucccaagaccagcucuuggccuaaucacgauuccaacaagggagugacagccgcuuguccccaugccggcgcgaaaucuuucuauaagaaucucaucuggcugguuaaaaagggcaacagcuacccuaaacuuuccaagagcuauauuaaugacaaggggaaagaagugcugguccucuggggaauccaccaccccuccaccucugccgaucaacagagccuguaccagaacgcugacgccuacguguuugugggcacauccagauauagcaagaaauucaagccugagauugcuauccggccgaaaguccgcgagcaggaagggagaaugaauuacuauuggacccugguugagcccggagauaagauuacguuugaagccacaggcaaccucguggugccucgguacgcguucgccauggagcgcaacgcugggucuggaaucauuaucuccgacacccccguccaugauugcaauacaaccugucaaaccccuaaaggcgccaucaacacaagccugcccuuucagaauauucacucuaucacgauuggcaagugcccgaaguaugugaaaagcaccaaacuuagacuggcuacagggcuccggaacguuccuuccauccagucucgcggacuguucggcgccauugccggguuuaucgaaggaggcuggaccgggaugguggacggaugguacggcuaucaucaccagaaugagcaaggcagcggguacgcugcggaccuuaaauccacacagaacgccaucgaugagauuaccaauaaggucaacagcgugaucgaaaagaugaauacgcaguucacagcuguuggaaaggaguuuaaccaccuggaaaagagaauugagaaucucaacaaaaagguggacgauggcuuccuggacaucuggaccuacaaugccgaacugcucguccugcuugagaacgagcggacccuggauuaucaugacucuaaugugaaaaaccucuacgaaaagguccgcucccagcugaaaaacaaugccaaggagauugggaacggauguuucgaauuuuaucacaagugcgauaauacauguauggagagcgugaaaaacggcaccuacgacuaucccaaguacucugaagaggcuaaacuuaauagagaggaaaucgaugggguuaagcuggaguccacacggaucuaucaaauucucgccaucuacagcacgguggcguccucuuucguccugauugugagccugggcgcuaucuccuuuuggaugugcucuaacggaagccuccagugccgcauuuguaucuga

SEQ ID NO: 189616 - RNA, 1701 nt, Artificial Sequence; identical to SEQ ID NO: 186865
  derived and/or modified sequence opt5 from hemagglutinin__InfluenzaA__ADZ47858

SEQ ID NO: 189617 - RNA, 1698 nt, Artificial Sequence
  derived and/or modified sequence opt5 from hemagglutinin__InfluenzaA__ADZ53100
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagaccuggucuuacauuguggaaaagccgaaccccgagaauggcacguguuauccugggcauuuugccgauuacgaggaacugagagagcaacucagcuccgucucuagcuucgaacgguuugagaucuuccccaaggaguccagcuggccuaaccacaccgugacaggaguuucugccuccugcagccauaauggcgaaucuuccuuuuaucgcaaccugcuuuggcugaccggcaaaaaugggcucuaccccaaccugagcaagucuuaugcuaauaacaaagagaaggaagugcugguccucuggggagugcaccacccuccguccaucaacgaccagaaaacacuguaccauaccgagaaugccuacgugagcgucguuuccucucacuauagcagaaaguucacgcccgaaauugcuaagcggccuaaagugcgcgaucaggagggcagaaucaacuacuauuggacacuucuggagccccgggacaccauuaucuuugaagccaaugggaaccucauugcgccucgcuacgccuucgcucuguccagaggauuuggcagcgggaucauuaauucuaacgcccccauggauaagugugacgcuaaaugccagacaccgcaaggagccaucaauuccagccuuccuuuccagaacgugcaucccgucaccaucggcgaguguccuaaguaugugcggucugcgaaacugcgcaugguuaccggccucagaaauauucccagcauccagucccgggggcuguuuggagccauugcuggcuucaucgaagggggauggacaggcaugguggaugggugguacggauaucaccaccagaacgagcaaggcucuggcuacgccgcugaccaaaagagcacgcagaaugccauuaacgggaucaccaauaaagucaacuccgugaucgaaaagaugaauacacaguuuaccgccguuggaaaggaguucaacaaacuggagcgcagaauggaaaaccucaauaagaaaguggaugacggcuucauugauaucuggacauacaacgcugagcugcuuguccugcucgaaaaugagcggacccuggacuuucaugacagcaacgugaagaaucuuuaugaaaaagucaagucucagcugaagaacaaugcgaaagagauugggaacggaugcuucgaguuuuaccacaaguguaaugaugaaugcauggaguccgugaaaaacggcacguaugacuaccccaaguauagcgaagagucuaaacucaaucgcgagaagaucgaugggguuaagcuggaauccaugggcguguaccagauucuggccaucuauagcacagucgcuuccucucucgugcugcuuguuagccugggagccaucuccuucuggaugugcucuaacggcagccuccaguguagaauuugcaucuga

SEQ ID NO: 189618 - RNA, 1701 nt, Artificial Sequence; identical to SEQ ID NO: 186140
  derived and/or modified sequence opt5 from hemagglutinin__InfluenzaA__ADZ53123

SEQ ID NO: 189619 - RNA, 1701 nt, Artificial Sequence; identical to SEQ ID NO: 185935
  derived and/or modified sequence opt5 from hemagglutinin__InfluenzaA__ADZ53125

SEQ ID NO: 189620 - RNA, 1701 nt, Artificial Sequence; identical to SEQ ID NO: 186317
  derived and/or modified sequence opt5 from hemagglutinin__InfluenzaA__ADZ53127

SEQ ID NO: 189621 - RNA, 1701 nt, Artificial Sequence; identical to SEQ ID NO: 185680
  derived and/or modified sequence opt5 from hemagglutinin__InfluenzaA__ADZ53131

SEQ ID NO: 189622 - RNA, 1701 nt, Artificial Sequence; identical to SEQ ID NO: 185693
  derived and/or modified sequence opt5 from hemagglutinin__InfluenzaA__ADZ53133

SEQ ID NO: 189623 - RNA, 1701 nt, Artificial Sequence; identical to SEQ ID NO: 185935
  derived and/or modified sequence opt5 from hemagglutinin__InfluenzaA__ADZ53135

SEQ ID NO: 189624 - RNA, 1701 nt, Artificial Sequence; identical to SEQ ID NO: 186857
  derived and/or modified sequence opt5 from hemagglutinin__InfluenzaA__ADZ53138

SEQ ID NO: 189625 - RNA, 1701 nt, Artificial Sequence; identical to SEQ ID NO: 185693
  derived and/or modified sequence opt5 from hemagglutinin__InfluenzaA__ADZ53140

SEQ ID NO: 189626 - RNA, 1701 nt, Artificial Sequence; identical to SEQ ID NO: 186140
  derived and/or modified sequence opt5 from hemagglutinin__InfluenzaA__ADZ93496

SEQ ID NO: 189627 - RNA, 1689 nt, Artificial Sequence; identical to SEQ ID NO: 185374
  derived and/or modified sequence opt5 from hemagglutinin__InfluenzaA__AEA04365

SEQ ID NO: 189628 - RNA, 1689 nt, Artificial Sequence
  derived and/or modified sequence opt5 from hemagglutinin__InfluenzaA__AEA04376
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucucugugcccgaauggagcuacaucauggagaaagagaacccuagagaugggcugugcuaucccggauccuuuaaugacuacgaggaacuuaagcaucugcucucuagcgucaagcacuucgaaaaagugaagauucugccuaaagaucgguggacacaacauaccacaaccggcggcucccgcgccugugccguuucugggaaccccagcuuuuucagaaauaugguguggcuuacggagaagggauccaacuauccugucgcuaaaggcagcuacaauaacaccucuggggagcagaugcugaucauuuggggagugcaccacccgaaugacgaaacagagcagcggacccucuaucagaacguuggcacauacguguccgucgggaccagcacgcugaauaagcgcucuacacccgaaaucgccaccagaccuaaggugaacggacaaggcggccggauggaguuuuccuggacacugcucgauaugugggacaccauuaacuucgaaagcaccgggaaucugaucgcucccgaguacggauuuaaaaucucuaagcgcggcuccagcgggauuaugaaaacagagggaacgcuugaaaacugcgagaccaagugucagacaccucugggcgccaucaauaccacacuccccuuccauaacgugcacccgcugaccauuggggaaugcccuaaauaugucaaguccgagaaacuuguucuggcgacgggacucagaaaugugccccagaucgaaucucggggccuguuuggcgccauugcuggguucaucgagggaggcuggcaggggaugguggauggaugguacggcuaucaucacagcaacgaccaaggguccggcuacgccgcugauaaggagagcacacagaaggccuuugacggaaucaccaauaaagucaacucugugauugaaaagaugaauacccaguucgaggcgguuggcaaagaauuuuccaaccuggagcgcagacucgaaaaucugaacaagaaaguggaggacggguuccuugaugucuggacauauaaugccgagcugcucgugcugauggaaaacgagcggacccuugacuuccacgauagcaauguuaagaaccuguacgacaaggugcgcaugcagcucagagauaacgucaaagaacugggaaauggcuguuuugaguucuaucauaagugcgacgaugaguguaugaacucugugaaaaaugggacauacgacuacccuaaguaugaagaggaaagcaaacugaaccggaaugagaucaagggagucaagcucuccucuaugggcguguaccaaauucuggcuaucuaugccacgguugcugggagccuuucccuggccauuaugauggccggcaucagcuuuuggaugugcucuaacggaucccuccagugcagaaucuguauuuga

SEQ ID NO: 189629 - RNA, 1698 nt, Artificial Sequence
  derived and/or modified sequence opt5 from hemagglutinin__InfluenzaA__AEA10292
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugcagccugaagggaaucgcgccccuccagcugggcaacuguuccguugcuggguggauucugggaaauccugagugcgaacuccugaucucuaaagagagcugguccuacauuguggaaaagccgaaccccgagaauggcaccuguuauccugggcauuuugccgauuacgaggaacuuagagagcaacugucuagcgucuccagcuucgaacgguuugagaucuuccccaaggagucuuccuggccuaaccacacggugaccggaguuagcgccucuugcucccauaauggcgaaagcucuuuuuaucgcaaccuccuguggcuuacagugaaaaauggccuguaccccaaccucuccaagagcuaugcuaauaacaaagagaaggaaguccuggugcuguggggagugcaccacccuccgaacaucgucgaccagaaaacccucuacagaacagagaaugccuacguuuccguggugucuagccauuauucccggaaguucacccccgaaauugcuaagcgcccuaaagucagagaucaggaggggcggaucaacuacuauuggacgcugcuugagcccggcgacacaauuaucuuugaagccaaugggaaccugauugcgccucgcuacgccuucgcucucagcagaggauuuggcucugggaucauuaauuccaacgcccccauggauaagugugacgcuaaaugccagaccccgcggggagccaucaauagcucucugccuuuccaaaacgugcaccccguuacaaucggcgaguguccuaaguaugugcgcagcgcgaaacuuagaauggucaccggccugcggaauauucccuccauccagucucgcgggcucuuuggagccauugcuggcuucaucgaagggggauggaccggcaugguggaugggugguacggauaucaucaccagaacgagcagggcagcggcuacgccgcugaccaaaaguccacacagaaugccauuaacgggaucacgaauaaaguuaacagcgugaucgaaaagaugaauacccaguuuacagccgucggaaaggaguucaacaaacuggagagacggauggaaaaccugaauaagaaaguggaugacggcuucauugauaucuggaccuacaacgcugagcuccugguccuucuggaaaaugagcgcacacucgacuuucacgacucuaacgugaagaaucuguaugaaaaaguuaagucccagcuuaagaacaaugcgaaagagauugggaacggaugcuucgaguuuuaccauaaguguaaugaugaaugcauggagagcgugaaaaacggcaccuaugacuaccccaaguauucugaagaguccaaacugaauagagagaagaucgauggggucaagcucgaaagcaugggcguguaccaaauucuggccaucuauuccacgguugcuucuagccuggugcuccuggucucccuuggagccaucucuuucuggaugugcagcaacggcucccugcagugucggauuugcaucuga

SEQ ID NO: 189630 - RNA, 1701 nt, Artificial Sequence; identical to SEQ ID NO: 188292
  derived and/or modified sequence opt5 from hemagglutinin__InfluenzaA__AEA10303

SEQ ID NO: 189631 - RNA, 1701 nt, Artificial Sequence; identical to SEQ ID NO: 189146
  derived and/or modified sequence opt5 from hemagglutinin__InfluenzaA__AEA10313

SEQ ID NO: 189632 - RNA, 1701 nt, Artificial Sequence; identical to SEQ ID NO: 186857
  derived and/or modified sequence opt5 from hemagglutinin__InfluenzaA__AEA10323

SEQ ID NO: 189633 - RNA, 1701 nt, Artificial Sequence; identical to SEQ ID NO: 187245
  derived and/or modified sequence opt5 from hemagglutinin__InfluenzaA__AEA10339

SEQ ID NO: 189634 - RNA, 1701 nt, Artificial Sequence
  derived and/or modified sequence opt5 from hemagglutinin__InfluenzaA__AEA10349
augaaggccauccugauugugcuccuguacaccuucgcuacagccaacgcggacacgcuuugcaucggcuaucacgcuaauaacagcaccgauacagucgacaccguucuggagaaaaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccaagagcuauaucaaugacaaggggaaagaaguucuugugcuguggggcauucaccaccccuccaccucugccgaucaacagagccucuaccagaacgcugacgccuacgucuucgugggaacauccagauauagcaagaaauuuaagccugagaucgcuauucggccgaaagugcgcgaucaggaggggagaaugaauuacuauuggacccuggucgaacccggagacaagaucacguucgaggccacaggcaaccugguugugccucgguacgcguuugccauggaacgcaacgcugggucuggaauuaucaucuccgauacccccgugcaugacugcaauacaaccugucaaaccccuaaaggcgccauuaacacaagccuccccuuccagaauauccacccgauuacgaucggcaagugcccuaaguaugucaaaucuaccaagcugagacuugcuacagggcugcggaacgugcccagcauucagucccgcggacucuuuggcgccaucgccggguucaucgagggaggcuggaccgggaugguugacggaugguacggcuaucaucaccagaaugaacaaggcucuggguacgcugcggaucugaaaagcacacagaacgccauugacaagaucaccaauaaagugaacuccgucauugagaagaugaauacgcaguuuacagcugugggaaaggaguucaaccaccuugagaaaagaaucgagaaucugaacaagaaaguugaugacggcuuccucgauauuuggaccuacaaugccgaacugcuggugcuccuggagaacgaacggacccuugacuaucaugauagcaaugucaagaaccuguacgagaaagugcgcucucagcucaagaacaaugccaaggagaucgggaacggauguuuugaguucuaucacaaaugcgacaauacauguauggaauccgucaagaacggcaccuacgauuauccuaaauacagcgaagaggcuaagcugaauagagaagagaucgacggggugaaacuugagucuacacggauuuaucaaauccuggccauuuacuccacgguugcgagcucccucgugcuggucgugucucugggcgcuaucagcuuuuggaugugcuccaacggaucucuccagugccgcauuuguaucuga

SEQ ID NO: 189635 - RNA, 1701 nt, Artificial Sequence; identical to SEQ ID NO: 187290
  derived and/or modified sequence opt5 from hemagglutinin__InfluenzaA__AEA30293

SEQ ID NO: 189636 - RNA, 1701 nt, Artificial Sequence
  derived and/or modified sequence opt5 from hemagglutinin__InfluenzaA__AEA48989
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaauccaacaagggagugacagccgcuuguccccaugccggcgcgcggagcuuuuauaaaaaucugaucuggcucguuaagaaaggcaacucuuacccuaagcuguccaaaagcuauauuaaugauaaggggaaggaggugcuuguccuguggggaauccaccaccccuccaccucugccgaccaacagagccucuaccagaacgcugaugccuacguguucgugggcacauccagauauagcaaaaaguuuaaaccugagauugcuauccgcccgaaggucagagaccaggaagggcggaugaauuacuauuggacccugguugagcccggagauaaaauuacguucgaagccacaggcaaccugguggugccucgcuacgcguuugccauggagagaaacgcugggucuggaaucauuaucuccgacacccccguccaugauugcaauacaaccugucaaaccccuaagggcgccaucaacacaagccuccccuuccagaauauucacccgaucacgauuggcaaaugcccuaaguaugugaagucuaccaaacugcggcuugcuacagggcugcgcaacguucccagcauccaguccagaggacucuuuggcgccauugccggguucaucgaaggaggcuggaccgggaugguggacggaugguacggcuaucaucaccagaaugagcaaggcucuggguacgcugcggaccuuaagagcacacagaacgccaucgaugagauuaccaauaaagucaacuccgugaucgaaaagaugaauacgcaguuuacagcuguuggaaaagaguucaaccaccuggaaaagcggauugagaaucugaacaagaaaguggacgauggcuuccucgacaucuggaccuacaaugccgaacugcugguccuccuggagaacgagcgcacccuugauuaucaugacagcaaugugaagaaccuguacgaaaaagucagaucucagcucaagaacaaugccaaagagauugggaacggauguuuugaguucuaucacaagugcgauaauacauguauggaguccgugaagaacggcaccuacgacuauccuaaauacagcgaagaggcuaagcugaaucgggaggaaaucgaugggguuaaacuugagucuacacgcaucuaucaaauucuggccaucuacuccacgguggcgagcucccucguccuggugguuucucugggcgcuauuagcuuuuggaugugcuccaacggaucucuccagugcagaaucuguauuuga

SEQ ID NO: 189637 - RNA, 1707 nt, Artificial Sequence
  derived and/or modified sequence opt5 from hemagglutinin__InfluenzaA__AEA50985
auggagaagaucgugcugcuccuggccauuaucaaccuugucaaaagcgaccagauuugcaucggcuaccacgcuaauaacuccaccgaacaaguugauacaauuauggagaagaaugugacggugacccaugcccaggacauccuggaaaagacacacaacgggaaacucugugaucuggacggagucaaaccccuuauccugagagauugcucuguggcgggcuggcuccuggggaauccuaugugugacgaguuccugaacguuccggaauggagcuauauuguggagaagaucaaucccgcuaacgaucucugcuacccuggaaauuuuaacgacuaugaggaacugaagcaucuucugucccggauuaaucacuucgagaaaauccagauuauccccaagucuagcugguccgaucaugaagccucuagcggcgucuccagcgccuguccuuaccaggggagaucuuccuuuuuccgcaacgugguuuggcucauuaaaaagaaugacgcuuaucccaccaucaaaaucagcuacaacaauacaaaccaagaggaucugcuugugcuguggggcauucaccacccuaacgacgccgcugagcagaccaagcucuaucagaauccgacaaccuacaucucugucggaacguccacccugaaccugcggcucgugcccaagauugccacacgcagcaaagugaauggccagucugggagaauggaauuuuucuggaccauccugaagccuaacgaugcgauuaauuuugaguccaacggaaauuucaucgcccccgaaaacgcuuacaaaaucgucaagaaaggcgacagcacaauuaugaaguccgagcuugaauaugggaauugcaacaccaaaugucaaacgccuguuggagccaucaauucuagcaugcccuuucauaacauucacccgcugacaaucggcgagugcccuaaguacgugaaguccaaucggcucgugcuggcuaccgggcuucgcaacagcccccagggagagagacggcgcaaaaagagaggccuguucggcgccauugcgggguuuaucgaaggaggcuggcaggggauggucgacggaugguauggcuaccaucacucuaaugagcagggguccggauaugccgcugauaaagaaagcacacaaaaggccaucaacggcgugaccaacaaaguuaauucuauuaucgacaagaugaacacccaguucgaggcugugggccgggaauuuaauaaccucgagcgcagaauugagaaucugaacaagaaaauggaagauggguuccuggacgucuggacauacaaugccgagcuccuggugcuuauggaaaacgagcggacgcuggauuuccacgacagcaauguuaagaaccucuaugauaaagugcgccugcagcuuagagacaaugccaaggaacugggaaacggcuguuuugaguucuaccaucggugcgauaaugaguguauggaauccgucagaaacgggaccuacgacuauccucaauacucugaggaaagccgccucaaacgggaggagaucuccggagugaagcuggaaagcauuggcaucuaucagauucugucuaucuacuccacagcugcgagcucucucgcccuggcuaucauggucgccgggcuuucccuguggaugugcagcaauggcucccuccagugcagaauuuguaucuga

SEQ ID NO: 189638 - RNA, 1701 nt, Artificial Sequence; identical to SEQ ID NO: 188557
  derived and/or modified sequence opt5 from hemagglutinin__InfluenzaA__AEA72704

SEQ ID NO: 189639 - RNA, 1701 nt, Artificial Sequence; identical to SEQ ID NO: 188557
  derived and/or modified sequence opt5 from hemagglutinin__InfluenzaA__AEA72715

SEQ ID NO: 189640 - RNA, 1701 nt, Artificial Sequence; identical to SEQ ID NO: 188557
  derived and/or modified sequence opt5 from hemagglutinin__InfluenzaA__AEA72726

SEQ ID NO: 189641 - RNA, 1701 nt, Artificial Sequence
  derived and/or modified sequence opt5 from hemagglutinin__InfluenzaA__AEA72740
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuacccggccgaaaguccgcgaucaggaggggagaaugaauuacuauuggacgcugguugaacccggagacaagaucacauucgaggccaccggcaaccugguggugccucgguacgcguuugccauggaacgcaacgcugggucuggaauuaucauuuccgauacacccguccaugacugcaauaccaccugucaaacaccuaaaggcgccaucaacacgagccuccccuuccagaauauccacccgauuaccaucggcaagugcccuaaguaugugaaaucuacaaagcugagacuugcuaccgggcugcggaacguucccagcauucagucccgcggacucuuuggcgccaucgccggguucauugagggaggcuggacagggaugguggacggaugguacggcuaucaucaccagaaugaacaaggcucuggguacgcugcggaucugaaaagcacccagaacgccaucgacgagaucacgaauaaggucaacuccgugauugagaaaaugaauacacaguuuaccgcuguuggaaaggaguucaaccaccuugagaagagaaucgaaaaucugaacaaaaagguggaugacggcuuccucgauauuuggaccuacaaugccgagcugcugguccuccuggaaaacgagcggacacuugacuaucaugauagcaaugugaaaaaccuguacgagaagguccgcaaccagcucaaaaauaacgccaaggaaaucgggaauggauguuuugaguucuaucacaagugcgacaacaccuguauggaaucugugaaaaauggcacauacgauuauccuaaguacuccgaggaagcuaaacugaacagagaggagauugacgggguuaaacuugaaagcacgcggaucuaucaaauccuggccauuuacucuaccguggcguccagccucguccuggugguuucccugggcgcuaucucuuuuuggaugugcagcaauggaucccuccagugccgcauuuguaucuga

SEQ ID NO: 189642 - RNA, 1701 nt, Artificial Sequence
  derived and/or modified sequence opt5 from hemagglutinin__InfluenzaA__AEA72750
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggucuuuauugauuacgaagaacugcgggagcagcuuuccagcgugucuuccuucgaacgcuuugagaucuuccccaagaccagcucuuggccuaaucacgacuccaacaagggaguuacagccgcuuguccccaugccggcgcgaaaucuuuuuauaagaaucugaucuggcucgugaaaaagggcaacagcuacccuaaacuguccaagagcuauauuaaugauaaggggaaagaaguccuugugcuguggggaauccaccaccccuccaccacagccgaccaacagucucucuaccagaacgcugauaccuacguguucgucggcacgagcagauauuccaagaaauuuaagccugagauugccauccggccgaaaguucgcgaccaggaggggagaaugaauuacuauuggacacugguggaacccggagauaagauuaccuucgaggcuacaggcaaccugguggucccucgguacgccuuugcgauggaacgcaacgccgggagcggaaucauuaucucugacacccccgugcaugauugcaauaccacaugucaaacgccuaaaggcgcuaucaacaccucccuccccuuccagaauauucacccgaucacaauuggcaagugcccuaaguauguuaaaagcaccaagcugagacuugccacagggcugcggaacgugcccucuauccagagccgcggacucuuuggcgcuauugccggguucaucgagggaggcuggaccgggauggucgacggaugguacggcuaucaucaccagaaugaacaaggcuccggguacgccgcugaccugaaaucuacgcagaacgcgaucgauaagauuacaaauaaagugaacagcguuaucgagaagaugaauacccaguuuaccgccgugggaaaggaguucaaccaccuugagaaaagaauugagaaucugaacaagaaagucgacgauggcuuccucgacaucuggacauacaaugcugaacugcuggugcuccuggagaacgaacggacccuugauuaucaugacuccaaugucaagaaccuguacgagaaagugcgcaaccagcucaagaauaacgccaaggagauugggaauggauguuuugaguucuaucacaaaugcgauaacacauguauggaaagcguuaagaauggcacguacgacuauccuaaauacucugaagaggccaagcugaacagagaagagaucgauggggugaaacuugaguccacccggaucuaucaaauucuggcuaucuacagcacagucgccucuucccucgugcugguugugagccugggcgcgauuuccuuuuggaugugcucuaauggaagccuccagugccgcaucuguauuuga

SEQ ID NO: 189643 - RNA, 1701 nt, Artificial Sequence; identical to SEQ ID NO: 189459
  derived and/or modified sequence opt5 from hemagglutinin__InfluenzaA__AEA72759

SEQ ID NO: 189644 - RNA, 1701 nt, Artificial Sequence
  derived and/or modified sequence opt5 from hemagglutinin__InfluenzaA__AEA72777
augaaggccauccuggugguccuccuguacacccuugcuacagccaacgcggacacgcugugcauuggcuaucacgcuaauaacagcaccgauacaguugacaccgugcucgagaaaaaugugacagucacccauuccgugaaccugcuugaagauaagcacgacgggaaacuguguaagcucagaggaguugcuccccugcaucugggcaaaugcaauaucgccggguggauucucggaaacccugagugugaaucucugagcacagccuccucuuggagcuacaucguggagaccuccucuagcgauaauggcacgugcuauccgggggacuucauugauuacgaggaacuucgggagcagcuguccagcgucucuuccuuugaacgcuucgagaucuuucccaagaccagcucuuggccuaaccacgacuccaauaagggagugacagccgcuuguccccaugccggcgcgaaauccuucuauaagaaccucaucuggcugguuaaaaagggcaauucuuacccuaaacuuuccaagagcuauauuaacgauaaggggaaagaaauccuggugcucuggggcauucaccaccccuccaccucugccgaccaacagagccuguaccagaaugcugaugccuacgucuuugugggaacauccagauauagcaagaaauucaagccugagaucgcuauucggccgaaagugcgcgaccaggaggggagaaugaacuacuauuggacccuggucgaacccggagauaagaucacguuugaggccacaggcaaucucguugugccucgguacgcguucgccauggaacgcaacgcugggucuggaauuaucaucuccgacacccccgugcaugacugcaacgccacaugucaaaccccuaaaggcgcuauuaauaccagccugcccuuucagaacauccacccgauuacaaucggcaagugcccuaaguaugucaaaucuacgaaacuuagacuggccaccgggcuccggaaugugcccagcauucagucccgcggacuguucggcgccaucgcuggguuuaucgagggaggcuggacagggaugguugauggaugguacggcuaucaucaccagaacgaacaaggcucuggguacgcggccgaccuuaaaagcacccagaaugcuauugauaagaucacaaacaaagugaauagcgucauugagaagaugaacacccaguucacggccgugggaaaggaguuuaaucaccuggaaaagagaaucgagaaccucaauaagaaaguugacgauggcuuccuggacauuuggacauacaacgccgaacugcucgugcugcuugagaaugaacggacccuggauuaucaugacagcaacgucaagaaucucuacgagaaagugcgcucucagcugaagaacaacgcuaaggagaucgggaauggauguuucgaauuuuaucacaaaugcgauaacaccuguauggaguccgucaagaauggcacauacgacuauccuaaauacagcgaagaggccaaacuuaacagagaagagaucgauggggugaagcuggagucuacccggauuuaucaaauccucgcgauuuacuccacaguugcuagcucccuggugcuggucgugucucucggcgccaucagcuucuggaugugcuccaauggaucucugcagugccgcauuuguaucuga

SEQ ID NO: 189645 - RNA, 1701 nt, Artificial Sequence; identical to SEQ ID NO: 189459
  derived and/or modified sequence opt5 from hemagglutinin__InfluenzaA__AEA72787

SEQ ID NO: 189646 - RNA, 1701 nt, Artificial Sequence; identical to SEQ ID NO: 188557
  derived and/or modified sequence opt5 from hemagglutinin__InfluenzaA__AEA73288

SEQ ID NO: 189647 - RNA, 1701 nt, Artificial Sequence; identical to SEQ ID NO: 188557
  derived and/or modified sequence opt5 from hemagglutinin__InfluenzaA__AEA73299

SEQ ID NO: 189648 - RNA, 1701 nt, Artificial Sequence; identical to SEQ ID NO: 188557
  derived and/or modified sequence opt5 from hemagglutinin__InfluenzaA__AEA73310

SEQ ID NO: 189649 - RNA, 1701 nt, Artificial Sequence
  derived and/or modified sequence opt5 from hemagglutinin__InfluenzaA__AEA73321
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaauuuuaaguauccugcccuuaacgucaccaugcccaacaaugagcaguucgacaagcuguacauuuggggcgugcaccauccugggacggauaaagaccagaucuuucucuaugcgcaagccucuggacgcauuacaguuuccaccaagagaagccagcaggcugugaucccgaacauuggcucccggccccgcgucagaaauaucccuucucggaucagcauuuacuggacaaucgugaaacccggggauauucugcugaucaacuccaccggaaaucucauugccccucgcggcuacuucaagaucagaagcgggaaaucuuccaucaugcggagcgacgcucccauuggaaaguguaacucugaaugcaucaccccgaauggcagcauuccuaacgacaagcccuuucagaaugugaaccgcaucacauauggcgccuguccuagauacgucaaacaauccacgcugaagcuggcgaccgggaugcggaauguucccgagaaacagacacgcggaauuuucggcgccaucgcuggguuuaucgaaaacggaugggagggcaugguggaugggugguauggauucagacaccaaaauucugagggccggggccaggccgcugaccuuaagagcacccaggccgccauugaucagaucaacgggaaacucaauagacugauuggaaagacaaacgaaaaauuccaccagaucgagaaggaauuuuccgagguggaaggccgcauucaagaccuugagaaguacgucgaggauaccaaaaucgaccuguggagcuauaacgcugaacuccuggugacgcuggagaaucagcauacaauugaucucaccgacucugaaaugaacaagcuguucgagaaaaccaagaaacagcuucgggaaaaugcggaggauauggggaacggaugcuuuacaaucuaccacaagugugacaaugccugcaucggcuccauuagaaacgggaccuaugaucauaauguuuaccgcgacgaggcucugaacaaucgguuccagaucaagggcguggaacucaaaagcggauacaaggacuggauucuguggaucucuuuugccauuuccugcuuccuucugugugucgcccuccugggcuuuaucaugugggcuugccaaaaagggaacaucagauguaauauuugcaucuga

SEQ ID NO: 189650 - RNA, 1701 nt, Artificial Sequence; identical to SEQ ID NO: 188557
  derived and/or modified sequence opt5 from hemagglutinin__InfluenzaA__AEA73332

SEQ ID NO: 189651 - RNA, 1701 nt, Artificial Sequence; identical to SEQ ID NO: 188557
  derived and/or modified sequence opt5 from hemagglutinin__InfluenzaA__AEA73343

SEQ ID NO: 189652 - RNA, 1701 nt, Artificial Sequence; identical to SEQ ID NO: 188557
  derived and/or modified sequence opt5 from hemagglutinin__InfluenzaA__AEA73354

SEQ ID NO: 189653 - RNA, 1701 nt, Artificial Sequence
  derived and/or modified sequence opt5 from hemagglutinin__InfluenzaA__AEA73365
augaagaccaucauugcccugagcuacacacucugccugguguucgcucagaaacuucccggcaacgacaauuccacggccacccugugucucgggcaccaugcggucccuaacggaacaaucguuaagaccauuacaaaugaucaaaucgaggugaccaacgcuacagaacuggugcagucuagcuccaccggcgagauuugcgacucuccgcaccagauccuugauggggaaaauuguacgcugaucgacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacccuugaauuuaacaaugagucuuucaacuggacaggagugacccagaauggcacauccagcgcuugcauucgcagaucuaacaauuccuuuuucagccggcugaacuggcucacccaucugaauuuuaaguauccugcccuuaacgucacgaugcccaacaaugagcaguucgacaagcuguacaucuggggcgugcaccauccugggacagauaaagaccagauuuuucucuaugcgcaagccucuggacgcaucaccguuuccacaaagagaagccagcaggcugugauuccgaacaucggcucccggccccgcgucagaaauauuccuucucggaucagcaucuacuggaccauugugaaacccggggauauccugcugauuaacuccaccggaaaucucaucgccccucgcggcuacuucaagauuagaagcgggaaaucuuccaucaugcggagcgacgcucccaucggaaaguguaacucugaaugcauuacaccgaauggcagcaucccuaacgacaagcccuuucagaaugugaaccgcauuacguauggcgccuguccuagauacgucaaacaauccacccugaagcuggcgacagggaugcggaauguucccgagaaacagacccgcggaaucuucggcgccauugcuggguuuaucgaaaacggaugggagggcaugguggaugggugguauggauucagacaccaaaauucugagggccggggccaggccgcugaccuuaagagcacacaggccgccaucgaucagauuaacgggaaacucaauagacugaucggaaagaccaacgaaaaauuccaccagauugagaaggaauuuuccgagguggaaggccgcauccaagaccuugagaaguacgucgaggauacgaaaauugaccuguggagcuauaacgcugaacuccugguggcgcuggagaaucagcauacaaucgaucucaccgacucugaaaugaacaagcuguucgagaaaaccaagaaacagcuucgggaaaaugccgaggauauggggaacggaugcuuuacaauuuaccacaagugugacaaugcuugcaucggcuccaucagaaacgggaccuaugaucauaauguuuaccgcgacgaggcccugaacaaucgguuccagauuaagggcguggaacucaaaagcggauacaaggacuggauccuguggauuucuuuugccaucuccugcuuccuucugugugucgcucuccugggcuuuauuaugugggccugccaaaaagggaacaucagauguaauaucugcauuuga

SEQ ID NO: 189654 - RNA, 1701 nt, Artificial Sequence; identical to SEQ ID NO: 188557
  derived and/or modified sequence opt5 from hemagglutinin__InfluenzaA__AEA73376

SEQ ID NO: 189655 - RNA, 1701 nt, Artificial Sequence; identical to SEQ ID NO: 188557
  derived and/or modified sequence opt5 from hemagglutinin__InfluenzaA__AEA73387

SEQ ID NO: 189656 - RNA, 1701 nt, Artificial Sequence; identical to SEQ ID NO: 188557
  derived and/or modified sequence opt5 from hemagglutinin__InfluenzaA__AEA73398

SEQ ID NO: 189657 - RNA, 1701 nt, Artificial Sequence; identical to SEQ ID NO: 188557
  derived and/or modified sequence opt5 from hemagglutinin__InfluenzaA__AEA73409

SEQ ID NO: 189658 - RNA, 1701 nt, Artificial Sequence; identical to SEQ ID NO: 188557
  derived and/or modified sequence opt5 from hemagglutinin__InfluenzaA__AEA73420

SEQ ID NO: 189659 - RNA, 1701 nt, Artificial Sequence; identical to SEQ ID NO: 188557
  derived and/or modified sequence opt5 from hemagglutinin__InfluenzaA__AEA73452

SEQ ID NO: 189660 - RNA, 1701 nt, Artificial Sequence; identical to SEQ ID NO: 188557
  derived and/or modified sequence opt5 from hemagglutinin__InfluenzaA__AEA73463

SEQ ID NO: 189661 - RNA, 1701 nt, Artificial Sequence; identical to SEQ ID NO: 188557
  derived and/or modified sequence opt5 from hemagglutinin__InfluenzaA__AEA73474

SEQ ID NO: 189662 - RNA, 1701 nt, Artificial Sequence
  derived and/or modified sequence opt5 from hemagglutinin__InfluenzaA__AEA73485
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagcccauuccaauuguuauccuuacgacgugcccgauuaugcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaccugaauuuuaaguacccugcccuuaacgucaccaugcccaacaaugagcaguucgacaagcuguauauuuggggcgugcaucacccugggacggauaaagaccagaucuuucucuacgcgcaagccucuggacgcauuacaguuuccaccaagagaagccagcaggcugugaucccgaacauuggcucccggccccgcgucagaaauaucccuucucggaucagcauuuauuggacaaucgugaaacccggggauauucugcugaucaacuccaccggaaaucucauugccccucgcggcuacuucaagaucagaagcgggaaaucuuccaucaugcggagcgacgcucccauuggaaaguguaacucugaaugcaucaccccgaauggcagcauuccuaacgacaagcccuuucagaaugugaaccgcaucacauacggcgccuguccuagauaugucaaacaauccacgcugaagcuggcgaccgggaugcggaauguucccgagaaacagacacgcggaauuuucggcgccaucgcuggguuuaucgaaaacggaugggagggcaugguggaugggugguacggauucagacaccaaaauucugagggccggggccaggccgcugaccuuaagagcacccaggccgccauugaucagaucaacgggaaacucaauagacugauuggaaagacaaacgaaaaauuccaucagaucgagaaggaauuuuccgagguggaaggccgcauucaagaccuugagaaguaugucgaggauaccaaaaucgaccuguggagcuacaacgcugaacuccugguggcgcuggagaaucagcacacgauugaucucacagacucugaaaugaacaagcuguucgagaaaaccaagaaacagcuucgggaaaaugccgaggauauggggaacggaugcuuuaccaucuaucauaagugugacaaugcuugcaucggcuccauuagaaacgggacauacgaucacaauguuuaucgcgacgaggcccugaacaaucgguuccagaucaagggcguggaacucaaaagcggauacaaggacuggauucuguggaucucuuuugccauuuccugcuuccuucugugugucgcucuccugggcuuuaucaugugggccugccaaaaagggaacaucagauguaauauuugcaucuga

SEQ ID NO: 189663 - RNA, 1701 nt, Artificial Sequence; identical to SEQ ID NO: 188557
  derived and/or modified sequence opt5 from hemagglutinin__InfluenzaA__AEA73496

SEQ ID NO: 189664 - RNA, 1701 nt, Artificial Sequence; identical to SEQ ID NO: 188557
  derived and/or modified sequence opt5 from hemagglutinin__InfluenzaA__AEA73507

SEQ ID NO: 189665 - RNA, 1701 nt, Artificial Sequence; identical to SEQ ID NO: 188557
  derived and/or modified sequence opt5 from hemagglutinin__InfluenzaA__AEA73518

SEQ ID NO: 189666 - RNA, 1701 nt, Artificial Sequence; identical to SEQ ID NO: 188557
  derived and/or modified sequence opt5 from hemagglutinin__InfluenzaA__AEA73529

SEQ ID NO: 189667 - RNA, 1701 nt, Artificial Sequence; identical to SEQ ID NO: 188557
  derived and/or modified sequence opt5 from hemagglutinin__InfluenzaA__AEA73540

SEQ ID NO: 189668 - RNA, 1701 nt, Artificial Sequence; identical to SEQ ID NO: 188557
  derived and/or modified sequence opt5 from hemagglutinin__InfluenzaA__AEA73551

SEQ ID NO: 189669 - RNA, 1701 nt, Artificial Sequence; identical to SEQ ID NO: 188557
  derived and/or modified sequence opt5 from hemagglutinin__InfluenzaA__AEA73562

SEQ ID NO: 189670 - RNA, 1698 nt, Artificial Sequence
  derived and/or modified sequence opt5 from hemagglutinin__InfluenzaA__AEA73573
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacagagaaaaauggccucuaccccaaccugucuaaguccuaugcuaauaacaaagaaaaggaggugcugguccucuggggagugcaccacccuccgaacaucggggaccagaaaacccuguaccauacagaaaaugccuacgugagcgucguuuccucucacuauagcagaaaguucacccccgagauugcuaagcggccuaaagugcgcgaucaggagggcagaaucaacuacuauuggacgcuucuggaacccggggacacaauuaucuuugaggccaauggaaaccucauugcgccucgguacgccuucgcucugucccgcggcuuugggagcggaaucauuaauucuaacgcccccauggauaagugugacgcuaaaugccagaccccgcaaggcgccaucaauuccagccuuccuuuccagaacgugcaucccgucacaaucggcgaauguccuaaguaugugagaucugcgaaacugcggaugguuaccgggcuccgcaauauucccagcauccaguccagaggacuguuuggcgccauugcuggguucaucgagggaggcuggaccgggaugguggauggaugguacggcuaucaccaccagaacgaacaaggcucuggguacgccgcugaccaaaagagcacacagaaugccauuaacggaaucacgaauaaagucaacuccgugaucgagaagaugaauacccaguuuacagccguuggcaaggaguucaacaaacuggaacggcgcauggagaaccucaauaagaaaguggaugacggguucauugauaucuggaccuacaacgcugaacugcuuguccugcucgagaaugaaagaacacuggacuuucaugacagcaacgugaagaaucuuuaugagaaagucaagucucagcugaagaacaaugcgaaagagauuggaaacggcugcuucgaauuuuaccacaaguguaaugaugagugcauggaauccgugaaaaacgggaccuaugacuaccccaaguauagcgaggagucuaaacucaaucgggaaaagaucgauggcguuaagcuggaguccaugggaguguaccagauucuggccaucuauagcacggucgcuuccucucucgugcugcuuguuagccugggcgccaucuccuucuggaugugcucuaacgggagccuccagugucgcauuugcaucuga

SEQ ID NO: 189671 - RNA, 1698 nt, Artificial Sequence
  derived and/or modified sequence opt5 from hemagglutinin__InfluenzaA__AEA73584
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucguggaccagaaaacccuguacagaacagagaaugccuacgucagcguuguguccucucauuauagccggaaguucacccccgaaauugcuaagcgcccuaaagugagaaaccaggagggccggaucaauuacuauuggacgcuucuggagcccggggauacaauuaucuuugaagccaacggaaaucucauugcgccucgcuacgccuucgcucuguccagaggcuuugggagcggaaucauuaacucuaaugcccccauggacaagugugaugcuaaaugccagaccccgcaaggcgccaucaacuccagccuuccuuuccagaauguccaccccgugacaaucggcgaguguccuaaguauguucggucugcgaaacugcgcauggugaccgggcucagaaacauucccagcauccagucccggggacuguuuggcgccauugcuggguucaucgaaggaggcuggaccgggauggucgacggaugguacggcuaucaucaccagaaugagcaaggcucuggguacgccgcugaucagaaguccacacagaacgccauuaauggaaucacgaacaaagugaauagcguuaucgaaaagaugaacacccaguuuacagccgugggcaaggaguucaacaaacuggagcgcagaauggaaaaucucaacaagaaagucgacgauggguucauugacaucuggaccuacaaugcugagcugcuugugcugcucgaaaacgagcggacacuggauuuucacgacagcaaugucaagaaccuuuaugaaaaagugaagucucaacugaagaauaacgcgaaagagauuggaaauggcugcuucgaguuuuaccauaaguguaacgacgaaugcauggaguccguuaaaaaugggaccuaugauuaccccaaguauagcgaagagucuaaacucaaccgcgagaagaucgacggcgugaagcuggaauccaugggagucuaccagauucuggccaucuauagcacgguggcuuccucucucguucugcuugugagccugggcgccaucuccuucuggaugugcucuaaugggagccuccaguguagaauuugcaucuga

SEQ ID NO: 189672 - RNA, 1698 nt, Artificial Sequence
  derived and/or modified sequence opt5 from hemagglutinin__InfluenzaA__AEA73595
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacagugaaaaauggccucuaccccaaccugucuaaguccuaugcuaauaacaaagagaaggaaguccuggugcucuggggagugcaccacccuccgaacaucgucgaccagaaaacccuguaccauacagagaaugccuacguuagcgugguguccucucacuauagcagaaaguucacccccgaaauugcuaagcggccuaaaguccgcgaucaggaggggagaaucaacuacuauuggacgcuucuggagcccggcgacacaauuaucuuugaagccaaugggaaccucauugcgccucgguacgccuucgcucugucccgcggauuuggcagcgggaucauuaauucuaacgcccccauggauaagugugacgcuaaaugccagaccccgagaggagccaucaauuccagccuuccuuuccaaaacgugcaucccguuacaaucggcgaguguccuaaguaugugcggucugcgaaacugcgcauggucaccggccucagaaauauucccagcauccagucccgggggcuguuuggagccauugcuggcuucaucgaagggggauggaccggcaugguggaugggugguacggauaucaccaccagaacgagcagggcucuggcuacgccgcugaccaaaagagcacacagaaugccauuaacgggaucacgaauaaaguuaacuccgugaucgaaaagaugaauacccaguuuacagccgucggaaaggaguucaacaaacuggagcgcagaauggaaaaccucaauaagaaaguggaugacggcuucauugauaucuggaccuacaacgcugagcugcuuguccugcucgaaaaugagcggacacuggacuuucaugacagcaacgugaagaaucuuuaugaaaaaguuaagucucagcugaagaacaaugcgaaagagauugggaacggaugcuucgaguuuuaccacaaguguaaugaugaaugcauggaguccgugaaaaacggcaccuaugacuaccccaaguauagcgaagagucuaaacucaaucgcgagaagaucgauggggucaagcuggaauccaugggcguguaccaaauucuggccaucuauagcacgguugcuuccucucucgugcugcuugucagccugggagccaucuccuucuggaugugcucuaacggcagccuccaguguagaauuugcaucuga

SEQ ID NO: 189673 - RNA, 1698 nt, Artificial Sequence; identical to SEQ ID NO: 188977
  derived and/or modified sequence opt5 from hemagglutinin__InfluenzaA__AEA73606

SEQ ID NO: 189674 - RNA, 1698 nt, Artificial Sequence; identical to SEQ ID NO: 186155
  derived and/or modified sequence opt5 from hemagglutinin__InfluenzaA__AEA73617

SEQ ID NO: 189675 - RNA, 1698 nt, Artificial Sequence; identical to SEQ ID NO: 186640
  derived and/or modified sequence opt5 from hemagglutinin__InfluenzaA__AEA73628

SEQ ID NO: 189676 - RNA, 1698 nt, Artificial Sequence; identical to SEQ ID NO: 188996
  derived and/or modified sequence opt5 from hemagglutinin__InfluenzaA__AEA73639

SEQ ID NO: 189677 - RNA, 1698 nt, Artificial Sequence; identical to SEQ ID NO: 186155
  derived and/or modified sequence opt5 from hemagglutinin__InfluenzaA__AEA73650

SEQ ID NO: 189678 - RNA, 1698 nt, Artificial Sequence; identical to SEQ ID NO: 186640
  derived and/or modified sequence opt5 from hemagglutinin__InfluenzaA__AEA73661

SEQ ID NO: 189679 - RNA, 1698 nt, Artificial Sequence
  derived and/or modified sequence opt5 from hemagglutinin__InfluenzaA__AEA73672
augaaggugaaacugcucguccugcuuugcaccuucacagccacguuugcugacaccaucuguauuggcuaccacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuauauuguggaaaagccgaaccccgagaauggcaccuguuacccugggcauuucgccgauuaugaggaacugagagagcaacucuccucugucagcuccuuugaacgguucgagaucuuucccaaggagagcucuuggccuaaccacacggugaccggaguuuccgccagcugcucucauaauggcgaauccagcuucuaccgcaaccugcuuuggcugacagugaaaaauggccucuaucccaaccugucuaaguccuacgcuaauaacaaagagaaggaaguccuggugcucuggggagugcaccacccuccgaacaucgucgaccagaaaacccuguauagaacagagaaugccuacguuagcgugguguccucucauuacagccggaaguuuacccccgaaauugcuaagcgcccuaaagucagagaucaggaggggcggaucaacuauuacuggacgcuucuggagcccggcgacacaauuaucuucgaagccaaugggaaccucauugcgccucgcuaugccuuugcucuguccagaggauucggcagcgggaucauuaauucuaacgcccccauggauaagugugacgcuaaaugccagaccccgcggggagccaucaauuccagccuuccuuuucaaaacgugcaccccguuacaaucggcgaguguccuaaguacgugcgcucugcgaaacugagaauggucaccggccuccggaauauucccagcauccagucccgcgggcuguucggagccauugcuggcuuuaucgaagggggauggaccggcaugguggaugggugguauggauaccaucaccagaacgagcagggcucuggcuaugccgcugaccaaaagagcacacagaaugccauuaacgggaucacgaauaaaguuaacuccgugaucgaaaagaugaauacccaguucacagccgucggaaaggaguucaacaaacuggagagacggauggaaaaccucaauaagaaaguggaugacggcuuuauugauaucuggaccuacaacgcugagcugcuuguccugcucgaaaaugagcgcacacuggacuuccacgacagcaacgugaagaaucuuuacgaaaaaguuaagucucagcugaagaacaaugcgaaagagauugggaacggaugcuuugaguucuaucauaaguguaaugaugaaugcauggaguccgugaaaaacggcaccuacgacuaucccaaguacagcgaagagucuaaacucaauagagagaagaucgauggggucaagcuggaauccaugggcguguaucaaauucuggccaucuacagcacgguugcuuccucucucgugcugcuugucagccugggagccaucuccuuuuggaugugcucuaacggcagccuccagugucggauuugcaucuga

SEQ ID NO: 189680 - RNA, 1698 nt, Artificial Sequence; identical to SEQ ID NO: 186640
  derived and/or modified sequence opt5 from hemagglutinin__InfluenzaA__AEA73683

SEQ ID NO: 189681 - RNA, 1698 nt, Artificial Sequence
  derived and/or modified sequence opt5 from hemagglutinin__InfluenzaA__AEA73694
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacagugaaaaauggccucuaccccaaccugucuaaguccuaugcuaauaacaaagagaaggaaguccuggugcucuggggagugcaccacccuccgaacaucgucgaccagaaaacccuguacagaacagagaaugccuacguuagcgugguguccucucauuauagccggaaguucacccccgaaauugcuaagcgcccuaaagucagagaucaggaggggcggaucaacuacuauuggacgcuucuggagcccggcgacacaauuaucuuugaagccaaugggaaccucauugcgccucgcuacgccuucgcucuguccagaggauuuggcagcgggaucauuaauucuaacgcccccauggauaagugugacgcuaaaugccagaccccgcggggagccaucaauuccagccuuccuuuccaaaacgugcaccccguuacaaucggcgaguguccuaaguaugugcgcucugcgaaacugagaauggucaccggccuccggaauauucccagcauccagucccgcgggcuguuuggagccauugcuggcuucaucgaagggggauggaccggcaugguggaugggugguacggauaucaucaccagaacgagcagggcucuggcuacgccgcugaccaaaagagcacacagaaugccauuaacgggaucacgaauaaaguuaacuccgugaucgaaaagaugaauacccaguuuacagccgucggaaaggaguucaacaaacuggagagacggauggaaaaccucaauaagaaaguggaugacggcuucauugauaucuggaccuacaacgcugagcugcuuguccugcucgaaaaugagcgcacacuggacuuucacgacagcaacgugaagaaucuuuaugaaaaaguuaagucucagcugaagaacaaugcgaaagagauugggaacggaugcuucgaguuuuaccauaaguguaaugaugaaugcauggaguccgugaaaaacggcaccuaugacuaccccaaguauagcgaagagucuaaacucaauagagagaagaucgauggggucgaacuggaguccaugggcguguaccaaauucuggccaucuauagcacgguugcuuccucucucgugcugcuugucagccugggagccaucuccuucuggaugugcucuaacggcagccuccagugucggauuugcaucuga

SEQ ID NO: 189682 - RNA, 1698 nt, Artificial Sequence; identical to SEQ ID NO: 186640
  derived and/or modified sequence opt5 from hemagglutinin__InfluenzaA__AEA73705

SEQ ID NO: 189683 - RNA, 1698 nt, Artificial Sequence; identical to SEQ ID NO: 186155
  derived and/or modified sequence opt5 from hemagglutinin__InfluenzaA__AEA73716

SEQ ID NO: 189684 - RNA, 1698 nt, Artificial Sequence; identical to SEQ ID NO: 186155
  derived and/or modified sequence opt5 from hemagglutinin__InfluenzaA__AEA73727

SEQ ID NO: 189685 - RNA, 1698 nt, Artificial Sequence; identical to SEQ ID NO: 186155
  derived and/or modified sequence opt5 from hemagglutinin__InfluenzaA__AEA73738

SEQ ID NO: 189686 - RNA, 1698 nt, Artificial Sequence; identical to SEQ ID NO: 186155
  derived and/or modified sequence opt5 from hemagglutinin__InfluenzaA__AEA73749

SEQ ID NO: 189687 - RNA, 1698 nt, Artificial Sequence
  derived and/or modified sequence opt5 from hemagglutinin__InfluenzaA__AEA73760
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacagugaaaaauggccucuaccccaaccugucuaaguccuaugcuaauaacaaagagaaggaaguccuggugcucuggggagugcaccacccuccgaacaucgucgaccagaaaacccuguacagaacagagaaugccuacguuagcgugguguccucucauuauagccggaaguucacccccgaaauugcuaagcgcccuaaaaucagagaucaggaggggcggauuaacuacuauuggacgcuucuggagcccggcgacacaaucauuuuugaagccaaugggaaccucaucgcgccucgcuacgccuucgcucuguccagaggauuuggcagcgggauuaucaauucuaacgcccccauggauaagugugacgcuaaaugccagaccccgcggggagccaucaauuccagccuuccuuuccaaaacguccaccccgugacaauuggcgaguguccuaaguauguucgcucugcgaaacugagaauggugaccggccuccggaauauccccagcauucagucccgcgggcuguuuggagccaucgcuggcuucauugaagggggauggaccggcauggucgaugggugguacggauaucaucaccagaacgagcagggcucuggcuacgccgcugaccaaaagagcacacagaaugccaucaacgggaucacgaauaaagugaacuccguuauugaaaagaugaauacccaguuuacagccgugggaaaggaguucaacaaacuggagagacggauggaaaaccucaauaagaaagucgaugacggcuucaucgauauuuggaccuacaacgcugagcugcuugugcugcucgaaaaugagcgcacacuggacuuucacgacagcaacgucaagaaucuuuaugaaaaagugaagucucagcugaagaacaaugcgaaagagaucgggaacggaugcuucgaguuuuaccauaaguguaaugaugaaugcauggaguccguuaaaaacggcaccuaugacuaccccaaguauagcgaagagucuaaacucaauagagagaagauugauggggugaagcuggaauccaugggcgucuaccaaauccuggccaucuauagcacgguggcuuccucucucguucugcuugugagccugggagccauuuccuucuggaugugcucuaacggcagccuccagugucggaucugcauuuga

SEQ ID NO: 189688 - RNA, 1701 nt, Artificial Sequence; identical to SEQ ID NO: 185693
  derived and/or modified sequence opt5 from hemagglutinin__InfluenzaA__AEA73771

SEQ ID NO: 189689 - RNA, 1701 nt, Artificial Sequence; identical to SEQ ID NO: 187323
  derived and/or modified sequence opt5 from hemagglutinin__InfluenzaA__AEA73781

SEQ ID NO: 189690 - RNA, 1701 nt, Artificial Sequence; identical to SEQ ID NO: 187245
  derived and/or modified sequence opt5 from hemagglutinin__InfluenzaA__AEA73791

SEQ ID NO: 189691 - RNA, 1701 nt, Artificial Sequence; identical to SEQ ID NO: 185873
  derived and/or modified sequence opt5 from hemagglutinin__InfluenzaA__AEA73801

SEQ ID NO: 189692 - RNA, 1701 nt, Artificial Sequence; identical to SEQ ID NO: 186857
  derived and/or modified sequence opt5 from hemagglutinin__InfluenzaA__AEA73811

SEQ ID NO: 189693 - RNA, 1701 nt, Artificial Sequence; identical to SEQ ID NO: 187415
  derived and/or modified sequence opt5 from hemagglutinin__InfluenzaA__AEA73821

SEQ ID NO: 189694 - RNA, 1701 nt, Artificial Sequence
  derived and/or modified sequence opt5 from hemagglutinin__InfluenzaA__AEA73831
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguuacaccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaaaaaucugaucuggcucguuaaaaagggcaacucuuacccuaaacuguccaagagcuauauuaaugacaaggggaaagaagugcuuguccuguggggaauccaccaccccuccacaucuaccgaucaacagagccucuaccagaacgcggacgccuacguguucgugggcacguccagauauagcaagaaauuuaagccugagauugcuauccggccgaaaguccgcgaucaggaggggagaaugaauuacuauuggacacugguugaacccggagacaagauuaccuucgaggccacaggcaaccugguggugccucgguacgcuuuugccauggaacgcaacgcggggucuggaaucauuaucuccgauacccccguccaugacugcaauaccacaugucaaacgccuaaaggcgccaucaacaccagccuccccuuccagaauauucacccgaucacaauuggcaagugcccuaaguaugugaaaucuaccaagcugagacuugcuacagggcugcggaacguucccagcauccagucccgcggacucuuuggcgccauugcuggguucaucgagggaggcuggaccgggaugguggacggaugguacggcuaucaucaccagaaugaacaaggcucuggguacgccgccgaucugaaaagcacgcagaacgcuaucgacaagauuacaaauaaagucaacuccgugaucgagaagaugaauacccaguuuaccgcgguuggaaaggaguucaaccaccuugagaaaagaauugagaaucugaacaagaaaguggaugacggcuuccucgauaucuggacauacaaugccgaacugcugguccuccuggagaacgaacggacccuugacuaucaugauagcaaugugaagaaccuguacgagaaaguccgcucucagcucaagaacaaugcuaaggagauugggaacggauguuuugaguucuaucacaaaugcgacaauacauguauggaauccgugaagaacggcacguacgauuauccuaaauacagcgaagaggccaagcugaauagagaagagaucgacgggguuaaacuugagucuacccggaucuaucaaauucuggccaucuacuccacaguggcuagcucccucguccuggugguuucucugggcgccauuagcuuuuggaugugcuccaacggaucucuccagugccgcaucuguauuuga

SEQ ID NO: 189695 - RNA, 1701 nt, Artificial Sequence
  derived and/or modified sequence opt5 from hemagglutinin__InfluenzaA__AEA73841
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaccugguggugccucgguacgcguuugccauggaacgcaaugcugagucugggaucauuaucuccgacacccccguccaugauugcaacacaaccugucaaaccccuaaaggagccaucaauacaagccuccccuuccagaacauucacccgaucacgauuggcaagugcccuaaguaugugaaaucuaccaagcugagacuugcuacaggccugcggaauguucccagcauccagucccgcgggcucuuuggagccauugccggcuucaucgaagggggauggaccggcaugguggacgggugguacggauaucaucaccagaacgagcaaggcucuggcuacgcugcggaccugaaaagcacacagaaugccaucgauaagauuaccaacaaagucaauuccgugguugagaagaugaacacgcaguuuacagcuguggggaaggaguucaaucaccuugagaaaagaaucgaaaaccugaauaagaaagucgacgauggauuccucgacauuuggaccuacaacgccgagcugcuggugcuccuggaaaaugagcggacccuugauuaucaugacagcaacgucaagaaccuguacgagaaagugcgcucucagcucaagaauaacgccaaggaaaucggcaauggguguuuugaguucuaucacaaaugcgauaacacauguauggaauccguuaagaauggaaccuacgacuauccuaaauacagcgaggaagcuaagcugaacagagaggagauugauggcgugaaacuugaaucuacacggaucuaucaaauccuggccauuuacuccacggucgcgagcucccucgugcugguugugucucugggggcuaucagcuuuuggaugugcuccaauggcucucuccagugccgcauuuguaucuga

SEQ ID NO: 189696 - RNA, 1701 nt, Artificial Sequence; identical to SEQ ID NO: 187323
  derived and/or modified sequence opt5 from hemagglutinin__InfluenzaA__AEA73851

SEQ ID NO: 189697 - RNA, 1701 nt, Artificial Sequence
  derived and/or modified sequence opt5 from hemagglutinin__InfluenzaA__AEA73861
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcgagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagagccucuaccagaacgcugacgccuacguguucgugggcacauccagauauagcaaaaaguuuaaaccugagauugcuauccggccgaagguccgcgaucaggaagggagaaugaauuacuauuggacccugguugagcccggagacaaaauuacguucgaagccacaggcaaccugguggugccucgguacgcguuugccauggagcgcaacgcugggucuggaaucauuaucuccgauacccccguccaugacugcaauacaaccugucaaaccccuaagggcgccaucaacacaagccuccccuuccagaaugugcacccgauuacgaucggcaaaugcccuaaguauguuaagucuaccaaacugagacuugcuacagggcugcggaacgugcccagcauucagucccgcggacucuuuggcgccaucgccggguucauugaaggaggcuggaccgggauggucgacggaugguacggcuaucaucaccagaaugagcaaggcucuggguacgcugcggaucuuaagagcacacagaacgccaucgacgagaucaccaauaaagugaacuccguuauugaaaagaugaauacgcaguuuacagcugugggaaaagaguucaaccaccuggaaaagagaaucgagaaucugaacaagaaaauugaugacggcuuccucgauaucuggaccuacaaugccgaacugcugguccuccuggagaacgagcggacccuugacuaucaugauagcaaugugaagaaccuguacgaaaaaguccgcucucagcucaagaacaaugccaaagagauugggaacggauguuuugaguucuaucacaagugcgacaauacauguauggaauccgugaagaacggcaccuacgauuauccuaaauacagcgaagaggcuaagcugaauagagaggaaaucgacgggguuaaacuugagucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 189698 - RNA, 1701 nt, Artificial Sequence; identical to SEQ ID NO: 187565
  derived and/or modified sequence opt5 from hemagglutinin__InfluenzaA__AEA73871

SEQ ID NO: 189699 - RNA, 1701 nt, Artificial Sequence; identical to SEQ ID NO: 187565
  derived and/or modified sequence opt5 from hemagglutinin__InfluenzaA__AEA73881

SEQ ID NO: 189700 - RNA, 1701 nt, Artificial Sequence; identical to SEQ ID NO: 187245
  derived and/or modified sequence opt5 from hemagglutinin__InfluenzaA__AEA73891

SEQ ID NO: 189701 - RNA, 1701 nt, Artificial Sequence
  derived and/or modified sequence opt5 from hemagglutinin__InfluenzaA__AEA73901
augaacgccauccuggugguccuccuguacaccuucgcuacagccaaugcggacacgcuuugcauuggcuaucacgcuaacaauagcaccgauacaguugacacccugcucgagaagaacgugacagugacccauuccgucaaucugcuugaagauaaacacaacgggaagcuguguaaacucagaggaguggcgccccugcaucugggcaagugcaauaucgccggguggauucucggaaacccugagugugaaucucugagcacagcuuccucuuggagcuacaucguugagaccuccucuagcgacaauggcacgugcuauccgggggauuuuauugacuacgaagaacuucgggagcagcuguccagcgugucuuccuucgaacgcuuugagaucuuccccaaaaccagcucuuggccuaaccacgauuccaauaagggagucacagccgcuuguccccaugccggcgccaagagcuuuuauaaaaaccucaucuggcuggugaagaaaggcaauucuuacccuaaacuuuccaagagcuauauuaacgacaaggggaaggaaguucuggugcucuggggaauccaccaccccuccaccucugccgaucaacagagccuguaccagaaugcugacgccuacgucuucgugggcacauccagauauagcaaaaaguuuaaaccugagauugcuauccggccgaaggugcgcgaucaggaggggagaaugaacuacuauuggacccuggucgaacccggagacaaaauuacguucgaggccacaggcaaccucguugugccucgguacgcguuugccauggaacgcaaugcugggucuggaaucauuaucuccgauacccccgugcaugacugcaacacaaccugucaaaccccuaagggcgccaucaauacaagccugcccuuccagaacauucacccgaucacgauuggcaaaugcccuaaguaugucaagucuaccaaacuuagacuggcuacagggcuccggaaugugcccagcauccagucccgcggacuguuuggcgccauugccggguucaucgagggaggcuggaccgggaugguugacggaugguacggcuaucaucaccagaacgaacaaggcucuggguacgcugcggaucuuaagagcacacagaaugccaucgacgagauuaccaacaaaaucaauuccgugauugagaagaugaacacgcaguuuacagcugucggaaaagaguucaaucaccuggagaagagaaucgaaaaccucaauaagaaaguggaugacggcuuccuggauauuuggaccuacaacgccgagcugcucguucugcuugaaaaugagcggacccuggacuaucaugauagcaacgugaagaaccucuacgagaaaguccgcucucagcugaagaauaacgccaaagaaaucgggaauggauguuuugaguucuaucacaagugcgacaacacauguauggaauccgugaagaauggcaccuacgauuauccuaaauacagcgaggaagcuaaacuuaacagagaggagaucgacggggucaagcuggaaucuacacggauuuaucaaauccucgccauuuacuccacgguggcgagcucccugguucugguggucucucucggcgcuaucagcuuuuggaugugcuccaauggaucucugcagugccgcauuuguaucuga

SEQ ID NO: 189702 - RNA, 1701 nt, Artificial Sequence; identical to SEQ ID NO: 186857
  derived and/or modified sequence opt5 from hemagglutinin__InfluenzaA__AEA73911

SEQ ID NO: 189703 - RNA, 1701 nt, Artificial Sequence; identical to SEQ ID NO: 187565
  derived and/or modified sequence opt5 from hemagglutinin__InfluenzaA__AEA73921

SEQ ID NO: 189704 - RNA, 1701 nt, Artificial Sequence; identical to SEQ ID NO: 187323
  derived and/or modified sequence opt5 from hemagglutinin__InfluenzaA__AEA73931

SEQ ID NO: 189705 - RNA, 1701 nt, Artificial Sequence; identical to SEQ ID NO: 187323
  derived and/or modified sequence opt5 from hemagglutinin__InfluenzaA__AEA73961

SEQ ID NO: 189706 - RNA, 1701 nt, Artificial Sequence
  derived and/or modified sequence opt5 from hemagglutinin__InfluenzaA__AEA73971
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccagaauauucacucuaucacgauuggcaagugcccgaaguaugugaaaagcaccaagcugagacuugcuacagggcugcggaacguuccuuccauccagucucgcggacucuuuggcgccauugccggguucaucgaaggaggcuggaccgggaugguggacggaugguacggcuaucaucaccagaaugagcaaggcagcggguacgcugcggaccagaaauccacacagaacgccaucgaugagauuaccaauaaggucaacagcgugaucgagaaaaugaauacgcaguuuacagcuguuggaaaggaguucaaccaccuggaaaagagaauugagaaucuuaacaaaaagguggacgauggcuuccuggacaucuggaccuacaaugccgaacuccugguccugcucgagaacgagcggacccuggauuaucaugacucuaaugugaaaaaccuuuacgaaaagguccgcucccaacugaaaaacaaugccaaggagauugggaacggauguuuugaguucuaucacaagugcaauaacacauguauggaaagcgugaaaaauggcaccuacgauuaucccaaguacucugaagaggcuaaacucaacagagaggaaaucgacgggguuaagcuggaguccacacggaucuaucagauucuugccaucuacagcacgguggcguccucucugguccucgugguuagccugggcgcuauuuccuuuuggaugugcucuaauggaagccugcagugccgcaucuguauuuga

SEQ ID NO: 189707 - RNA, 1701 nt, Artificial Sequence; identical to SEQ ID NO: 187323
  derived and/or modified sequence opt5 from hemagglutinin__InfluenzaA__AEA73981

SEQ ID NO: 189708 - RNA, 1701 nt, Artificial Sequence
  derived and/or modified sequence opt5 from hemagglutinin__InfluenzaA__AEA73991
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaaaugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgggagcagcuuuccagcgucucuuccuucgaaaaguuugagaucuuccccaagaccagcucuuggccuaaucacgauuccaacaaaggagugacagccgcuuguccccaugccggcgccaagagcuuuuauaaaaaucugaucuggcucguuaagaaaggcaacucuuacccuaagcuguccaagagcuauauuaaugacaaagggaaggaagugcuuguccuguggggaauccaccaccccuccaccucugccgaucaacagagccucuaccagaacgcugacuccuacguguucgugggcacaagccgcuauucuaaaaaguuuaaaccugagauugccaucagaccgaagguccgggaucaggaggggcgcaugaauuacuauuggacccugguugaacccggagacaaaauuacguucgaggcuacaggcaaccugguggugccuagauacgccuuugcgauggaacggaacgccggguccggaaucauuaucagcgauacccccguccaugacugcaauacaaccugucaaaccccugagggcgcuaucaacacaucucuccccuuccagaauauucacccgaucacgauuggcaagugcccuaaguaugugaaaagcaccaagcugcgccuugccacagggcugagaaacguucccuccauccagucucggggacucuuuggcgcuauugccggguucaucgaaggaggcuggaccgggaugguggacggaugguacggcuaucaucaccagaaugagcaaggcagcggguacgccgcugaucugaaauccacacagaacgcgaucgacgagauuaccaauaaggucaacagcgugaucgaaaagaugaauacgcaguuuacagccguuggaaaggaguucaaccaccuugaaaagcgcauugagaaucugaacaaaaagguggaugacggcuuccucgauaucuggaccuacaaugcugaacugcugguccuccuggagaacgagagaacccuugacuaucaugauucuaaugugaaaaaccuguacgaaaagguccggucccagcucaaaaacaaugccaaggagauugggaacggauguuuugaguucuaucacaagugcgacaauacauguauggagagcgugaaaaacggcaccuacgauuauccuaaguacucugaagaggccaaacugaaucgcgaggaaaucgacgggguuaaacuugaguccacaagaaucuaucaaauucuggcuaucuacagcacgguggccuccucucucguccuggugguuagccugggcgcgauuuccuuuuggaugugcucuaacggaagccuccagugccggaucuguauuuga

SEQ ID NO: 189709 - RNA, 1701 nt, Artificial Sequence; identical to SEQ ID NO: 187306
  derived and/or modified sequence opt5 from hemagglutinin__InfluenzaA__AEA74001

SEQ ID NO: 189710 - RNA, 1701 nt, Artificial Sequence
  derived and/or modified sequence opt5 from hemagglutinin__InfluenzaA__AEA74011
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaggagcugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagagaaacagcuacccuaaacugucccaaagcuauauuaaugacaagggcaaggaagugcuuguccugugggggauccaccaccccuccaccucugccgaucagcagagccucuaccagaacgcugacgccuacguguucgugggaacaucccgguauagcaaaaaguuuaaaccugagauugcuauccgcccgaaggucagagaucaagagggccggaugaauuacuauuggacccugguugaacccggggacaaaauuacguucgaggccacaggaaaccugguggugccucgcuacgcguuugccauggaaagaaacgcuggcucugggaucauuaucuccgauacccccguccaugacugcaauacaaccugucagaccccuaagggagccaucaacacaagccuccccuuccagaauauucacccgaucacgauuggcaaaugcccuaaguaugugaagucuaccaaacugcggcuugcuacaggccugcgcaacguucccagcauccaguccagagggcucuuuggagccauugccggcuucaucgaagggggauggaccggcaugguggacgggugguacggauaucaucaccaaaaugaacagggcucuggcuacgcugcggaucuuaagagcacacagaacgccaucgacaaaauuaccaauaaggucaacuccgugaucgagaaaaugaauacgcaguuuacagcuguugggaaggaguucaaccaccuugaaaagcggauugagaaucugaacaaaaagguggaugacggauuccucgauaucuggaccuacaaugccgaacugcugguccuccuggagaacgaacgcacccuugacuaucaugauagcaaugugaaaaaccuguacgagaaggucagaucucaacucaaaaacaaugccaaggagauuggcaacggguguuuugaguucuaucacaagugcgacaauacauguauggaauccaucaaaaacggaaccuacgauuauccuaaguacagcgaagaggcuaaacugaaucgggaagagaucgacggcgugaagcuggagucuacacgcauuuaucagauccuggccauuuacuccacgguugcgagcucccucgugcuggucgugucucugggggcuaucagcuuuuggaugugcuccaacggcucucuccagugcagaauuuguaucuga

SEQ ID NO: 189711 - RNA, 1701 nt, Artificial Sequence
  derived and/or modified sequence opt5 from hemagglutinin__InfluenzaA__AEA74021
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacugucccaaagcuauauuaaugacaaggggaaggaagugcuuguccuguggggaauccaccaccccuccaccucugccgaucagcagagccucuaccagaacgcugacgccuacguguucgugggcacauccagauauagcaaaaaguuuaaaccugagauugcuauccggccgaagguccgcgaucaagaggggagaaugaauuacuauuggacccugguugaacccggagacaaaauuacguucgaggccacaggcaaccugguggugccucgguacgcguuugccauggaacgcaacgcugggucuggaaucauuaucuccgauacccccguccaugacugcaauacaaccugucagaccccuaagggcgccaucaacacaagccuccccuuccagaauauucacccgaucacgauuggcaaaugcccuaaguaugugaagucuaccaaacugagacuugcuacagggcugcggaacguucccagcauccagucccgcggacucuuuggcgccauugccggguucaucgagggaggcuggaccgggaugguggacggaugguacggcuaucaucaccaaaaugaacagggcucuggguacgcugcggaucuuaagagcacacagaacgccaucgacaaaauuaccaauaaggucaacuccgugaucgagaaaaugaauacgcaguuuacagcuguuggaaaggaguucaaccaccuugaaaagagaauugagaaucugaacaaaaagguggaugacggcuuccucgauaucuggaccuacaaugccgaacugcugguccuccuggagaacgaacggacccuugacuaucaugauagcaaugugaaaaaccuguacgagaagguccgcucucaacucaaaaacaaugccaaggagauugggaacggauguuuugaguucuaucacaagugcgacaauacauguauggaguccaucaaaaacggcaccuacgauuauccuaaguacagcgaagaggcuaaacugaauagagaagagaucgacggggugaagcuggagucuacacggauuuaucagauccuggccauuuacuccacgguugcgagcucccucgugcuggucgugucucugggcgcuaucagcuuuuggaugugcuccaacggaucucuccagugccgcauuuguaucuga

SEQ ID NO: 189712 - RNA, 1701 nt, Artificial Sequence
  derived and/or modified sequence opt5 from hemagglutinin__InfluenzaA__AEA74031
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccguggaucuccuggaagacaagcacaacgggaaacuuuguaagcugagaggaguugcuccccuccaucugggcaaaugcaauaucgccggguggauucugggaaacccugagugugaaucucucagcacagccuccucuuggagcuacaucguggagaccuccucuagcgauaauggcacgugcuauccgggggacuuuauugauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaacaaucugaucuggcucguuaagaaaggcaacagcuacccuaagcugaauaaauccuauauuaacgauaaggggaaggaagugcuuguccuguggggaauccaccaccccagcaccuccacagaccaacagucucucuaccagaaugccgaugcuuacguguucgugggcaccagcagauauuccaaaaaguuuaaaccugagauugccauccggccgaagguccgcaaccaggaggggagaaugaacuacuauuggacgcugguugaacccggagacaaaauuacauucgaggcuaccggcaaucugguggugccucgguacgccuuugcgauggaacgcaacgccgggagcggaaucauuaucucugauacacccauccaugacugcaauaccaccugucaaacaccuaagggcgcuauuaacacgucccuccccuuccagaauauccacccgauuaccaucggcaaaugcccuaaguaugucaagagcacaaaacugagacuugccaccgggcugcggaacgugcccucuauucagagccgcggacucuuuggcgcuaucgccggguucaucgagggaggcuggacagggaugguugacggaugguacggcuaucaucaccagaaugaacaaggcuccggguacgccgcugaucugaagucuacccagaacgcgauugacgagaucacgaauaaagugaacagcgucauugagaagaugaauacacaguuuaccgccgugggaaaagaguucaaccaccuugagaagagaaucgaaaaucugaacaagaaaguugaugacggcuuccucgauauuuggaccuacaaugcugagcugcuggugcuccuggaaaacgagcggacacuugacuaucaugauuccaacgucaagaaucuguacgagaaagugcgcagccagcucaagaacaaugccaaagaaaucgggaacggauguuuugaguucuaucacaagugcgacaauaccuguauggaaucugucaagaacggcacauacgauuauccuaaauacuccgaggaagccaagcugaauagagaggagaucgacggggugaaacuugaaagcacgcggauuuaucaaauccuggcuauuuacucuaccguugccuccagccucgugcuggucgugucccugggcgcgaucucuuuuuggaugugcagcaacggaucccuccagugccgcauuuguaucuga

SEQ ID NO: 189713 - RNA, 1701 nt, Artificial Sequence
  derived and/or modified sequence opt5 from hemagglutinin__InfluenzaA__AEA74035
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccguggaucuccuggaagacaagcacaacgggaaacuuuguaagcugagaggaguugcuccccuccaucugggcaaaugcaauaucgccggguggauucugggaaacccugagugugaaucucucagcacagccuccucuuggagcuacaucguggagaccuccucuagcgauaauggcacgugcuauccgggggacuuuauugauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaacaaucugaucuggcucguuaagaaaggcaacagcuacccuaagcugaauaaauccuauauuaacgauaaggggaaggaagugcuuguccuguggggaauccaccaccccagcaccuccacagaccaacagucucucuaccagaaugccgaugcuuacguguucgugggcaccagcagauauuccaaaaaguuuaaaccugagauugccauccggccgaagguccgcgaccaggaggggagaaugaacuacuauuggacgcugguugaacccggagauaaaauuacauucgaggcuaccggcaaccugguggugccucgguacgccuuugcgauggaacgcaaugccgggagcggaaucauuaucucugacacacccauccaugacugcaacaccaccugucaaacaccuaagggcgcuauuaauacgucccuccccuuccagaacauccacccgauuaccaucggcaaaugcccuaaguaugucaagagcacaaaacugagacuugccaccgggcugcggaaugugcccucuauucagagccgcggacucuuuggcgcuaucgccggguucaucgagggaggcuggacagggaugguugauggaugguacggcuaucaucaccagaacgaacaaggcuccggguacgccgcugaccugaagucuacccagaaugcgauugaugagaucacgaacaaagugaauagcgucauugagaagaugaacacacaguuuaccgccgugggaaaagaguucaaucaccuugagaagagaaucgaaaaccugaauaagaaaguugacgauggcuuccucgacauuuggaccuacaacgcugagcugcuggugcuccuggaaaaugagcggacacuugauuaucaugacuccaacgucaagaaccuguacgagaaagugcgcagccagcucaagaauaacgccaaagaaaucgggaauggauguuuugaguucuaucacaagugcgauaacaccuguauggaaucugucaagaauggcacauacgacuauccuaaauacuccgaggaagccaagcugaacagagaggagaucgauggggugaaacuugaaagcacgcggauuuaucaaauccuggcuauuuacucuaccguugccuccagccucgugcuggucgugucccugggcgcgaucucuuuuuggaugugcagcaauggaucccuccagugccgcauuuguaucuga

SEQ ID NO: 189714 - RNA, 1701 nt, Artificial Sequence; identical to SEQ ID NO: 185458
  derived and/or modified sequence opt5 from hemagglutinin__InfluenzaA__AEA77299

SEQ ID NO: 189715 - RNA, 1701 nt, Artificial Sequence; identical to SEQ ID NO: 189459
  derived and/or modified sequence opt5 from hemagglutinin__InfluenzaA__AEB21316

SEQ ID NO: 189716 - RNA, 1701 nt, Artificial Sequence; identical to SEQ ID NO: 189478
  derived and/or modified sequence opt5 from hemagglutinin__InfluenzaA__AEB21326

SEQ ID NO: 189717 - RNA, 1701 nt, Artificial Sequence; identical to SEQ ID NO: 189459
  derived and/or modified sequence opt5 from hemagglutinin__InfluenzaA__AEB21338

SEQ ID NO: 189718 - RNA, 1701 nt, Artificial Sequence; identical to SEQ ID NO: 189478
  derived and/or modified sequence opt5 from hemagglutinin__InfluenzaA__AEB21348

SEQ ID NO: 189719 - RNA, 1701 nt, Artificial Sequence; identical to SEQ ID NO: 186612
  derived and/or modified sequence opt5 from hemagglutinin__InfluenzaA__AEB40206

SEQ ID NO: 189720 - RNA, 1701 nt, Artificial Sequence; identical to SEQ ID NO: 186612
  derived and/or modified sequence opt5 from hemagglutinin__InfluenzaA__AEB66895

SEQ ID NO: 189721 - RNA, 1698 nt, Artificial Sequence
  derived and/or modified sequence opt5 from hemagglutinin__InfluenzaA__AEB71102
auggacgugcccgucuucguucugcucaugcugaccagcaucugcgugcaggccgauagaauuugugugggcuaccuuuccacaaacucuagcgagcgggucgacacgcugcucgaaaauaacgugccuguuaccuccucuguggaucuggucgagacaaaucacaccgggacauauugcagccuuggaggcaucuccccggugcaucugggggacuguucuuuugaaggauggauuguuggcaaccccgcuugcgccagcaaucucgggauccgcgagugguccuaccugauugaagauccuagcgcgccccacggacuguguuauccuggcgagcucgacaacaauggcgagcugagacaucuuuucucugggauccgguccuuuagccgcaccgaacugaucgcucccacaucuuggggagaggugaacgauggcgucaccgccgccugccaagacaagggggcuuccagcuucuacagaaaucucgugugguuuguggaacggggaaacaaauauccugucauucgcagaacguacaauaacaccacaggccgggauguucuggugaucugggggauucaccauccggugucuaccgacgaggcccgcaaacuuuaugcuaaggauaaucccuacacacuggucuccaccagcuccuggucuagaaaguacaaccucgagacgggaacacggccuggcuauaauggccagaaaagcuggaccaagaucuacugguaucugaugcaccccggggacuccauuagcuucgaaucuaacggaggccugcucgccccuaaguacggguauaucauugaggaauacggaaaaggccgcaucuuucaguccagaauccggauugcgaaguguaacacaaaaugccagaccagcguugggggaaucaauaccaacaagacauuccaaaauauugagcgcaacgcccugggcgauugucccaaauauaucaagucuggccagcuuaagcuggcuacggggcucagaaaugugccggccauuagcaaccggggacuguuuggcgcuaucgccggguucaucgaaggaggcuggccugggcuuauuaauggcugguacggauuucagcaccagaacgagcaaggcauggggauggcggccgacaaagaguccacccagaaggcuaucgaccagauuacaaccaaaaucaauaacauuaucgaaaagaugaauggaaacuacgauucuaucagaggcgaguucagccagguggaacaacgcauuaauaugcuggccgaccggaucgaugacgcugucacagaugugugguccuauaacgccaaacuccugguucugcucgagaaugacaagacccuggauaugcaugacgccaacgugagaaaccuucacgaucagguccgccgggugcugagaacgaaugcuauugacgaagggaacggaugcuuugagcuccugcauaaauguaaugauagcugcauggagacaauccgcaacggcaccuacaaucacauugaauaugaggaagagucuaaacuuaagcggcaggaaaucgaggggauuaagcugaaguccgacgacaacgucuacaaagcgcucagcaucuauucuugcaucgccuccagcauugugcugguuggccugauccucgcuuucauuaugugggccuguuccucuggaaauugcagauucaacaucuguauuuga

SEQ ID NO: 189722 - RNA, 1698 nt, Artificial Sequence
  derived and/or modified sequence opt5 from hemagglutinin__InfluenzaA__AEB71896
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucguggaccagaaaacccuguacagaacagagaaugccuacgucagcguuguguccucucauuauagccggaaguucacccccgaaauugcuaagcgcccuaaagugagagaucaggagggccggaucaacuacuauuggacgcuucuggagcccggggacacaauuaucuuugaagccaauggaaaccucauugcgccucgcuacgccuucgcucuguccagaggcuuugggagcggaaucauuaauucuaacgcccccaugggcaagugugaugcuaaaugccagaccccgcaaggcgccaucaauuccagccuuccuuuccagaacguccaccccgugacaaucggggaguguccuaaguauguucggucugcgaaacugcgcauggugaccggacucagaaauauucccagcauccagucccggggccuguuuggggccauugcuggauucaucgaaggcggguggaccggaauggucgacggcugguacggcuaucaucaccagaacgagcaagggucuggauacgccgcugaucaaaagagcacacagaaugccauuaacggcaucacgaauaaagugaacuccguuaucgaaaagaugaauacccaguuuacagccguggggaaggaguucaacaaacuggagcgcagaauggaaaaccucaauaagaaagucgacgauggauucauugacaucuggaccuacaacgcugagcugcuugugcugcucgaaaaugagcggacacuggauuuucacgacagcaacgucaagaaucuuuaugaaaaagugaagucucagcugaagaacaaugcgaaagagauuggcaacgggugcuucgaguuuuaccauaaguguaaugacgaaugcauggaguccguuaaaaacggcaccuaugauuaccccaaguauagcgaagagucuaaacucaauaaggagaagaucgacggagugaaacuggaauccaugggcgucuaccagauucuggccaucuauagcacgguggcuuccucucucguucugcuugugagccugggggccaucuccuucuggaugugcucuaacggaagccuccagugucgcauuugcaucuga

SEQ ID NO: 189723 - RNA, 1701 nt, Artificial Sequence; identical to SEQ ID NO: 185935
  derived and/or modified sequence opt5 from hemagglutinin__InfluenzaA__AEB71916

SEQ ID NO: 189724 - RNA, 1701 nt, Artificial Sequence; identical to SEQ ID NO: 185458
  derived and/or modified sequence opt5 from hemagglutinin__InfluenzaA__AEB71925

SEQ ID NO: 189725 - RNA, 1701 nt, Artificial Sequence; identical to SEQ ID NO: 185458
  derived and/or modified sequence opt5 from hemagglutinin__InfluenzaA__AEB71936

SEQ ID NO: 189726 - RNA, 1701 nt, Artificial Sequence; identical to SEQ ID NO: 185458
  derived and/or modified sequence opt5 from hemagglutinin__InfluenzaA__AEB71947

SEQ ID NO: 189727 - RNA, 1698 nt, Artificial Sequence; identical to SEQ ID NO: 188996
  derived and/or modified sequence opt5 from hemagglutinin__InfluenzaA__AEB71958

SEQ ID NO: 189728 - RNA, 1701 nt, Artificial Sequence; identical to SEQ ID NO: 188443
  derived and/or modified sequence opt5 from hemagglutinin__InfluenzaA__AEB71969

SEQ ID NO: 189729 - RNA, 1701 nt, Artificial Sequence
  derived and/or modified sequence opt5 from hemagglutinin__InfluenzaA__AEB71980
augaagaccaucauugcccugagcugcauccucugucugguguucgcucagaaacuucccggcaacgacaauuccacagccacgcugugccucgggcaccaugcggucccuaacggaaccauuguuaagacaaucaccaaugaucaaauugaggugacaaacgcuaccgaacuggugcagucuagcuccacaggcgagaucugugacucuccgcaccagauccuugauggggaaaauugcacccugauugacgcccuccugggagauccccagugugacggcuuucaaaacaaaaagugggaucuguucgucgagagaagcaaagccuacuccaauugcuauccuuacgacgugcccgauuaugcuucucuccggagccugguugccuccagcgggacgcuugaauuuaacaaugagucuuucaacuggaccggagugacacagaauggcaccuccagcgcuuguauccgcagaucuaacaauuccuuuuucagccggcugaacuggcucacacaucugaaguuuaaguacccugcccuuaaugucaccaugcccaacaacgagcaguucgacaaacuguauauuuggggcgugcaccauccugggacggauaaugaccagaucuuucucuacgcgcaagccucuggacgcauuacaguuuccaccaagagaagccagcagacagugaucccgaacauuggcucccggccccgcgucagaaauaucccuucucggaucagcauuuauuggaccaucgugaaacccggggauauucugcugaucaacuccaccggaaaucucauugcuccucgcggcuacuucaagaucagaagcgggaaaucuuccaucaugcggagcgacgcccccauuggaaagugcaacucugaauguaucacaccgaauggcagcauuccuaacgacaagcccuuucagaaugugaaccgcaucacguacggcgcuugcccuagauaugucaaacaaaauacccugaaacuugccacagggaugcggaacguucccgagaagcagacccgcggaauuuucggcgcgaucgccggguuuaucgaaaauggaugggagggcaugguggaugggugguacggauucagacaccagaacuccgagggccggggccaagcugccgaccugaagucuacacaggcugccauugaucagaucaaugggaaacucaacagacugauuggaaagaccaacgaaaaauuccaccagaucgagaaggaauuuagcgagguggaaggccgcauucaagaccuugagaaguaugucgaggauacgaaaaucgaccugugguccuacaaugccgaacuccugguggcucuggagaaccagcauacaauugaucucaccgacagcgaaaugaauaagcuguucgagaaaaccaagaaacagcuucgggaaaacgcggaggauauggggaauggauguuuuaagaucuaucacaagugcgacaacgccugcaucggcucuauuagaaaugggacauacgaucaugacguuuaucgcgacgaggcucugaacaaucgguuccagaucaaaggcguggaacucaaguccggauacaaagauuggauucuguggaucagcuuugccauuucuuguuuccuucugugcgucgcccuccugggcuuuaucaugugggcuugucaaaaggggaacaucagaugcaauauuuguaucuga

SEQ ID NO: 189730 - RNA, 1698 nt, Artificial Sequence; identical to SEQ ID NO: 186640
  derived and/or modified sequence opt5 from hemagglutinin__InfluenzaA__AEB71992

SEQ ID NO: 189731 - RNA, 1698 nt, Artificial Sequence; identical to SEQ ID NO: 186640
  derived and/or modified sequence opt5 from hemagglutinin__InfluenzaA__AEC13313

SEQ ID NO: 189732 - RNA, 1701 nt, Artificial Sequence
  derived and/or modified sequence opt5 from hemagglutinin__InfluenzaA__AEC46553
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaggaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaccuccuauauuaaugacaaggggaaggaagugcuuguccuguggggaauccaccacccuagcacauccgccgaucaacagucucucuaccagaacgcugacgccuacgcuuucgugggcaccagcagauauuccaaaaaguuuaaaccggagauugccauccggcccaaggugcgcgaucaggaggggagaaugaauuacuauuggacgcuggucgaaccuggagacaaaauuacauucgaggcgaccggcaaccugguugugccccgguacgccuuugcuauggaacgcaacgccgggagcggaaucauuaucucugauacauccgugcaugacugcaauaccaccugucaaacaccuaagggcgcuaucaacacgagccuccccuuccagaauguccacccgauuaccaucggcaaaugcccuaaguaugugaagucuacaaaacugagacuugccaccgggcugcggaacguucccagcauucagucccgcggacucuuuggcgccaucgcuggguucauugagggaggcuggacagggaugguggacggaugguacggcuaucaucaccagaaugaacaaggcucuggguacgcggccgaucuuaagagcacccagaacgcuuuugacaaaaucacgaauaaggucaacuccgugaucgagaaaaugaauacacaguucaccgccguuggaaaggaguucaaccaccuugaaaagagaauugagaaucugaacaaaaagguggaugacggcuuucucgauaucuggaccuacaaugccgaacugcugguccuccuggagaacgaacggacacuugacuaucaugauagcaaugugaaaaaccuguacgagaagguccgcucucagcucaaaaacaaugcuaaggagauugggaacggauguuucgaauuuuaucacaagugcgacaauaccuguauggaguccgugaaaaacggcacauacgauuauccuaaguacagcgaagaggccaaacugaauagagaagagaucgacgggguuaagcuggagucuacgcggauuuaucaaauccuggcgaucuacuccaccguggcuagcucccucguccuggugguuucucugggcgccauuagcuucuggaugugcuccaacggaucucuccagugccgcaucuguauuuga

SEQ ID NO: 189733 - RNA, 1701 nt, Artificial Sequence
  derived and/or modified sequence opt5 from hemagglutinin__InfluenzaA__AEC46555
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaccuccuauauuaaugacaaggggaagaaagugcuuguccuguggggaauccaccacccuagcacauccgccgaucaacagucucucuaccagaacgcugacgccuacgcuuucgugggcaccagcagauauuccaagaaauuuaagccggaaauugccauccggcccaaagugcgcgaucaggaggggagaaugaauuacuauuggacgcuggucgagccuggagacaagauuacauucgaagcgaccggcaaccugguugugccccgguacgccuuugcuauggagcgcaacgaagggagcggaaucauuaucucugauacauccgugcaugacugcaauaccaccugucaaacaccuaaaggcgccaucaacacgagccuccccuuccagaauguccacccgauuaccaucggcaagugcccuaaguaugugaaaucuacaaagcugagacuugcuaccgggcugcggaacguucccagcauucagucccgcggacucuuuggcgccaucgccggguucauugagggaggcuggacagggaugguggacggaugguacggcuaucaucaccagaaugaacaaggcucuggguacgcugcggaucugaaaagcacccagaacgccuuugacaagaucacgaauaaagucaacuccgugaucgagaagaugaauacacaguucaccgcuguuggaaaggaguucaaccaccuugagaaaagaauugagaaucugaacaagaaaguggaugacggcuuucucgauaucuggaccuacaaugccgaacugcugguccuccuggagaacgaacggacacuugacuaucaugauagcaaugugaagaaccuguacgagaaaguccgcucucagcucaagaacaaugccaaggagauugggaacggauguuucgaauuuuaucacaaaugcgacaauaccuguauggaguccgugaagaacggcacauacgauuauccuaaauacagcgaagaggcuaagcugaauagagaagagaucgacgggguuaaacuugagucuacgcggauuuaucaaauccuggccaucuacuccaccguggcgagcucccucguccuggugguuucucugggcgcuauuagcuucuggaugugcuccaacggaucucuccagugccgcaucuguauuuga

SEQ ID NO: 189734 - RNA, 1701 nt, Artificial Sequence; identical to SEQ ID NO: 189732
  derived and/or modified sequence opt5 from hemagglutinin__InfluenzaA__AEC46557

SEQ ID NO: 189735 - RNA, 1701 nt, Artificial Sequence; identical to SEQ ID NO: 185680
  derived and/or modified sequence opt5 from hemagglutinin__InfluenzaA__AEC53259

SEQ ID NO: 189736 - RNA, 1701 nt, Artificial Sequence
  derived and/or modified sequence opt5 from hemagglutinin__InfluenzaA__AEC53269
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcuucuguccagcgucucuuccuucgaacgcuuugagaucuuccccaagaccagcucuuggccuaaucacgauuccaacaagggagugacagccgcuuguccccaugccggcgcgaaaucuuuuuauaagaaucucaucuggcugguuaaaaagggcaacagcuacccuaaacuuuccaagagcuauauuaaugacaaggggaaagaagugcugguccucuggggaauccaccaccccuccaccucugccgaucagcaaagccuguaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccucguggugccucgguacgcguuugccauggaacgcaacgcuggguccggaaucauuaucagcgauacacccguccaugacugcaauaccacaugucagaccccuaaaggcgccaucaacaccucucugcccuuccaaaauauucacccgaucacaauuggcaagugcccuaaguaugugaaaagcacgaaacuuagacuggcuaccgggcuccggaacauccccuccauucagucucgcggacuguuuggcgccaucgccggguucaucgagggaggcuggacagggaugguugacggaugguacggcuaucaucaccagaaugaacagggcagcggguacgcugcggaucuuaaguccacccaaaacgccauugacgagaucacaaauaaggugaacagcgucauugagaaaaugaauacccaguuuacggcugugggaaaggaguucaaccaccuggagaagagaaucgaaaaucucaacaaaaagguugaugacggcuuccuggauauuuggacauacaaugccgagcugcucgugcugcuugaaaacgagcggacccuggacuaucaugauucuaaugucaaaaaccucuacgagaaggugcgcucccagcugaaaaacaaugccaaggaaaucgggaacggauguuuugaguucuaucacaagugcgacaauaccuguauggaaagcgucaaaaacggcacauacgauuauccuaaguacucugaggaagcuaaacuuaauagagaggagaucgacggggugaagcuggaauccacccggauuuaucagauccucgccauuuacagcacaguugcguccucucuggugcuggucgugagccucggcgcuaucuccuuuuggaugugcucuaacggaagccugcaaugccgcauuuguaucuga

SEQ ID NO: 189737 - RNA, 1701 nt, Artificial Sequence; identical to SEQ ID NO: 186423
  derived and/or modified sequence opt5 from hemagglutinin__InfluenzaA__AEC53279

SEQ ID NO: 189738 - RNA, 1701 nt, Artificial Sequence; identical to SEQ ID NO: 185680
  derived and/or modified sequence opt5 from hemagglutinin__InfluenzaA__AEC53289

SEQ ID NO: 189739 - RNA, 1701 nt, Artificial Sequence; identical to SEQ ID NO: 185680
  derived and/or modified sequence opt5 from hemagglutinin__InfluenzaA__AEC53299

SEQ ID NO: 189740 - RNA, 1701 nt, Artificial Sequence; identical to SEQ ID NO: 185873
  derived and/or modified sequence opt5 from hemagglutinin__InfluenzaA__AEC53327

SEQ ID NO: 189741 - RNA, 1701 nt, Artificial Sequence
  derived and/or modified sequence opt5 from hemagglutinin__InfluenzaA__AEC53347
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugauugaacccggagacaagaucaccuucgaggccacgggcaaccugguugugccucgguacgcguuugccauggaacgcaacgcuggguccggaauuaucaucagcgauacacccgugcaugacugcaauaccacaugucaaaccccuaaaggcgccauuaacaccucucuccccuuccagaauauccacccgauuacaaucggcaagugcccuaaguaugucaaaagcacgaagcugagacuugcuaccgggcugcggaacgugcccuccauucagucucgcggacucuuuggcgccaucgccggguucaucgagggaggcuggacagggaugguugacggaugguacggcuaucaucaccagaaugaacaaggcagcggguacgcugcggaucugaaauccacccagaacgccauugacgagaucacaaauaaggugaacagcgucauugagaaaaugaauacccaguuuacggcugugggaaaggaguucaaccaccuugagaagagaaucgaaaaucugaacaaaaagguugaugacggcuuccucgauauuuggacauacaaugccgagcugcuggugcuccuggaaaacgagcggacccuugacuaucaugauucuaaugucaaaaaccuguacgagaaggugcgcucccagcucaaaaacaaugccaaggaaaucgggaacggauguuuugaguucuaucacaagugcgacaauaccuguauggaaagcgucaaaaacggcacauacgauuauccuaaguacucugaggaagcuaaacugaauagagaggagaucgacggggugaaacuugaauccacccggauuuaucaaauccuggccauuuacagcacaguugcguccucucucgugcuggucgugagccugggcgcuaucuccuuuuggaugugcucuaacggaagccuccagugccgcauuuguaucuga

SEQ ID NO: 189742 - RNA, 1701 nt, Artificial Sequence
  derived and/or modified sequence opt5 from hemagglutinin__InfluenzaA__AEC53404
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggaauuacagccgcuuguccccaugccggcgcgaaaucuuuuuauaagaaucuuaucuggcuggugaaaaagggcaacagcuacccuaaacucuccaagagcuauauuaaugacaaggggaaagaaguucuggugcuuuggggaauccaccaccccuccaccucugccgaucaacagagccuguaccagaacgcugacgccuacgucuucgugggcuccagcagauauucuaagaaauuuaagccugagauugcuauccggccgaaagugcgcgaucaggaggggagaaugaauuacuauuggacacucgucgaacccggagacaagauuaccuucgaggccacgggcaaccugguugugccucgguacgcguuugccauggaacgcaacgcuggguccggaaucaucauuagcgauacacccgugcaugacugcaauaccacaugucaaaccccuaaaggcgccaucaacaccucucugcccuuccagaauauucacccgaucacaauuggcaagugcccuaaguaugucaaaagcacgaagcucagacuggcuaccgggcuucggaacgugcccuccauccagucucgcggacuguuuggcgccaucgccggguucauugagggaggcuggacagggaugguugacggaugguacggcuaucaucaccagaaugaacaaggcagcggguacgcugcggaucucaaauccacccagaacgccaucgacgagauuacaaauaaggugaacagcgucaucgagaaaaugaauacccaguuuacggcugugggaaaggaguucaaccaccuggagaagagaauugaaaaucuuaacaaaaagguugaugacggcuuccuggauaucuggacauacaaugccgagcuccuggugcugcucgaaaacgagcggacccuggacuaucaugauucuaaugucaaaaaccuuuacgagaaggugcgcucccagcugaaaaacaaugccaaggaaaucgggaacggauguuuugaguucuaucacaagugcgacaauaccuguauggaaagcgucaaaaacggcacauacgauuauccuaaguacucugaggaagcuaaacucaauagagaggagauugacggggugaagcuggaauccacccggaucuaucaaauucuugccaucuacagcacaguugcguccucucuggugcucgucgugagccugggcgcuauuuccuuuuggaugugcucuaacggaagccugcagugccgcaucuguauuuga

SEQ ID NO: 189743 - RNA, 1701 nt, Artificial Sequence; identical to SEQ ID NO: 185680
  derived and/or modified sequence opt5 from hemagglutinin__InfluenzaA__AEC53414

SEQ ID NO: 189744 - RNA, 1701 nt, Artificial Sequence
  derived and/or modified sequence opt5 from hemagglutinin__InfluenzaA__AEE27177
augaagaccauccuggugguccuccuguacacauucgccacggcuaacgccgacacccuuugcauuggcuaucacgcgaauaacagcacagauaccguugacacagugcuggagaaaaaugugaccgucacacauuccgugaacauccucgaagauaagcacaaugggaaacuguguaaacuuagaggaguugcuccccugcaucucggcaaaugcaacauugccggguggauccugggaaauccugagugugaaucucugagcaccgccuccucuuggagcuacauuguggagacguccucuagcgacaacgggaccugcuauccgggggauuuuaucgacuacgaagaacuccgggagcagcuguccagcgucucuuccuucgaacgcuuugagaucuuccccaagacaagcucuuggccuaaucacgauuccaacaagggagugaccgcugccuguccccaugcuggcgccaagagcuuuuauaagaaucuuauuuggcugguuaaaaagggcaacucuuacccuaaacucuccaagagcuauaucaaugacaagagaaaagaagugcugguccuuugggggauucaccaccccuccacaucugcggaucaacagagccuguaccagaacgccgacgcuuacguguucgugggauccagccgguauucuaagaaauuuaagccugagaucgccauucgcccgaaagucagagaucaggagggccggaugaauuacuauuggacccucguugaacccggggacaagaucacguucgaggcuacaggaaaccugguggugccucgcuacgccuuugcgauggaaagaaacgccggcuccgggauuaucaucagcgauacccccguccaugacugcaauacaaccugucaaaccccuaaaggagcuauuaacacaucucugcccuuccagaauauccacccgauuacgaucggcaagugcccuaaguaugugaaaagcaccaagcuccggcuggccacaggccuucgcaacguucccuccauucagucuagagggcuguuuggagcuaucgccggcuucaucgagggcggauggaccggcaugguggacgggugguacggauaucaucaccagaaugaacaaggcagcggcuacgccgcugaucucaaauccacacagaacgcgauugacgagaucaccaauaaggucaacagcgugauugagaaaaugaauacgcaguuuacagccguugggaaggaguucaaccaccuggagaagcggaucgaaaaucuuaacaaaaagguggaugacggauuccuggauauuuggaccuacaaugcugagcuccugguccugcucgaaaacgagcgcacccuggacuaucaugauucuaaugugaaaaaccuuuacgagaaggucagaucccagcugaaaaacaaugccaaggaaaucggcaacggguguuuugaguucuaucacaagugcgacaauacauguauggaaagcgugaaaaacggaaccuacgauuauccuaaguacucugaggaagccaaacucaaucgggaggagaucgacggcguuaagcuggaauccacacgcauuuaucaaauccuugcuauuuacagcacgguggccuccucucugguccucgugguuagccugggggcgaucuccuuuuggaugugcucuaacggcagccugcagugcagaauuuguaucuga

SEQ ID NO: 189745 - RNA, 1701 nt, Artificial Sequence; identical to SEQ ID NO: 187465
  derived and/or modified sequence opt5 from hemagglutinin__InfluenzaA__AEE27187

SEQ ID NO: 189746 - RNA, 1701 nt, Artificial Sequence
  derived and/or modified sequence opt5 from hemagglutinin__InfluenzaA__AEE27207
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaagugaagaaucuguacgagaaaguccgcucucagcucaagaacaacgccaaggaaauugggaauggauguuuugaguucuaucacaaaugcgacaacacauguauggaauccgugaagaauggcaccuacgauuauccuaaauacagcgaggaagcuaagcugaacagagaggagaucgacgggguuaaacuugaaucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 189747 - RNA, 1701 nt, Artificial Sequence
  derived and/or modified sequence opt5 from hemagglutinin__InfluenzaA__AEG64752
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucuccccuuccagaauauucacccgaucacaauuggcaagugcccuaaguaugugagaagcacgaaacugcggcuugcuaccgggcugcgcaacguucccuccauccagucuagaggacucuuuggcgccauugccggguucaucgagggaggcuggacagggaugguggacggaugguacggcuaucaucaccagaaugaacaaggcagcggguacgcugcggaucugaaguccacccagaacgccaucgacgagauuacaaauaaagucaacagcgugaucgagaagaugaauacccaguuuacggcuguuggaaaagaguucaaccaccuugagaagcggauugaaaaucugaacaagaaaguggaugacggcuuccucgauaucuggacauacaaugccgagcugcugguccuccuggaaaacgagcgcacccuugacuaucaugauucuaaugugaagaaccuguacgagaaagucagacggcagcucaagaacaaugccaaagaaauugggaacggauguuuugaguucuaucacaagugcgacaauaccuguauggaauccgugaagaacggcacauacgauuauccuaaauacagcgaggaagcuaagcugaaucgcgaggagaucgacgggguuaaacuugaaucuaccagaaucuaucaaauucuggccaucuacuccacaguggcgagcucccucguccuggugguuucucugggcgcuauuagcuuuuggaugugcuccaacggaucucuccagugccggaucuguauuuga

SEQ ID NO: 189748 - RNA, 1701 nt, Artificial Sequence
  derived and/or modified sequence opt5 from hemagglutinin__InfluenzaA__AEG64762
augaaggccagacugcucgugcugcuuugcgcucuggccgcgaccgacgcugauacaaucuguauuggcuaccacgccaacaauagcacggacaccgucgauacacuccuggagaaaaacguuaccgugacacauuccgugaaucuucuggaagacucucacaacgggaagcucugcaaacugaagggaaucgcuccccugcagcucggcaaauguaauauugccggguggcugcuuggaaacccugagugcgauagccugcucccggcccgguccuggucuuauaucgucgaaacccccaauagcgagaacggcgcuuguuacccuggggacuucauugauuaugaagaacugcgcgagcaacuuuccacagugucuagccuggaaagauuugagaucuuccccaaggaauccagcuggccuaaucauaacacccucaagggaguuacggugucuugcucccacggcggcaaaagcucuuuuuaccggaaucugcuguggcucaccaagacaggggacuccuaucccaaacugaacaauagcuacgucaacaauaagggaaaagaggugcuuguucuguggggcgugcaucacccuucuuccagcaacgagcagcagucccucuaucacaacgucaaugccuacgugucuguggucagcuccaacuacaaucgcagauucaccccggaaaucgcggcccggcccaagguucgcgaucagccugggagaaugaacuauuacuggacacugcuugagcccggagacaccauucuguuugaagcuacgggcaaucucaucgccccuugguaugcuuucgcccugagccggggguuuggaucuggcauuaucacauccaacgcgagcaugcaugaguguaauaccaagugccaaacaccccagggcgccauuaacucuagccugccguuccagaauauccacccugugaccauuggggaaugucccaaauacgugcgcuccaccaagcucagaauggucacaggacugcggaacaucccuucuauccagagccgcggccuuuuuggggcuauugccggauucaucgagggcggguggacgggaaugauugauggcugguauggcuaccaucaccaaaaugagcagggguccggauaugcugccgaccagaaaagcacccagaacgccaucaauggcauuacaaacaagguuaauucugugaucgagaaaaugaacacccaauuuacagcuguggggaaggaguucaacaaucuggagaaaagaauggaaaaccucaauaagaaggucgaugacggauuucuggacaucuggaccuacaacgcggaacuucuggugcuccuggagaaugagcggacgcuggauuuccacgaccucaacguuaaaaaucuguacgaaaaggugaaaucccagcuuaagaacaaugccaaagagauuggcaacgggugcuucgaauuuuaucauaagugugauaaugagugcauggaaagcguccgcgacggcacauacgauuaucccaaguacucugaggaguccaaacugaacagagaaaagaucgacggagugaaacucgagagcaugggcgucuaucagauucuggcuaucuacuccaccguggccucuagccugguucuucucgugucccugggggccauuucuuucuggaugugcagcaauggaucccugcaaugucggaucugcaucuga

SEQ ID NO: 189749 - RNA, 1701 nt, Artificial Sequence; identical to SEQ ID NO: 185693
  derived and/or modified sequence opt5 from hemagglutinin__InfluenzaA__AEG64784

SEQ ID NO: 189750 - RNA, 1701 nt, Artificial Sequence
  derived and/or modified sequence opt5 from hemagglutinin__InfluenzaA__AEG64834
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcgccggcgagaucugcgacuccccgcaccagauccuugauggggaaaacuguacacugauugacgcccuccugggagauccccagugcgacggcuuucagaauaaaaagugggaucuguucgucgagagaucucgggcuuauagcaacuguuacccuuaugacgugcccgauuacgccucccuccgcucucugguugcuagcuccgggacccuugaauuuaauaacgagagcuucaauuggacgggagugacccagaacggcacaucuuccgccugcaucagacggagcaauaacuccuuuuucucucgccugaauuggcucacccaucugaacuuuaaauauccugcgcuuaacgucacaaugcccaauaacgagcaguucgacaagcuguacauuuggggcgugcaccauccugggaccgauaaggaccagaucuuucucuaugcccaagcuagcggaagaauuacgguuucuacaaaacggucccagcaggccgugaucccgaauauuggcagccgccccagaguccggaacaucccuucccgcaucucuauuuacuggaccaucgugaagcccggggauauucugcugaucaauagcacaggaaaccucauugcuccuagaggcuacuucaaaauccgguccgggaaaagcucuaucaugcgcuccgacgcccccauuggaaaauguaauagcgaaugcaucaccccgaacggcucuauuccuaaugacaagcccuuucagaacgugaauagaaucaccuauggcgcguguccucgguacgucaagcaaagcacacugaaacuugccacggggaugcgcaacguucccgagaagcagaccagaggaauuuucggcgcuaucgccggguuuaucgaaaauggaugggagggcaugguggaugggugguauggauuccggcaccagaacuccgagggcagaggccaagcugccgaccugaaaucuacacaggccgcuauugaucagaucaaugggaagcucaaccgccugauuggaaaaaccaacgaaaaguuccaccagaucgagaaagaauuuagcgagguggaaggccggauucaagaccuugagaaguacgucgaggauacaaagaucgaccugugguccuauaaugcggaacuccugguggcccuggagaaccagcauaccauugaucucacggacagcgaaaugaauaaacuguucgagaagacaaagaagcagcuuagagaaaacgcugaggauauggggaauggaugcuuuaaaaucuaccacaagugugacaacgccugcaucggcucuauucgcaaugggaccuaugaucaugacguuuaccgggacgaggcccugaacaauagauuccagaucaagggcguggaacucaaauccggauacaaggauuggauucuguggaucagcuuugcuauuucuugcuuccuucugugugucgcccuccugggcuuuaucaugugggcgugccaaaaagggaacauccgcuguaauauuugcaucuga

SEQ ID NO: 189751 - RNA, 1701 nt, Artificial Sequence
  derived and/or modified sequence opt5 from hemagglutinin__InfluenzaA__AEG64845
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgagaucugcgacuccccgcaccagauccuugauggggaaaacuguacccugauugacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacgcuugaauuuaauaacgagagcuucaauuggaccggagugacacagaacggcaccucuuccgcuugcauccgcagaagcaauaacuccuuuuucucucggcugaauuggcucacacaucugaacuuuaaguauccugcccuuaacgucaccaugcccaauaacgagcaguucgacaagcuguacauuuggggcgugcaccauccugggacggauaaagaccagaucuuucucuaugcgcaagccagcggacgcauuacaguuucuaccaagagaucccagcagacagugaucccgaauauuggcagccggccccgcgucagaaacaucccuucccggaucucuauuuacuggaccaucgugaaacccggggauauucugcugaucaauagcaccggaaaccucauugcuccucgcggcuacuucaagaucagauccgggaaaagcucuaucaugcgguccgacgcccccauuggaaaguguaauagcgaaugcaucacaccgaacggcucuauuccuaaugacaagcccuuucagaacgugaaucgcaucacguauggcgcuuguccuagauacgucaaacaaaacacccugaaacuugccacagggaugcggaauguucccgagaagcagacccgcggaauuuucggcgcgaucgccggguuuaucgaaaacggaugggagggcaugguggaugggugguauggauucagacaccagaauagcgagggccggggccaagcugccgaccugaaguccacacaggcugccauugaucagaucaacgggaaacucaacagacugauuggaaagaccaaugaaaaauuccaccagaucgagaaggaauuuucugagguggaaggccgcauucaagaccuugagaaguacgucgaggauacgaaaaucgaccuguggagcuauaacgccgaacuccugguggcucuggagaaucagcauacaauugaucucaccgacuccgaaaugaacaagcuguucgagaaaaccaagaaacagcuucgggaaaaugcggaggauauggggaacggaugcuuuaagaucuaccacaagugugacaaugccugcaucggcagcauuagaaacgggacauaugaucaugacguuuaccgcgacgaggcucugaauaaccgguuccagaucaaaggcguggaacucaagucuggauacaaagauuggauucuguggaucuccuuugccauuagcugcuuccuucugugugucgcccuccugggcuuuaucaugugggcuugccaaaaggggaauaucagauguaacauuugcaucuga

SEQ ID NO: 189752 - RNA, 1701 nt, Artificial Sequence
  derived and/or modified sequence opt5 from hemagglutinin__InfluenzaA__AEG64856
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuaacaaguccuuuuucagccgccucaauuggcugcaccagcuuaaguauaaauacccugcgcugaacgucaccaugcccaauaacgagaaguuugacaaacucuauauuuggggcgugcaucacccuucuacagauuccgaccagaucagccuguacgcccaggcuuccgggagaguuaccgugucuacgaagcggagccaacagacagucauuccgaacaucggaucccgccccugggugagaggcgugagcucucggauuuccaucuacuggaccauugucaaaccuggggauauccugcucaucaauagcacaggaaaccugauugcuccccgcggcuauuucaagaucagaucugggaagucuuccguuaugcggucugacgccagcauuggaaaauguaauuccgaaugcaucaccccuaacggcagcauucccaaugacaagccguuucagaacgugaaucgcaucaccuacggcgccuguccuagauaugugaaacagaacacacuuaagcuggcgacggggaugcggaauguccccgagaaacaaacccgcggaaucuucggcgccauugcuggguuuaucgaaaacggaugggagggcaugguggaugggugguacggauucagacaccagaauagcgagggcacaggccaggccgcugaccucaaguccacccaagccgccauuaaccagaucaaugggaaacugaaccggcuuauugaaaagacaaaugagaaguuucaucagaucgaaaaagaguucagcgaaguugagggaagaauccaggaucuggagaaguauguggaagacaccaaaauugaucucuggucuuacaacgcugagcugcuggucgcgcucgaaaaccaacacacgaucgaccugacagauuccgagaugaauaaacuuuucgaacgcaccaagaagcagcugcgggagaacgccgaggacaugggcaaugggugcuuuaagauuuaucauaaaugugauaacgcuugcaucgaaagcauuagaaauggaaccuacgaccacgauguguaccgcgacgaggcccucaacaaucgguuccagaucaagggcguugaacugaaauccggguauaaggacuggauucuuuggaucucuuuugccaucagcugcuuccugcucugugugguccugcugggcuuuauuaugugggcuugccagaaaggaaacaucagauguaauauuugcaucuga

SEQ ID NO: 189753 - RNA, 1701 nt, Artificial Sequence; identical to SEQ ID NO: 183096
  derived and/or modified sequence opt5 from hemagglutinin__InfluenzaA__AEG64867

SEQ ID NO: 189754 - RNA, 1701 nt, Artificial Sequence
  derived and/or modified sequence opt5 from hemagglutinin__InfluenzaA__AEG64878
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuguggccuccagcggcacccuggaauuuaacaaugagucuuucaacuggacaggggucgcucagaauggaaccuccagcgccugcaagagacggucuauuaaauccuuuuucagccgccucaacuggcugcaucaacuuaaguauaaguacccugcgcugaaugugacaaugcccaacaaugagaaauuugacaagcucuauaucuggggcguucaccacccuucuaccgauuccgaccagauuagccuguacgcccaggcuuccggcagagugacggucucuacaaaacggagccagcaaaccgugaucccgaacauugggucccgccccugggugagaggagucagcucucggaucuccauuuacuggacaaucguuaagccuggcgauauccugcucauuaacagcaccgggaaucugaucgcccccagaggauauuucaaaauuagaucuggcaagagcuccaucaugcggucuaacgcuccuauugggaaguguaauagcgaaugcaucacccccaacggauccaucccgaaugacaaaccuuuucagaacgugaaucgcauuacauacggcgccugucccagauaugugaagcagaacacgcuuaaacuggcgaccggcaugcggaaugucccugagaagcagacacgcgggaucuucggagccauugcuggcuuuaucgaaaacgggugggagggaaugguggacggcugguacggguucagacaucaaaauagcgagggaauuggccaggccgcugaucucaaaucuacccaggccgccaucaaccaaaucaauggcaagcugaaccggcuuauugagaaaacaaaugaaaaguuucaccagaucgaaaaggaguucuccgaaguugaggggcgcauucaggaccuggagaaauauguggaagauaccaagaucgaccucuggagcuacaacgcugagcugcuggucgcgcucgaaaaccagcauacgauugaucugacagacucugagaugaauaaacuuuucgaacgcacccggaagcaacugagagagaacgccgaggauaugggaaauggcugcuuuaaaaucuaucacaagugugacaacgcuugcauuggguccauccgcaauggaaccuacgaucacgacguguaccgggaugaagcccucaacaauagauuccagaucaagggcguugagcugaaaagcggguauaaggacuggauucuuuggaucuccuuugccauuucuugcuuccugcucugugugguccugcugggcuuuaucaugugggcuugccagaaaggaaacauucgcuguaauaucugcaucuga

SEQ ID NO: 189755 - RNA, 1701 nt, Artificial Sequence
  derived and/or modified sequence opt5 from hemagglutinin__InfluenzaA__AEG64889
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuuuugccuccagcggcacccuggaguucaacaaugaaucuuuuaacuggacagggguggcucagaauggaaccuccagcgccugcaagagacggucuauuaaauccuucuuuagccgccucaacuggcugcaucaacuuaaguauaaguacccugcgcugaaugucacaaugcccaacaaugagaaauucgacaagcucuauaucuggggcgugcaccacccuucuaccgauuccgaccagauuagccuguacgcccaggcuuccggcagaguuacggugucuacaaaacggagccagcaaaccgucaucccgaacauugggucccgccccugggugagaggagugagcucucggaucuccauuuacuggacaaucgucaagccuggcgauauccugcucauuaacagcaccgggaaucugaucgcuccccgcggauauuuuaaaauuagaucuggcaagagcuccaucaugcggucuaacgccccuauugggaaguguaauagcgaaugcaucacccccaacggauccaucccgaaugacaaaccuuuccagaacguuaaucgcauuacauacggcgccugucccagauaugugaagcagaacacgcuuaaacuggcgaccggcaugcggaaugugccugagaagcagacacgcgggaucuuuggagccauugcuggcuucaucgaaaacgggugggagggaauggucgacggcugguacggguuuagacaucaaaauagcgagggaaccggccaggccgcugaucucaaaucuacacaggccgccauuaaccaaaucaauggcaagcugaaccggcuuaucgaaaagaccaaugagaaguuccaccagauugaaaaggaguucuccgaaguggaggggagaauccaggaccuggagaaauauguugaagauacgaagauugaccucuggagcuacaacgcugagcugcugguggcgcucgaaaaccagcauacaaucgaucugaccgacucugagaugaauaaacuuuuugaaaagacccgcaaacaacugcgggagaacgccgaggauaugggaaauggcugcuucaagauuuaucacaagugugacaacgcuugcaucggguccauuagaaauggaacauacgaucacgacgucuaccgcgaugaagcccucaacaaucgguuucagaucaaaggcguggagcugaaaagcggguauaaagacuggauccuuuggauuuccuucgccaucucuugcuuucugcucuguguugugcugcugggcuucauuaugugggcuugccagaagggaaacaucagauguaauauuugcaucuga

SEQ ID NO: 189756 - RNA, 1701 nt, Artificial Sequence; identical to SEQ ID NO: 183056
  derived and/or modified sequence opt5 from hemagglutinin__InfluenzaA__AEG64911

SEQ ID NO: 189757 - RNA, 1701 nt, Artificial Sequence; identical to SEQ ID NO: 183056
  derived and/or modified sequence opt5 from hemagglutinin__InfluenzaA__AEG64922

SEQ ID NO: 189758 - RNA, 1701 nt, Artificial Sequence; identical to SEQ ID NO: 183056
  derived and/or modified sequence opt5 from hemagglutinin__InfluenzaA__AEG64933

SEQ ID NO: 189759 - RNA, 1701 nt, Artificial Sequence; identical to SEQ ID NO: 183142
  derived and/or modified sequence opt5 from hemagglutinin__InfluenzaA__AEG64944

SEQ ID NO: 189760 - RNA, 1701 nt, Artificial Sequence; identical to SEQ ID NO: 183056
  derived and/or modified sequence opt5 from hemagglutinin__InfluenzaA__AEG64955

SEQ ID NO: 189761 - RNA, 1701 nt, Artificial Sequence; identical to SEQ ID NO: 183056
  derived and/or modified sequence opt5 from hemagglutinin__InfluenzaA__AEG64966

SEQ ID NO: 189762 - RNA, 1701 nt, Artificial Sequence
  derived and/or modified sequence opt5 from hemagglutinin__InfluenzaA__AEG64977
augaagaccaucauugcccugagcuacauccucugccugguguucgcucagaaacuucccgagaacgacaauuccacagccacgcugugucucggccaccaugcggucccuaacgggaccauuguuaagacaaucaccaaugaucaaauugaagugacaaacgcuaccgagcuggugcagucuagcuccacaggaggcaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucgacuggaccggagugacacagaacggcaccuccagcgcuugcaagcgcagaucuaauaaguccuuuuucagccggcugaacuggcucacacaucugaaauauaaguacccugcccuuaaugucaccaugcccaacaaugagaaauuugauaagcuguauaucuggggcgugcaccauccugggacggacucugaucagauuucccucuacgcgcaggccagcggacgcaucacaguuuccaccaaaagaucucaacagacagugauuccgaacaucggcagccggccccgcgucagagacguguccagccggauuucuaucuacuggaccaucgugaagccuggggacauucugcugaucaacuccaccggaaaucucauugcuccccgcggcuauuucaagaucagaagcgggaaaucuagcauuaugcgguccgaugccccuaucgacaaguguaacucugaaugcaucacacccaauggaagcauuccgaacgauaaaccuuuucagaaugucaaccgcaucacguacggcgcuugucccagauauguuaagcagaauacccugaaacuugccacaggcaugcggaacgugccugagaagcaaacccgcgggauuuucggagcgaucgccggcuuuauugaaaaugggugggagggaaugguggacggcugguacggguucagacaccagaacuccgagggaacaggccaggcugccgaucugaaaagcacccaagcugccaucaaucagaucaacggcaagcucaaucggcugauugggaagacgaacgaaaaauuucaccagaucgagaaggaguucucugaagucgaaggacgcauucaggaccuugagaaauauguggaggauacaaagaucgaccugugguccuacaaugccgaacuccugguugcucuggagaaccaacauaccauugaucucaccgacagcgaaaugaacaaacuguucgagagaacaaagaagcagcuucgggaaaaugcggaggauaugggcaacgggugcuuuaaaaucuaucacaagugugacaaugccugcauuggaucuaucagaaacggcaccuacgaccaugauguguaccgcgacgaggcucugaauaaccgguuccagaucaaaggggucgaacucaaguccggcuauaaagauuggauucuguggaucagcuuugccauuuccugcuuccuucuguguguggcccuccugggauuuaucaugugggcuugccagaagggcaauauuagauguaacaucugcaucuga

SEQ ID NO: 189763 - RNA, 1701 nt, Artificial Sequence
  derived and/or modified sequence opt5 from hemagglutinin__InfluenzaA__AEG64988
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacaugccgcaccagauccuugauggggaaaauuguacccugauugacgcccuccugggagauccccagugcgacggcuuucaaaacaaaaagugggaucuguucgucgagagaucuaaagccuauagcaauuguuacccuuaugacgugcccgauuacgcuucccuccggucucugguugccagcuccgggacgcuugaauuuaacaaugagagcuucaacuggaccggagugacacagaauggcaccucuuccgcuugcaagcgcagaagcaacaauagcuuuuucucccggcugaacuggcucacacaucugaaguuuaaauauccugcccuuaaugucaccaugcccaacaacgagaaguucgacaaacuguacaucuggggcgugcaccauccugggacggauaaugaccagauuuuucucuaugcgcaggccagcggacgcaucacaguuucuaccaagagaucccaacagacagugauuccgaacaucggcagccggccccgcgucagaaauauuccuucccggaucucuaucuacuggaccauugugaaacccggggauauccugcugauuaacagcaccggaaaucucaucgcuccucgcggcuacuucaagauuagauccgggaagucuucuaucaugcgguccgacgcccccaucggaaaauguaacagcgaaugcauuacaccgaauggcucuaucccuaacgacaagcccuuucagaaugugaaccgcauuacguauggcgcuuguccuagauacgucaaacagaauacccugaaacuugccacagggaugcggaacguucccgagaagcaaacccgcggaaucuucggcgcgauugccggguuuaucgaaaauggaugggagggcaugguggaugggugguauggauucagacaccagaacagcgagggcaucggccaggcugccgaccugaaguccacacaagcugccauuaaucagaucaacgggaaacucaaccggcugauuggaaagaccaaugaaaaguuccaccagaucgagaaagaauuuucugagguggaaggccgcauucaggaucuugagaaguacgucgaggacacgaaaaucgaucuguggagcuauaacgccgaacuccugguggcucuggagaaucaacauacaauugaccucaccgauuccgaaaugaacaagcuguucgagagaaccaaaaagcagcuucgggaaaaugcggaggacauggggaacggaugcuuuaagaucuaccacaaaugugauaaugccugcaucggcagcauuagaaacgggacauaugaccaugauguuuaccgcgacgaggcucugaauaaccgguuccagaucaagggcguggaacucaaaucuggauacaaggacuggauucuguggaucuccuuugccauuagcugcuuccuucugugugucgugcuccugggcuuuaucaugugggccugccagaaagggaauaucagauguaacauuugcaucuga

SEQ ID NO: 189764 - RNA, 1701 nt, Artificial Sequence
  derived and/or modified sequence opt5 from hemagglutinin__InfluenzaA__AEG64999
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgggaucugcgacuccccgcaccagauccuugauggagagaacuguacccugauugacgcccuccugggcgauccccagugcgacggguuucagaauaaaaagugggaucuguucgucgaaagaucuaaagccuauagcaacuguuacccuuaugacgugcccgauuacguuucccuccggucucugguggcuagcuccggaacgcuugaguuuaauaacgaaucuuucaauuggaccggcgucacacagaacggcaccucuuccgccugcaagcgcagaagcaauaacagcuuuuucucccggcugaauuggcucacacaucugaaguuuaaauauccugcucuuaacgugaccaugcccaacaaugagaaguucgacaaacuguacaucuggggaguucaccauccugggacggauaacgaccagauuagccucuaugcccaggcgucuggccgcaucacaguguccaccaagagaagccaacagacagucauuccgaauaucgggucccggccccgcgugagagauauuccuucucggaucagcaucuacuggaccauugugaaacccggagacauccugcugauuaacuccaccggcaaucucaucgccccucgcggguacuuuaagauuagaagcggaaagucuuccaucaugcggagcgacgcucccaucggcaaauguaacucugagugcauuacaccgaauggcagcaucccuaacgauaagcccuuccagaaugucaaccgcauuacguauggggccuguccuagauacguuaaacagaauacccugaaacuugcuacaggaaugcggaacgugcccgaaaagcaaacccgcggcaucuuuggggccauugcgggauucaucgagaauggcugggaagggaugguggacggaugguauggcuuuagacaccagaacuccgagggcaucgggcaggccgcugaucugaagucuacacaagccgcuauuaaucagaucaacggaaaacucaaccggcugauuggcaagaccaaugagaaguuccaccagaucgaaaaagaguucagcgaagucgaggggcgcauucaggaccuugaaaaguacguggaggauacgaaaaucgaccugugguccuauaacgccgagcuccugguugcccuggaaaaucaacauacaauugaucucaccgacagcgagaugaacaagcuguuugaaagaaccaaaaagcagcuucgggagaaugcugaagauaugggaaacggcugcuucaagaucuaccacaaaugugacaaugcgugcaucgggucuauuagaaacggcacauaugaucaugacguguaccgcgacgaggcccugaauaaccgguuucagaucaagggagucgagcucaaauccggcuacaaggauuggauucuguggaucagcuucgcuauuucuugcuuucuucuguguguggcccuccugggguucaucaugugggccugccagaaaggaaauaucagauguaacauuugcaucuga

SEQ ID NO: 189765 - RNA, 1701 nt, Artificial Sequence; identical to SEQ ID NO: 183279
  derived and/or modified sequence opt5 from hemagglutinin__InfluenzaA__AEG65010

SEQ ID NO: 189766 - RNA, 1701 nt, Artificial Sequence
  derived and/or modified sequence opt5 from hemagglutinin__InfluenzaA__AEG65021
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacguuucucuccggagccugguggcuuccagcggaacgcuugaguuuaacaaugaaucuuucaacuggaccggcgucacacagaauggcaccuccagcgccugcaagcgcagaucuaacaauuccuuuuucagccggcugaacuggcucacacaucugaaguuuaaauauccugcucuuaaugugaccaugcccaacacggagaaguucgacaaacuguacaucuggggaguucaccauccugggacagauaacgaccagauuucucucuaugcccaggcguccggccgcaucaccgugagcacaaagagaucccaacagaccgucauuccgaauaucgggucucggccccgcgugagagauauuccuagccggaucuccaucuacuggaccauugugaaacccggagacauccugcugauuaacagcacaggcaaucucaucgccccucgcggguacuuuaagauuagaucuggaaaguccagcaucaugcggucugacgcucccaucggcaaauguaacagcgagugcauuacgccgaauggcuccaucccuaacgauaagcccuuccagaaugucaaccgcauuaccuauggggccuguccuagauacguuaaacagaauacacugaaacuugcuaccggaaugcggaacgugcccgaaaaacaaacacgcggcaucuuuggggccauugcgggauucaucgagaauggcugggaagggaugguggacggaugguauggcuuuagacaccagaacucugagggcaucgggcaggccgcugaucucaagagcacccaagccgcuauuaaucagaucaacggaaaacugaaucggcugauuggcaagacgaacgagaaguuccaccagaucgaaaaagaguucuccgaagucgaggggcgcauucaggaccuugaaaaguacguggaggauacaaaaaucgaccuguggagcuauaacgccgagcuccugguugcccuggaaaaucaacauaccauugaucucaccgacucugagaugaacaagcuguuugaaagaacaaagaagcagcuucgggagaaugcugaagauaugggaaacggcugcuucaagaucuaccacaaaugugacaaugcgugcaucggguccauuagaaacggcaccuaugaucaugacguguaccgcgacgaggcccugaauaaccgguuucagaucaagggagucgagcucaaaagcggcuacaaggauuggauucuguggaucucuuucgcuauuuccugcuuucuucuguguguggcccuccugggguucaucaugugggccugccagaaaggaaauaucagauguaacauuugcaucuga

SEQ ID NO: 189767 - RNA, 1701 nt, Artificial Sequence
  derived and/or modified sequence opt5 from hemagglutinin__InfluenzaA__AEG65032
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuuuucucuaugcgcaggccucuggccgcaucacaguuuccaccaagagaagccaacagacagugauuccgaacaucgggucccggccccgcgucagaaauauuccuucucggaucagcaucuacuggaccauugugaaacccggagauauccugcugauuaacuccaccggcaaucucaucgcuccucgcggguacuucaagauuagaagcggaaagucuuccaucaugcggagcgacgcccccaucggcaaauguaacucugagugcauuacaccgaauggcagcaucccuaacgacaagcccuuucagaaugugaaccgcauuacguauggggcuuguccuagauacgucaaacagaauacccugaaacuugccacaggaaugcggaacguucccgaaaagcaaacccgcggcaucuucggggcgauugccggauuuaucgagaauggcugggaagggaugguggauggaugguauggcuucagacaccagaacuccgagggcaucgggcaggcugccgaccugaagucuacacaagcugccauuaaucagaucaacggaaaacucaacaagcugauuggcaagaccaaugagaaauuccaccagaucgaaaaggaguuuagcgaaguggaggggcggauucaggaucuugaaaaauacgucgaggacacgaagaucgaucugugguccuauaacgccgagcuccugguggcucuggaaaaucaacauacaauugaccucaccgauagcgagaugaacaaacuguucgaaagaaccaagaagcagcuucgcgagaaugcggaagacaugggaaacggcugcuuuaaaaucuaccacaagugugauaaugccugcaucgggucuauucggaacggcacauaugaccaugauguuuacagagacgaggcucugaauaaccgcuuccagaucaaaggaguggagcucaaguccggcuacaaagacuggauucuguggaucagcuuugccauuucuugcuuccuucugugugucgcccuccugggguuuaucaugugggcuugccagaagggaaauauccgguguaacauuugcaucuga

SEQ ID NO: 189768 - RNA, 1701 nt, Artificial Sequence; identical to SEQ ID NO: 183654
  derived and/or modified sequence opt5 from hemagglutinin__InfluenzaA__AEG65043

SEQ ID NO: 189769 - RNA, 1701 nt, Artificial Sequence; identical to SEQ ID NO: 183654
  derived and/or modified sequence opt5 from hemagglutinin__InfluenzaA__AEG65054

SEQ ID NO: 189770 - RNA, 1701 nt, Artificial Sequence
  derived and/or modified sequence opt5 from hemagglutinin__InfluenzaA__AEG65065
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggcgugcaccauccugggacggauaaugaccagauuuuucucuaugcgcaggccucuggacgcaucacaguuuccaccaagagaagccaacagacagugauuccgaacaucggcucccggccccgcgucagaaauauuccuucucggaucagcaucuacuggaccauugugaaacccggggauauccugcugauuaacuccaccggaaaucucaucgcuccucgcggcuacuucaagauuagaagcgggaagucuuccaucaugcggagcgacgcccccaucggaaaauguaacucugaaugcauuacaccgaauggcagcaucccuaacgacaagcccuuucagaaugugaaccgcauuacguauggcgcuuguccuagauacgucaaacagaauacccugaaacuugccacagggaugcggaacguucccgagaagcaaacccgcggaaucuucggcgcgauugccggguuuaucgaaaauggaugggagggcaugguggaugggugguauggauucagacaccagaacuccgagggcaucggccaggcugccgaccugaagucuacacaagcugccauuaaucagaucaacgggaaacucaaccggcugauuggaaagaccaaugaaaaguuccaccagaucgagaaagaauuuagcgagguggaaggccgcauucaggaucuugagaaguacgucgaggacacgaaaaucgaucugugguccuauaacgccgaacuccugguggcucuggagaaucaacauacaauugaccucaccgauagcgaaaugaacaagcuguucgagagaaccaaaaagcagcuucgggaaaaugcggaggacauggggaacggaugcuuuaagaucuaccacaaaugugauaaugccugcaucggcucuauuagaaacgggacauaugaccaugauguuuaccgcgacgaggcucugaauaaccgguuccagaucaagggcguggaacucaaauccggauacaaggacuggguccuguggauuagcuuugccaucucuugcuuccuucugugugugguucuccugggcuuuauuaugugggccugccagaaagggaauaucagauguaacaucugcauuuga

SEQ ID NO: 189771 - RNA, 1701 nt, Artificial Sequence
  derived and/or modified sequence opt5 from hemagglutinin__InfluenzaA__AEG65076
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugcgcuuuaaguauccugcccuuaaugucaccaugcccaacaacgagaaauucgacaagcuguacaucuggggagugcaccauccugggacggauaaugaccagauuuuucucuaugcgcaggccucuggcagaaucacaguuuccaccaaacggagccaacagacagugauuccgaacgucgggucccgccccagagugcggaauaucccuucucgcauuagcaucuacuggaccaucgugaagcccggagauauucugcugaucaacuccaccggcaaucucauugcuccuagaggguacuucaaaauccggagcggaaagucuuccauuaugcgcagcgacgcccccaucggcaaguguaacucugagugcaucacaccgaauggcagcauuccuaacgacaaacccuuucagaaugucaacagaaucacguauggggcuuguccucgguacguuaagcagaauacccugaaacuugccacaggaaugcgcaacgugcccgaaaagcaaaccagaggcauuuucggggcgaucgccggauuuauugagaauggcugggaagggaugguggauggaugguauggcuuccggcaccagaacuccgagggcacagggcaggcugccgaccugaaaucuacccaagcugccaucaaucagaucaacggaaagcucaacagacugauuggcaaaacgaaugagaaguuccaccagaucgaaaaggaguuuagcgaagucgaggggcgcauucaggaucuugaaaaauacguggaggacacaaagaucgaucugugguccuauaacgccgagcuccugguugcucuggaaaaucaacauaccauugaccucaccgauagcgagaugaacaaacuguucgaacggacaaagaaacagcuuagagagaaugcggaagacaugggaaacggcugcuuuaagaucuaccacaagugugauaaugccugcauugggucuauccgcaacggcaccuaugaccaugauguguaccgggacgaggcucugaauaacagauuccagaucaaaggagucgagcucaaguccggcuacaaagacuggauucuguggaucagcuuugccauuucuugcuuccuucuguguguggcccuccugggguuuaucaugugggcuugccagaagggaaauauucgcuguaacaucugcaucuga

SEQ ID NO: 189772 - RNA, 1701 nt, Artificial Sequence
  derived and/or modified sequence opt5 from hemagglutinin__InfluenzaA__AEG65087
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacgaauaacgaucagauuuuucucuaugcgcaggccucuggccgcaucacaguuuccaccaagagaagccaacagacagugauuccgaauaucgggucccggccccgcgucagaaacauuccuucucggaucagcaucuacuggaccauugugaaacccggagacauccugcugauuaauuccaccggcaaccucaucgcuccucgcggguacuucaagauuagaagcggaaagucuuccaucaugcggagcgaugcccccaucggcaaauguaauucugagugcauuacaccgaacggcagcaucccuaaugacaagcccuuucagaacgugaaucgcauuacguauggggcuuguccuagauacgucaaacagaacacccugaaacuugccacaggaaugcggaauguucccgaaaagcaaacccgcggcaucuucggggcgauugccggauuuaucgagaacggcugggaagggaugguggacggaugguauggcuucagacaccaaaauuccgagggcaucgggcaggcugccgaucugaagucuacacaggcugccauuaaccagaucaacggaaaacucaaucggcugauuggcaagaccaacgagaaguuccaccagaucgaaaaagaguuuagcgaaguggaggggcgcauucaggaccuugaaaaguacgucgaggauacgaaaaucgaccugugguccuauaaugccgagcuccugguggcucuggaaaaccaacauacaauugaucucaccgacagcgagaugaauaagcuguucgaaagaaccaaaaagcagcuucgggagaacgcggaagauaugggaaauggcugcuuuaagaucuaccacaaaugugacaacgccugcaucgggucuauuagaaauggcacauaugaucaugacguuuaccgcgaugaggcucugaacaaucgguuccagaucaagggaguggagcucaaauccggcuacaaggacuggauucuguggaucagcuuugccauuucuugcuuccuucugugugucgcccuccugggguuuaucaugugggcuugccagaaaggaaacaucagauguaauauuugcaucuga

SEQ ID NO: 189773 - RNA, 1701 nt, Artificial Sequence
  derived and/or modified sequence opt5 from hemagglutinin__InfluenzaA__AEG65098
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacgauuuucaaaacaaaaagugggaccuguucgucgagagaagcaaagccuauuccaauuguuacccuuaugaugugcccgacuacgcuucucuccggagccugguugccuccagcggcacgcuugaauuuaacaaugagucuuucaacuggaccggggugacacagaauggaaccuccagcgcuugcaagcgcagaucuaacaauuccuuuuucagccggcugaacuggcucacacauucuaaguuuaaauauccugcccugaaugucaccaugcccaacaacgagaaguucgauaaacuuuacaucuggggcgugcaccauccuggcacggacaaugaucagauuuuucuguaugcgcaggccuccgggcgcaucacaguuagcaccaagagaucccaacagacagugauuccgaacaucggaucucggccccgcgucagaaauauuccuagccggaucuccaucuacuggaccauugugaaacccggcgacauccuccugauuaacagcaccgggaaucugaucgcuccucgcggauacuucaagauuagaucuggcaaguccagcaucaugcggucugacgcccccaucgggaaauguaacagcgaaugcauuacaccgaauggauccaucccuaacgauaagcccuuucagaaugugaaccgcauuacguauggcgcuuguccuagauacgucaaacagaauacccucaagcuggccacaggcaugcggaacguucccgagaaacaaacccgcgggaucuucggagcgauugccggcuuuaucgaaaaugggugggagggaaugguggacggcugguauggguucagacaccagaacucugagggaaucggccaggcugccgaucuuaagagcacacaagcugccauuaaucagaucaacggcaaccugaaucggcucauugggaaaaccaacgaaaaguuccaccagaucgagaaggaauuuuccgagguggaaggacgcauucaggaccuggagaaauacgucgaggauacgaagaucgaccuuuggagcuauaaugccgaacugcucguggcucuggagaaccaacauacaauugaucugaccgacucugaaaugaauaaacucuucgagagaaccaagaaacagcugcgggaaaacgcggaggauaugggcaaugggugcuuuaagaucuaccacaagugugacaacgccugcaucggauccauuagaaauggcacauaugaucaugacguuuaccgcgacgaggcucuuaacaaucgguuccagaucaaagggguggaacucaagagcggcuacaaagauuggauucuguggaucucuuuugccauuuccugcuuccugcuuugugucgugcugcucggauuuaucaugugggccugccagaagggcaacaucagauguaauauuugcaucuga

SEQ ID NO: 189774 - RNA, 1701 nt, Artificial Sequence
  derived and/or modified sequence opt5 from hemagglutinin__InfluenzaA__AEG65109
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguaaacugauugacgcccuccugggagauccccagugcgacggcuuucaaaacaagaaaugggaucuguucgucgagagaagcaaggccuauuccaauuguuacccuuaugacgugcccgauuacgcuucucuccggagccugguugccuccagcgggacccuugaauuuaacaaugagucuuucaacuggacgggagugacccagaauggcacauccagcgcuugcaagcgcagaucuaacaauuccuuuuucagccggcugaacuggcucacccaucugaaauuuaaguauccugcccuuaaugucacaaugcccaacaacgagaaauucgacaagcuguacaucuggggcgugcaccauccugggaccgauaaugaccagauuuuucucuaugcgcagucuuccggacgcaucacgguuagcacaaaaagaucccaacagaccgugauuccgaacaucggcucucggccccgcgucagaaauauuccuagccggaucuccaucuacuggacaauugugaagcccggggauauccugcugauuaacagcaccggaaaucucaucgccccucgcggcuacuucaagauuagaucugggaaauccagcaucaugcggucugacgcucccaucggaaaguguaacagcgaaugcauuaccccgaauggcuccaucccuaacgacaaacccuuucagaaugugaaccgcauuacauauggcgccuguccuagauacgucaagcagaauacgcugaaacuugcuaccgggaugcggaacguucccgagaagcaaacacgcggaaucuucggcgccauugcgggguuuaucgaaaauggaugggagggcaugguggaugggugguauggauucagacaccagaacucugagggcaucggccaggccgcugaccugaaaagcacccaagccgcuauuaaucagaucaacgggaagcucaaccggcugauuggaaagacaaaugaaaaauuccaccagaucgagaaggaauuuuccgagguggaaggccgcauucaggaucuugagaaauacgucgaggacaccaagaucgaucuguggagcuauaacgccgaacuccugguggcccuggagaaucaacauacgauugaccucacagauucugaaaugaacaaacuguucgagagaaccaagaagcagcuucgggaaaaugcugaggacauggggaacggaugcuuuaaaaucuaccacaagugugauaaugcgugcaucggcuccauuagaaacgggaccuaugaccaugauguuuaccgcgacgaggcccugaauaaccgguuccagaucaaaggcguggaacucaagagcggauacaaagacuggauucuguggaucucuuuugcuauuuccugcuuccuucugugugucgcccuccugggcuuuaucaugugggccugccagaaggggaauaucagauguaacauuugcaucuga

SEQ ID NO: 189775 - RNA, 1701 nt, Artificial Sequence
  derived and/or modified sequence opt5 from hemagglutinin__InfluenzaA__AEG65120
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggcgugcaccauccugggacggauaaugaccagauuuuucucuaugcgcaggccucuggacgcaucacaguuuccaccaagagaagccaacagacagugauuccgaacaucggcucccggccccgcgucagaaauauuccuucucggaucagcaucuacuggaccauugugaaacccggggauauccugcugauuaacuccaccggaaaucucaucgcuccucgcggcuacuucaagauuagaagcgggaagucuuccaucaugcggagcgacgcccccaucggaaaauguaacucugaaugcauuacaccgaauggcagcaucccuaacgacaagcccuuucagaaugugaaccgcauugcuuauggcgccuguccuagauacgucaaacagaauacgcugaaacuugcgaccgggaugcggaacguucccgagaagcaaacacgcggaaucuucggcgccauugcuggguuuaucgaaaauggaugggagggcaugguggaugggugguauggauucagacaccagaacuccgagggcaucggccaggccgcugaccugaagucuacccaagccgccauuaaucagaucaacgggaaacucaaccggcugauuggaaagacaaaugaaaaguuccaccagaucgagaaagaauuuagcgagguggaaggccgcauucaggaucuugagaaguacgucgaggacaccaaaaucgaucugugguccuauaacgcugaacuccugguggcgcuggagaaucaacauacgauugaccucacagauagcgaaaugaacaagcuguucgagagaaccaaaaagcagcuucgggaaaaugccgaggacauggggaacggaugcuuuaagaucuaccacaaaugugauaaugcuugcaucggcucuauuagaaacgggaccuaugaccaugauguuuaccgcgacgaggcccugaauaaccgguuccagaucaagggcguggaacucaaauccggauacaaggacuggauucuguggaucagcuuugccauuucuugcuuccuucugugugucgugcuccugggcuuuaucaugugggcuugccagaaagggaauaucagauguaacauuugcaucuga

SEQ ID NO: 189776 - RNA, 1701 nt, Artificial Sequence
  derived and/or modified sequence opt5 from hemagglutinin__InfluenzaA__AEG65131
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcaagcgcagaucuaacaauuccuuuuucagccggcugaacuggcucacacauucuaaguuuaaauauccugcccugaaugucaccaugcccaacaacgagaaguucgacaaacuuuacaucuggggcgugcaccauccugggacggauaaugaccagauuuuucuguaugcgcaggccuccggacgcaucacaguuagcaccaagagaucccaacagacagugauuccgaacaucggcucucggccccgcgucagaaauauuccuagccggaucuccaucuacuggaccauugugaaacccggggauauccuccugauuaacagcaccggaaaucugaucgcuccucgcggcuacuucaagauuagaucugggaaguccagcaucaugcggucugacgcccccaucggaaaauguaacagcgaaugcauuacaccgaauggcuccaucccuaacgacaagcccuuucagaaugugaaccgcauuacguauggcgcuuguccuagauacgucaaacagaauacccucaagcuggccacagggaugcggaacguucccgagaaacaaacccgcggaaucuucggcgcgauugccggguuuaucgaaaauggaugggagggcaugguggaugggugguauggauucagacaccagaacucugagggcaucggccaggcugccgaccuuaagagcacacaagcugccauuaaucagaucaacgggaaacugaaccggcucauuggaaagaccaaugaaaaguuccaccagaucgagaaagaauuuuccgagguggaaggccgcauucaggaucuggagaaguacgucgaggacacgaaaaucgaucuuuggagcuauaacgccgaacugcucguggcucuggagaaucaacauacaauugaccugaccgauucugaaaugaacaaacucuucgagagaaccaagaagcagcugcgggaaaaugcggaggacauggggaacggaugcuuuaagaucuaccacaaaugugauaaugccugcaucggcuccauuagaaacgggacauaugaccaugauguuuaccgcgacgaggcucuuaauaaccgguuccagaucaagggcguggaacugaaaagcggauacaaggacuggauucucuggaucucuuuugccauuuccugcuuccugcuuugugucgugcugcucggcuuuaucaugugggccugccagaaagggaauaucagauguaacauuugcaucuga

SEQ ID NO: 189777 - RNA, 1701 nt, Artificial Sequence; identical to SEQ ID NO: 183075
  derived and/or modified sequence opt5 from hemagglutinin__InfluenzaA__AEG65142

SEQ ID NO: 189778 - RNA, 1701 nt, Artificial Sequence; identical to SEQ ID NO: 183075
  derived and/or modified sequence opt5 from hemagglutinin__InfluenzaA__AEG65153

SEQ ID NO: 189779 - RNA, 1701 nt, Artificial Sequence
  derived and/or modified sequence opt5 from hemagglutinin__InfluenzaA__AEG65164
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagccgccccugggugagaggggucuccagccggauuucuaucuacuggaccauuguuaaaccuggagacauccugcucaucaacuccacaggcaaucugauugcuccccgcggguauuucaagaucagaagcggaaagucuagcauuaugcgguccgacgccccuaucggcaaauguaacucugaaugcauuacccccaauggcagcaucccgaacgauaagccuuuucagaaugugaaccgcaucaccuacgggcccuguccuagauaugugaaacagaauacacuuaagcuggcuacgggaaugcggaacguccccgagaaacaaacccgcggcauuuucggggccaucgcgggauuuauugaaaauggcugggaggggaugauggacggaugguacggcuucagacaccagaacuccgagggcacagggcaggccgcugaucucaagagcacccaagccgcuaucaaucagauuaacggaaaacugaaucggcuuaucgaaaagacaaacgagaaguuucaucagaucgaaaaagaguucucugaaguggagggccgcauucaggaccuggagaaguauguugaagauaccaaaaucgaccucugguccuacaaugccgaguuccugguggcccuggaaaaccaacacacgauugaucucacagacagcgagaugaacaagcuguuugaaagaaccaaaaagcagcuucgggagaaugcugaggauauggggaacggaugcuucaagaucuaucauaaaugugacaaugcgugcauuggcucuaucagaaacgggaccuacgaucacgacgucuaccgcgacgaagcccugaauaaccgguuucagauuaagggcguggagcucaaauccggauauaaggauuggauccuguggaucagcuucgcuauuuccugcuuucuucuguguaucguucuccugggcuucauuaugugggccugccagaaagggaauaucagauguaacauuugcaucuga

SEQ ID NO: 189780 - RNA, 1701 nt, Artificial Sequence
  derived and/or modified sequence opt5 from hemagglutinin__InfluenzaA__AEG65175
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcgagcgcagaucuaacaaguccuuuuucagccggcugaauuggcucacacaucugaaguauaaauacccugcccuuaacgucaccaugcccaauaacgagaaguuugacaaacuguauaucuggggagugcaccauccugggacggauucugaccagauuucccucuacgcgcaggccagcggccgcaucacaguuuccaccaagagaucucaacagacagugauuccgaacaucgggagccggccccgcgucagagauguguccagccggauuucuaucuacuggaccaucgugaaaccuggagacauucugcugaucaauuccaccggcaaccucauugcuccccgcggguauuucaagaucagaaauggaaagagcucuauuaugcggagcgacgccccuaucggcaaauguaacuccgaaugcaucacacccaauggcucuauuccgaacgauaagccuuuucagaaugucaaccgcaucacguacggggcuugucccagauauguuaaacagaauacccugaaacuugccacaggaaugcggaacgugccugagaaacaaacccgcggcauuuucggggcgaucgccggauuuauugaaaauggcugggaggggaugguggacggaugguacggcuucagacaccagaacagcgagggcacagggcaggcugccgaucugaaguccacccaagcugccaucaaucagaucaacggaaaacucaaucggcugauuggcaagacgaacgaaaaguuucaccagaucgagaaagaguucagcgaagucgaagggcgcauucaggaccuugagaaguauguggaggauacaaaaaucgaccuguggucuuacaacgccgaacuccugguugcucuggagaaucaacauaccauugaucucaccgacuccgaaaugaacaagcuguucgagagaacaaagaagcagcuucgggaaaaugcggaggauaugggaaacggcugcuuuaagaucuaucacaaaugugacaaugccugcauugggagcaucagaaacggcaccuacgaucaugacguguaccgcgacgaggcucugaauaaccgguuccagaucaagggagucgaacucaaaucuggcuauaaggauuggauucuguggaucuccuuugccauuagcugcuuccuucuguguguggcccuccugggguuuaucaugugggcuugccagaaaggaaauauuagaugugacaucugcaucuga

SEQ ID NO: 189781 - RNA, 1701 nt, Artificial Sequence; identical to SEQ ID NO: 183443
  derived and/or modified sequence opt5 from hemagglutinin__InfluenzaA__AEG65186

SEQ ID NO: 189782 - RNA, 1701 nt, Artificial Sequence
  derived and/or modified sequence opt5 from hemagglutinin__InfluenzaA__AEG65197
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcccgacaggcgggaucugcgacucuccccaccagauccuugauggagagaauuguacccugauugacgcccuccugggcgauccucagugcgacggguuucaaaacaaaaagugggaucuguucgucgaaagaucuaaagccuauagcaauuguuaccccuaugacgugccugauuacgcuucccuccggucucugguugccagcuccggaacgcuugaguuuaacaaugagagcuucaacuggaccggcgugacacagaauggcaccucuuccgcuugcaagcgcagaagcaacaauuccuuuuucucccggcugaacuggcucacacaucugaaguuuaaauaucccgcccuuaaugucaccaugccuaacaacgaaaaguucgacaaacuguacaucuggggagugcaccauccggggacggauaaugaccagauuagccucuaugcgcaggccucuggccgcaucacaguuuccaccaagagaagccaacagacagugauucccaacaucgggucccggccucgcgucagagauauucccucucggaucagcaucuacuggaccauugugaaaccuggagacaucauucugaucaauuccaccggcaaccugauugcuccccgcggguacuuuaagaucagaagcggaaagucuuccaucaugcggagcgacacaccgauuggcaaauguaauucugagugcaucacgccuaacggcagcauucccaaugauaagccuuuccagaacgugaaucgcaucaccuauggggccugucccagauacgucaaacagaacacacucaagcuggcuaccggaaugcggaauguucccgaaaaacaaacacgcggcauuuuuggggccaucgcgggauucaucgagaacggcugggaagggaugguggacggaugguauggcuuuagacaccaaaauuccgagggcauugggcaggccgcugaucuuaagucuacccaggccgcuaucaaccagauuaauggaaaacugaaccggcucaucggcaagacgaacgagaaguuccaccagauugaaaaagaguucagcgaaguggaggggagaauccaggaccuggaaaaguacgucgaggauacaaaaauugaccuuugguccuauaaugccgagcugcucguggcccuggaaaaccaacauaccaucgaucugaccgacagcgagaugaauaagcucuuugaacgcaccaaaaagcagcugcgggagaacgcugaagauaugggaaauggcugcuucaagaucuaccacaaaugugacaacgcgugcauugggucuaucagaaauggcacauaugaucaugacguuuaccgcgacgaggcccuuaacaaucgguuucagauuaagggaguggagcugaaauccggcuacaaggauuggauccucuggauuagcuucgcuaucucuugcuuucugcuuugugucgcccugcucggguucaucaugugggccugccagaaaggaaacauuagauguaauaucugcauuuga

SEQ ID NO: 189783 - RNA, 1701 nt, Artificial Sequence; identical to SEQ ID NO: 183654
  derived and/or modified sequence opt5 from hemagglutinin__InfluenzaA__AEG65208

SEQ ID NO: 189784 - RNA, 1701 nt, Artificial Sequence
  derived and/or modified sequence opt5 from hemagglutinin__InfluenzaA__AEG65219
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaaguccuuuuucagccggcugaauuggcucacacaucugaaauuuaaguauccugcccuuaacgucaccaugcccaauaacgagaaauucgacaagcuguacaucuggggagugcaccauccugggacggauaacgaccagauuucucucuaugcgcaggccuccggccgcaucacaguuagcaccaaaagaucccaacagacagugauuccgaauaucgggucucggccccgcgucagagaugugccuagccggauuuccaucuacuggaccaucgugaagcccggagacauucugcugaucaacagcaccggcaaucucauugcuccucgcggguacuuuaagaucagaucuggaaaauccagcauuaugcggucugacgcccccaucggcaaguguaacagcgagugcaucacaccgaauggcuccauuccuaacgauaaacccuuccagaaugucaaccgcaucacguauggggcuuguccuagauacguuaagcagaauacccugaaacuugccacaggaaugcggaacgugcccgaaaagcaaacccgcggcauuuuuggggcgaucgccggauucauugagaauggcugggaagggaugguggacggaugguauggcuuuagacaccagaacucugagggcacagggcaggcugccgaucugaaaagcacccaagcugccaucaaucagaucaacggaaagcucaaucggcugauuggcaagacgaacgagaaauuccaccagaucgaaaaggaguucuccgaagucgaggggcgcauucaggaccuugaaaaauacguggaggauacaaagaucgaccuguggagcuauaacgccgagcuccugguugcucuggaaaaucaacauaccauugaucucaccgacucugagaugaacaaacuguuugaaagaacaaagaagcagcuucgggagaaugcggaagauaugggaaacggcugcuucaaaaucuaccacaagugugacaaugccugcauuggguccaucagaaacggcaccuaugaucaugacguguaccgcgacgaggcucugaauaaccgguuucagaucaaaggagucgagcucaagagcggcuacaaagauuggauucuguggaucucuuucgccauuuccugcuuucuucuguguguggcccuccugggguucaucaugugggcuugccagaagggaaauauuaaguguaacaucugcaucuga

SEQ ID NO: 189785 - RNA, 1701 nt, Artificial Sequence; identical to SEQ ID NO: 184819
  derived and/or modified sequence opt5 from hemagglutinin__InfluenzaA__AEG65230

SEQ ID NO: 189786 - RNA, 1701 nt, Artificial Sequence; identical to SEQ ID NO: 184819
  derived and/or modified sequence opt5 from hemagglutinin__InfluenzaA__AEG65252

SEQ ID NO: 189787 - RNA, 1701 nt, Artificial Sequence; identical to SEQ ID NO: 183540
  derived and/or modified sequence opt5 from hemagglutinin__InfluenzaA__AEG65263

SEQ ID NO: 189788 - RNA, 1701 nt, Artificial Sequence; identical to SEQ ID NO: 183540
  derived and/or modified sequence opt5 from hemagglutinin__InfluenzaA__AEG65274

SEQ ID NO: 189789 - RNA, 1701 nt, Artificial Sequence; identical to SEQ ID NO: 183540
  derived and/or modified sequence opt5 from hemagglutinin__InfluenzaA__AEG65285

SEQ ID NO: 189790 - RNA, 1701 nt, Artificial Sequence
  derived and/or modified sequence opt5 from hemagglutinin__InfluenzaA__AEG65296
augaagaccgugaucgcccugagcuacauucucugccuggucuucgcucagaaacuucccggcaacgacaauuccacagccacgcugugucucgggcaccaugcgguuccuaacggaaccaucgugaagacaauuaccaaugaucaaaucgaggugacaaacgcuaccgaacugguccagucuagcuccacaggcgggauuugcgacucuccgcaccagauccuugauggagagaauuguacccugaucgacgcccuccugggcgauccccagugcgacggguuucaaaacaaaaagugggaucuguucguggaaagaagcaaagccuauuccaauuguuacccuuaugacguucccgaucaugcuucucuccggagccugguggccuccagcggaacgcuugaguuuaacaaugaaucuuucgacuggaccggcgucacacagaacggcaccuccagcgcuugcaagcgcagaucuaauaaguccuuuuucagccggcugaacuggcucacacaccugaaauacaaguauccugcccuuaaugugaccaugcccaacaaugagaaauuugauaagcuguacauuuggggaguucaucacccugggacggacucugaucagaucucccucuaugcgcaggccagcggccgcauuacaguguccaccaaaagaucucaacagacagucaucccgaacauugggagccggccccgcgugagagacguguccagccggaucucuauuuacuggaccaucgucaagccuggagacauccugcugauuaacuccaccggcaaucucaucgcuccccgcggguacuucaagauuagaagcggaaaaucuagcaucaugcgguccgaugccccuauuggcaaguguaacucugagugcaucacacccaauggcagcaucccgaacgacaaaccuuuucagaauguuaaccgcauuacguauggggcuugucccagauacgugaagcagaauacccugaaacuugccacaggaaugcggaacgugccugaaaagcaaacccgcggcaucuucggggcgauugccggauuuaucgagaauggcugggaagggauggucgauggaugguauggcuucagacaccagaacuccgagggcacagggcaggcugccgaccugaaaagcacccaagcugccauuaaucagaucaacggaaagcucaaucggcugaucggcaagacgaacgagaaauuucaucagauugaaaaggaguucucugaaguggaggggagaauccaggaucuugaaaaauacguugaggacacaaagauugaucugugguccuauaaugccgagcuccugguggcucuggaaaaccaacacaccaucgaccucaccgauagcgagaugaacaaacuguucgaacgcacaaagaagcagcuucgggagaaugcggaagacaugggaaacggcugcuuuaaaauuuaccauaagugugauaaugccugcaucgggucuauuagaaacggcaccuaugaccacgacgucuaccgcgaugaggcucugaauaaccgguuccagaucaaaggaguggagcucaaguccggcuacaaagacuggauccuguggauuagcuuugccaucuccugcuuccuucuguguguugcccuccugggguuuauuaugugggcuugccagaagggaaauaucagauguaacauuugcaucuga

SEQ ID NO: 189791 - RNA, 1701 nt, Artificial Sequence; identical to SEQ ID NO: 184819
  derived and/or modified sequence opt5 from hemagglutinin__InfluenzaA__AEG65307

SEQ ID NO: 189792 - RNA, 1701 nt, Artificial Sequence
  derived and/or modified sequence opt5 from hemagglutinin__InfluenzaA__AEG65318
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaaguccuuuuucagccggcugaauuggcucacacaucugaaauuuaaguauccugcccuuaacgucaccaugcccaauaacgagaaauucgacaagcuguacaucuggggagugcaccauccugggacggauaacgaccagauuucucucuaugcgcaggccuccggccgcaucacaguuagcaccaaaagaucccaacagacagugauuccgaauaucgggucucggccccgcgucagagaugugccuagccggauuuccaucuacuggaccaucgugaagcccggagacauucugcugaucaacagcaccggcaaucucauugcuccucgcggguacuuuaagaucagaucuggaaaauccagcauuaugcggucugacgcccccaucggcaaguguaacagcgagugcaucacaccgaauggcuccauuccuaacgauaaacccuuccagaaugucaaccgcaucacguauggggcuuguccuagauacguucggcagaauacccugaaacuugccacaggaaugcgcaacgugcccgaaaaacaaaccagaggcauuuuuggggcgaucgccggauucauugagaauggcugggaagggaugguggacggaugguauggcuuucggcaccagaacucugagggcacagggcaggcugccgaucucaagagcacccaagcugccaucaaucagaucaacggaaaacugaauagacugauuggcaagacgaacgagaaguuccaccagaucgaaaaagaguucuccgaagucgaggggcgcauucaggaccuugaaaaguacguggaggauacaaaaaucgaccuguggagcuauaacgccgagcuccugguugcucuggaaaaucaacauaccauugaucucaccgacucugagaugaacaagcuguuugaacggacaaagaagcagcuuagagagaaugcggaagauaugggaaacggcugcuucaagaucuaccacaaaugugacaaugccugcauuggguccauccgcaacggcaccuaugaucaugacguguaccgggacgaggcucugaauaacagauuucagaucaagggagucgagcucaaaagcggcuacaaggauuggauucuguggaucucuuucgccauuuccugcuuucuucuguguguggcccuccugggguucaucaugugggcuugccagaaaggaaauauucgcuguaacaucugcaucuga

SEQ ID NO: 189793 - RNA, 1701 nt, Artificial Sequence; identical to SEQ ID NO: 184819
  derived and/or modified sequence opt5 from hemagglutinin__InfluenzaA__AEG65329

SEQ ID NO: 189794 - RNA, 1701 nt, Artificial Sequence
  derived and/or modified sequence opt5 from hemagglutinin__InfluenzaA__AEG65340
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcgagcgcagaucuaacaaguccuuuuucagccggcugaauuggcucacacaucugaaguauaaauacccugcccuuaacgucaccaugcccaauaacgagaaguuugacaaacuguauaucuggggagugcaccauccugggacggauucugaccagauuucccucuacgcgcaggccagcggccgcaucacaguuuccaccaagagaucucaacagacagugauuccgaacaucgggagccggccccgcgucagagauguguccagccggauuucuaucuacuggaccaucgugaaaccuggagacauucugcugaucaauuccaccggcaaccucauugcuccccgcggguauuucaagaucagaagcggaaagucuagcauuaugcgguccgacgccccuaucggcaaauguaauucugaaugcaucacacccaacggcagcauuccgaaugauaagccuuuucagaacgucaaucgcaucacguacggggcuugucccagauauguuaaacagaacacccugaaacuugccacaggaaugcggaaugugccugagaaacaaacccgcggcauuuucggggcgaucgccggauuuauugaaaacggcugggaggggaugguggacggaugguacggcuucagacaccagaauagcgagggcacagggcaggcugccgaucugaaguccacccaagcugccaucaaccagaucaauggaaaacucaaccggcugauuggcaagacgaaugaaaaguuucaccagaucgagaaagaguucucugaagucgaagggcgcauucaggaccuugagaaguauguggaggauacaaaaaucgaccugugguccuacaacgccgaacuccugguugcucuggagaaccaacauaccauugaucucaccgacagcgaaaugaauaagcuguucgagagaacaaagaagcagcuucgggaaaacgcggaggauaugggaaauggcugcuuuaagaucuaucacaaaugugacaacgccugcauugagucuaucagaaaugggaccuacgaucaugacguguaccgcgacgaagcucugaacaaucgguuccagaucaagggcgucgagcucaaauccggauauaaggauuggauucuguggaucagcuuugccauuuccugcuuccuucuguguguggcccuccugggcuuuaucaugugggcuugccagaaagggaacauuagauguaauaucugcaucuga

SEQ ID NO: 189795 - RNA, 1701 nt, Artificial Sequence; identical to SEQ ID NO: 184819
  derived and/or modified sequence opt5 from hemagglutinin__InfluenzaA__AEG65351

SEQ ID NO: 189796 - RNA, 1701 nt, Artificial Sequence; identical to SEQ ID NO: 184819
  derived and/or modified sequence opt5 from hemagglutinin__InfluenzaA__AEG65362

SEQ ID NO: 189797 - RNA, 1701 nt, Artificial Sequence; identical to SEQ ID NO: 189794
  derived and/or modified sequence opt5 from hemagglutinin__InfluenzaA__AEG65373

SEQ ID NO: 189798 - RNA, 1701 nt, Artificial Sequence; identical to SEQ ID NO: 183540
  derived and/or modified sequence opt5 from hemagglutinin__InfluenzaA__AEG65384

SEQ ID NO: 189799 - RNA, 1701 nt, Artificial Sequence; identical to SEQ ID NO: 183540
  derived and/or modified sequence opt5 from hemagglutinin__InfluenzaA__AEG65406

SEQ ID NO: 189800 - RNA, 1701 nt, Artificial Sequence; identical to SEQ ID NO: 183540
  derived and/or modified sequence opt5 from hemagglutinin__InfluenzaA__AEG65417

SEQ ID NO: 189801 - RNA, 1701 nt, Artificial Sequence; identical to SEQ ID NO: 183540
  derived and/or modified sequence opt5 from hemagglutinin__InfluenzaA__AEG65428

SEQ ID NO: 189802 - RNA, 1701 nt, Artificial Sequence
  derived and/or modified sequence opt5 from hemagglutinin__InfluenzaA__AEG65439
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuuuucucuaugcgcaggccucuggccgcaucacaguuuccaccaagagaagccaacagacagugauuccgaacaucgggucccggccccgcgucagaaauauuccuucucggaucagcaucuacuggaccauugugaaacccggagauauccugcugauuaacuccaccggcaaucucaucgcuccucgcggguacuucaagauuagaagcggaaagucuuccaucaugcggagcgacgcccccaucggcaaauguaacucugagugcauuacaccgaauggcagcaucccuaacgacaagcccuuucagaaugugaaccgcauuacguauggggcuuguccuagauacgucaaacagaauacccugaaacuugccacaggaaugcggaacguucccgaaaagcaaacccgcggcaucuucggggcgauugccggauuuaucgagaauggcugggaagggaugguggauggaugguauggcuucagacaccagaacuccgagggcguggggcaggcugccgaccugaagucuacacaagcugccaucaaucagauuaacggaaaacucaaccggcugaucggcaagaccaaugagaaguuccaccagauugaaaaagaguuuagcgaagucgaggggagaauccaggaucuugaaaaguacguggaggacacgaaaauugaucugugguccuauaacgccgagcuccugguugcucuggaaaaucaacauacaaucgaccucaccgauagcgagaugaacaagcuguucgaacgcaccaaaaagcagcuucgggagaaugcggaagacaugggaaacggcugcuuuaagauuuaccacaaaugugauaaugccugcaucgggucuaucagaaacggcacauaugaccaugauguguaccgcgacgaggcucugaauaaccgguuccagauuaagggagucgagcucaaauccggcuacaaggacuggauccuguggauuagcuuugccaucucuugcuuccuucuguguguggcccuccugggguuuauuaugugggcuugccagaaaggaaauaucagauguaacaucugcauuuga

SEQ ID NO: 189803 - RNA, 1701 nt, Artificial Sequence
  derived and/or modified sequence opt5 from hemagglutinin__InfluenzaA__AEG65450
augaagaccaucauugccuggagcuacauccugugccucguguucgcucagaaacugcccggcaacgacaauuccacagccacgcuuugucuggggcaccaugcggucccuaacggaaccauuguuaagacaaucaccaaugaucaaauugaggugacaaacgcuaccgaacucgugcagucuagcuccacaggcgggaucugcgacucuccgcaccagauccuggauggagagaauuguacccuuauugacgcccugcucggcgauccccagugcgacggguuucaaaacaaaaagugggaucuguucgucgaaagaagcaaagccuauuccaauuguuacccuuaugacgugcccgauuacgcuucucugcggagccucaucgccuccagcggaacgcuggaguuuaacaaugaaucuuucaacuggaccggcguuacacagaauggcaccuccagcgcuugcaagcgcagaucuaacuccagcuuuuucucucggcuuaauuggcugacacaucucaaguuuaaauauccugcccugaacgugaccaugcccaauaacgaggaguucgacaaacuuuacauuuggggaguccaccauccugggacguauaacgaucagaucucccuguacgcgcaggccagcggccgcauuacaguguccaccaagagaucucaacagacaguuaucccgaauauugggagccggccccgcgugagagacaucccuucccggaucagcauuuacuggaccaucgucaagcccggagauauucuccugaucaacucuaccggcaaucugauugcuccucgcggguauuuuaaaaucagauccggaaagagcucuaucaugcggagcgacgcccccauuggcaaguguaacuccgaaugcaucacaccgaauggcucuauuccuaacgacaaacccuuccagaaugugaaccgcaucacguacggggcuuguccuagauaugugaagcagaauacccucaaacuggccacaggaaugcggaacguccccgagaagcaaacccgcggcauuuuuggggcgaucgccggauucaucgaaaauggcugggaggggaugguugauggaugguacggcuuuagacaccagaacagcgagggcauugggcaggcugccgaccuuaaauccacacaagcugccaucgaucagauuaauggaaagcugaaccggcucaucggcaaaaccaaugaaaaguuccaccagauugagaaggaguucagcgaaguggaagggagaauccaggaccuggagaaauauguggaggauacgaagauugaccuuuggucuuacaacgccgaacugcucgucgcucuggagaaccaacauacaaucgaucugaccgacuccgaaaugaauaaacucuuugagcgcaccaagaaacagcugcgggaaaacgcggaggauaugggaaauggcugcuucaagaucuaucacaagugugacaacgccugcauugggagcaucagaaauggcacauacgaucaugacguguaccgcgacgaggcucuuaacaaucgguuucagauuaaaggaguugaacugaagucuggcuauaaagauuggauccucuggauuuccuucgccaucagcugcuuucugcuuuguguggcccugcucggguucaucaugugggcuugccagaagggaaacauuagauguaauaucugcauuuga

SEQ ID NO: 189804 - RNA, 1701 nt, Artificial Sequence; identical to SEQ ID NO: 189803
  derived and/or modified sequence opt5 from hemagglutinin__InfluenzaA__AEG65461

SEQ ID NO: 189805 - RNA, 1701 nt, Artificial Sequence
  derived and/or modified sequence opt5 from hemagglutinin__InfluenzaA__AEG65472
augaagaccaucauugccuggagcuacauccugugccucguguucgcucagaaacugcccggcaacgacaauuccacagccacgcuuugucuggggcaccaugcggucccuaacggaaccauuguuaagacaaucaccaaugaucaaauugaggugacaaacgcuaccgaacucgugcagucuagcuccacaggcgggaucugcgacucuccgcaccagauccuggauggagagaauuguacccuuauugacgcccugcucggcgauccccagugcgacggguuucaaaacaaaaagugggaucuguucgucgaaagaagcaaagccuauuccaauuguuacccuuaugacgugcccgauuacgcuucucugcggagccucaucgccuccagcggaacgcuggaguuuaacaaugaaucuuucaacuggaccggcguuacacagaauggcaccuccagcgcuugcaagcgcagaucuaacuccagcuuuuucucucggcuuaauuggcugacacaucucaaguuuaaauauccugcccugaacgugaccaugcccaauaacgaggaguucgacaaacuuuacauuuggggaguccaccauccugggacguauaacgaucagaucucccuguacgcgcaggccagcggccgcauuacaguguccaccaagagaucucaacagacaguuaucccgaauauugggagccggccccgcgugagagacaucccuucccggaucagcauuuacuggaccaucgucaagcccggagauauucuccugaucaacucuaccggcaaucugauugcuccucgcggguauuuuaaaaucagauccggaaagagcucuaucaugcggagcgacgcccccauuggcaaguguaacuccgaaugcaucacaccgaauggcucuauuccuaacgacaaacccuuccagaaugugaaccgcaucacguacggggcuuguccuagauaugugaagcagaauacccucaaacuggccacaggaaugcggaacguccccgagaagcaaacccgcggcauuuuuggggcgaucgccggauucaucgaaaauggcugggaggggaugguugauggaugguacggcuuuagacaccagaacagcgagggcauugggcaggcugccgaccuuaaauccacacaagcugccaucgaucagauuaauggaaagcugaaccggcucaucggcaaaaccaaugaaaaguuccaccagauugagaaggaguucagcgaaguggaagggagaauccaggaccuggagaaauauguggaggauacgaagauugaccuuuggucuuacaacgccgaacugcucgucgcucuggagaaccaacauacaaucgaucugaccgacuccgaaaugaauaaacucuuugagaucaccaagaaacagcugcgcgaaaacgcggaggauaugggaaauggcugcuucaagauuuaucacaagugugacaacgccugcaucgggagcauucggaauggcacauacgaucaugacguguacagagacgaggcucuuaacaaucgcuuucagaucaaaggaguugaacugaagucuggcuauaaagauuggauucucuggaucuccuucgccaucagcugcuuucugcuuuguguggcccugcucggguucauuaugugggcuugccagaagggaaacauccgguguaauauuugcaucuga

SEQ ID NO: 189806 - RNA, 1701 nt, Artificial Sequence; identical to SEQ ID NO: 189803
  derived and/or modified sequence opt5 from hemagglutinin__InfluenzaA__AEG65483

SEQ ID NO: 189807 - RNA, 1701 nt, Artificial Sequence; identical to SEQ ID NO: 189803
  derived and/or modified sequence opt5 from hemagglutinin__InfluenzaA__AEG65494

SEQ ID NO: 189808 - RNA, 1701 nt, Artificial Sequence; identical to SEQ ID NO: 189803
  derived and/or modified sequence opt5 from hemagglutinin__InfluenzaA__AEG65505

SEQ ID NO: 189809 - RNA, 1701 nt, Artificial Sequence; identical to SEQ ID NO: 189803
  derived and/or modified sequence opt5 from hemagglutinin__InfluenzaA__AEG65516

SEQ ID NO: 189810 - RNA, 1701 nt, Artificial Sequence; identical to SEQ ID NO: 189803
  derived and/or modified sequence opt5 from hemagglutinin__InfluenzaA__AEG65527

SEQ ID NO: 189811 - RNA, 1701 nt, Artificial Sequence; identical to SEQ ID NO: 189803
  derived and/or modified sequence opt5 from hemagglutinin__InfluenzaA__AEG65538

SEQ ID NO: 189812 - RNA, 1701 nt, Artificial Sequence
  derived and/or modified sequence opt5 from hemagglutinin__InfluenzaA__AEG65560
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugaucgccuccagcggaacgcuugaguuuaacaaugaaucuuucaacuggaccggcguuacacagaauggcaccuccagcgcuugcaagcgcagaucuaacuccagcuuuuucucucggcugaauuggcucacacaucugaaguuuaaauauccugcccuuaacgugaccaugcccaauaacgaggaguucgacaagcuguacauuuggggaguccaccauccugggacguauaacgaucagaucucccucuacgcgcaggccagcggccgcauuacaguguccaccaaaagaucucaacagacaguuaucccgaauauugggagccggccccgcgugagagacaucccuucccggaucagcauuuacuggaccaucgucaagcccggagauauucugcugaucaacucuaccggcaaucucauugcuccucgcggguauuuuaaaaucagauccggaaagagcucuaucaugaaaagcgacgcccccauuggcaaguguaacuccgaaugcaucacaccgaauggcucuauuccuaacgacaagcccuuccagaaugugaaccggaucacguacggggcuuguccucgcuaugugaaacagaauacccugaaacuugccacaggaaugagaaacguccccgagaagcaaacccggggcauuuuuggggcgaucgccggauucaucgaaaauggcugggaggggaugguugauggaugguacggcuuucgccaccagaacagcgagggcauugggcaggcugccgaccugaaguccacacaagcugccaucgaucagauuaauggaaaacucaacagacugaucggcaagaccaaugaaaaguuccaccagauugagaaagaguucagcgaaguggaagggcggauccaggaccuugagaaguauguggaggauacgaaaauugaccuguggucuuacaacgccgaacuccuggucgcucuggagaaccaacauacaaucgaucucaccgacuccgaaaugaauaagcuguuugagagaaccaaaaagcagcuucgcgaaaacgcggaggauaugggaaauggcugcuucaagaucuaucacaaaugugacaacgccugcauugggagcauccggaauggcacauacgaucaugacguguacagagacgaggcucugaacaaucgcuuucagauuaagggaguugaacucaaaucuggcuauaaggauuggauccuguggauuuccuucgccaucagcugcuuucuucuguguguggcccuccugggguucaucaugugggcuugccagaaaggaaacauucgguguaauaucugcauuuga

SEQ ID NO: 189813 - RNA, 1701 nt, Artificial Sequence; identical to SEQ ID NO: 189812
  derived and/or modified sequence opt5 from hemagglutinin__InfluenzaA__AEG65571

SEQ ID NO: 189814 - RNA, 1701 nt, Artificial Sequence; identical to SEQ ID NO: 189812
  derived and/or modified sequence opt5 from hemagglutinin__InfluenzaA__AEG65582

SEQ ID NO: 189815 - RNA, 1701 nt, Artificial Sequence; identical to SEQ ID NO: 189812
  derived and/or modified sequence opt5 from hemagglutinin__InfluenzaA__AEG65593

SEQ ID NO: 189816 - RNA, 1701 nt, Artificial Sequence
  derived and/or modified sequence opt5 from hemagglutinin__InfluenzaA__AEG65604
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugaucgccuccagcggaacgcuugaguuuaacaaugaaucuuucaacuggaccggcguuacacagaauggcaccuccagcgcuugcaagcgcagaucuaacaauuccuuuuucagccggcugaacuggcucacacaucugaaguuuaaauauccugcccuuaaugugaccaugcccaacaacgaggaguucgacaagcuguacauuuggggaguccaccauccugggacggauaaugaccagaucucucucuaugcgcaggccuccggcaaaauuacagugagcaccaagcgcucccaacagacaguuaucccgaacauugggucuagaccccgggugcgcgauaucccuagcagaaucuccauuuacuggaccaucgucaaacccggagacauucugcugaucaauagcaccggcaaccucauugcuccucggggguacuuuaagauccgcucuggaaaguccagcaucaugagaucugacgcccccauuggcaaauguaauagcgaaugcaucacaccgaacggcuccauuccuaaugauaagcccuuccagaacgugaaucggaucacguauggggcuuguccucgcuacgugaaacagaacacccugaagcuggccacaggaaugagaaauguccccgagaaacaaacccggggcauuuuuggggcgaucgccggauucaucgaaaacggcugggaggggaugguugacggaugguauggcuuucgccaccaaaauucugagggcauugggcaggcugccgaucuuaagagcacacaggcugccaucgaccagauuaacggaaaacucaauagacugaucggcaagaccaacgaaaaguuccaccagauugagaaagaguucuccgaaguggaagggcggauccaggaucuugagaaguacguggaggacacgaaaauugaucuguggagcuauaacgccgaacuccuggucgcucuggagaaucaacauacaaucgaccucaccgauucugaaaugaacaagcuguuugagagaaccaaaaagcagcuucgcgaaaaugcggaggacaugggaaacggcugcuucaagaucuaccacaaaugugauaaugccugcauuggguccauccggaacggcacauaugaccaugacguguacagagaugaggcucugaauaaccgcuuucagauuaagggaguugaacucaaaagcggcuacaaggacuggauccuguggauuucuuucgccaucuccugcuuucuucuguguguggcccuccugggguucaucaugugggcuugccagaaaggaaauauucgguguaacaucugcauuuga

SEQ ID NO: 189817 - RNA, 1701 nt, Artificial Sequence
  derived and/or modified sequence opt5 from hemagglutinin__InfluenzaA__AEG65626
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcaagucuaacaauuccuuuuucagcagacugaacuggcucacacaucugaaauuuaaguauccugcccuuaaugucaccaugcccaacaacaaaaaguucgacaaacuguacaucuggggagugcaccauccugggacggauaaugaccagauuucucucuaugcgcaggccuccggccggaucacaguuagcaccaagcgcucccaacagacagugauuccgaacaucgggucuagaccccggguccgcgauauuccuagcagaaucuccaucuacuggaccauugugaagcccggagacaugcugcugaucaauagcaccggcaaccucauugcuccucggggguacuuuaaaauccgcucuggaaaguccagcauuaugagaucugacgcccccaucggcaaauguaauagcgagugcaucacaccgaacggcuccauuccuaaugauaagcccuuccagaacgugaaucggaucacguauggggcuuguccucgcuacgucaaacagaacacccugaagcuggccacaggaaugagaaauguucccgagaaacaaacccggggcauuuuuggggcgaucgccggauucauugaaaacggcugggaggggaugguggacggaugguauggcuuucgccaccaaaauucugaaggcacagggcaggcugccgaucuuaagagcacccaggcugccaucaaccagaucaauggaaagcucaacagacugauuggcaaaacgaacgagaaguuccaccagaucgagaaagaguucuccgaaguggaagggcggauucaggaccuugagaaguacgucgaagauacaaaaaucgaccuguggagcuauaaugccgagcuccugguggcucuggagaaccaacauaccauugaucucaccgacucugaaaugaauaagcuguuugagagaacaaagaaacagcuucgcgaaaacgcggaggauaugggaaauggcugcuucaagaucuaccacaaaugugacaacgccugcauuggguccauccggaauggcaccuaugaucaugacguuuacagagacgaagcucugaacaaucgcuuucagaucaagggaguggagcucaaaagcggcuacaaggauuggauucuguggaucucuuucgccauuuccugcuuucuucugugugucgcccuccugggguucaucaugugggcuugccagaagggaaacauucgguguaauaucugcaucuga

SEQ ID NO: 189818 - RNA, 1701 nt, Artificial Sequence
  derived and/or modified sequence opt5 from hemagglutinin__InfluenzaA__AEG65637
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcaagucuaacaauuccuuuuucagcagacugaacuggcucacacaucugaaauuuaaguauccugcccuuaaugucaccaugcccaacaacaaaaaguucgacaaacuguacaucuggggagugcaccauccugggacggauaaugaccagauuucucucuaugcgcaggccuccggccggaucacaguuagcaccaagcgcucccaacagacagugauuccgaacaucgggucuagaccccggguccgcgauauuccuagcagaaucuccaucuacuggaccauugugaagcccggagacaugcugcugaucaauagcaccggcaaccucauugcuccucggggguacuuuaaaauccgcucuggaagauccagcauuaugcggucugacgcccccaucggcaaguguaauagcgagugcaucacaccgaacggcuccauuccuaaugauaaacccuuccagaacgugaaucgcaucacguauggggcuuguccuagauacgucaagcagaacacccugaaacuugccacaggaaugcggaauguucccgagaagcaaacccgcggcauuuuuggggcgaucgccggauucauugaaaacggcugggaggggaugguggacggaugguauggcuuuagacaccaaaauucugaaggcacagggcaggcugccgaucugaaaagcacccaggcugccaucaaccagaucaauggaaagcucaaccggcugauuggcaagacgaacgagaaauuccaccagaucgagaaggaguucuccgaaguggaagggcgcauucaggaccuugagaaauacgucgaagauacaaagaucgaccuguggagcuauaaugccgagcuccugguggcucuggagaaccaacauaccauugaucucaccgacucugaaaugaauaaacuguuugagagaacaaagaagcagcuucgggaaaacgcggaggauaugggaaauggcugcuucaaaaucuaccacaagugugacaacgccugcauuggguccaucagaaauggcaccuaugaucaugacguuuaccgcgacgaagcucugaacaaucgguuucagaucaaaggaguggagcucaagagcggcuacaaagauuggauucuguggaucucuuucgccauuuccugcuuucuucugugugucgcccuccugggguucaucaugugggcuugccagaagggaaacauuagauguaauaucugcaucuga

SEQ ID NO: 189819 - RNA, 1701 nt, Artificial Sequence; identical to SEQ ID NO: 183055
  derived and/or modified sequence opt5 from hemagglutinin__InfluenzaA__AEG65648

SEQ ID NO: 189820 - RNA, 1701 nt, Artificial Sequence; identical to SEQ ID NO: 184819
  derived and/or modified sequence opt5 from hemagglutinin__InfluenzaA__AEG65659

SEQ ID NO: 189821 - RNA, 1701 nt, Artificial Sequence; identical to SEQ ID NO: 184819
  derived and/or modified sequence opt5 from hemagglutinin__InfluenzaA__AEG65670

SEQ ID NO: 189822 - RNA, 1701 nt, Artificial Sequence; identical to SEQ ID NO: 184819
  derived and/or modified sequence opt5 from hemagglutinin__InfluenzaA__AEG65681

SEQ ID NO: 189823 - RNA, 1701 nt, Artificial Sequence; identical to SEQ ID NO: 189794
  derived and/or modified sequence opt5 from hemagglutinin__InfluenzaA__AEG65692

SEQ ID NO: 189824 - RNA, 1701 nt, Artificial Sequence; identical to SEQ ID NO: 183654
  derived and/or modified sequence opt5 from hemagglutinin__InfluenzaA__AEG65703

SEQ ID NO: 189825 - RNA, 1701 nt, Artificial Sequence
  derived and/or modified sequence opt5 from hemagglutinin__InfluenzaA__AEG65747
augaagaccaucauugcccugagcuacauccucugccugguguucgcucagaaacuucccggcaacgacaauuccacagccacgcugugucucgggcaccauaccgucccuaacggaacaauuguuaagaccaucacaaaugaucaaauugaggugaccaacgcgacagaacuggugcagucuagcuccaccggcgagaucugcgacucuccgcaccagauccuugauggggaaaauuguacgcugauugacgcucuccugggagauccccagugcgacggcuuucaaaacaaaaagugggaucuguucgucgagagaagcaaagccuauuccaauuguuacccuuaugacgugcccgauuacgccucucuccggagccugguugcuuccagcgggacccuugaauuuaacaaugagucuuucaacuggacaggagugacccagaauggcacauccagcgccugcaagcgcagaucuaacaauuccuuuuucagccggcugaacuggcucacccaucugaaguuuaaauauccugcucuuaaugucacgaugcccaacaacgagaaguucgacaaacuguacaucuggggcgugcaccauccugggacagauaaugaccagauuuuucucuaugcccaggcgucuggacgcaucaccguuuccacaaagagaagccaacagaccgugauuccgaacaucggcucccggccccgcgucagaaauauuccuucucggaucagcaucuacuggaccauugugaaacccggggauauccugcugauuaacuccacaggaaaucucaucgccccucgcggcuacuucaagauuagaagcgggaagucuuccaucaugcggagcgacgcucccaucggaaaauguaacucugaaugcauuacgccgaauggcagcaucccuaacgacaagcccuuucagaaugugaaccgcauuaccuauggcgccuguccuagauacgucaaacagaauacacugaaacuugcuaccgggaugcggaacguucccgagaagcaaacacgcggaaucuucggcgccauugcgggguuuaucgaaaauggaugggagggcaugguggaugggugguauggauucagacaccagaacuccgagggcaccggccaggccgcugaccugaagucuacgcaagccgcuaucaaucagauuaacgggaaacucaaccggcugaucggaaagacaaaugaaaaguuccaccagauugagaaagaauuuagcgagguggaaggcagaauccaggaucuugagaaguacgucgaggacaccaaaauugaucugugguccuauaacgccgaacuccugguggcccuggagaaucaacauaccaucgaccucacagauagcgaaaugaacaagcuguucgagcgcaccaaaaagcagcuucgggaaaaugcugaggacauggggaacggaugcuuuaagauuuaccacaaaugugauaaugcgugcaucggcucuaucagaaacgggacauaugaccaugauguuuaccgcgacgaggcccugaauaaccgguuccagauuaagggcguggaacucaaauccggauacaaggacuggauccuguggauuagcuuugcuaucucuugcuuccuucugugugucgcccuccugggcuuuauuaugugggccugccagaaagggaauaucagauguaacaucugcauuuga

SEQ ID NO: 189826 - RNA, 1701 nt, Artificial Sequence
  derived and/or modified sequence opt5 from hemagglutinin__InfluenzaA__AEG65758
augaagaccaucauugcccugagcuacauccucugccugguguccgcucagaaacuucccggcaacgacaauucuacagccacgcugugucucgggcaccaugcggucccuaacggaaccauuguuaagacaaucaccaaugaucaaauugaggugacaaacgcuaccgaacuggugcagagcuccucuacaggcgggaucugcgacagcccgcaccagauccuugauggagagaauuguacccugauugacgcccuccugggcgauccccagugcgacggguuccaaaacaaaaagugggaucuguuugucgaaagauccaaagccuauucuaauuguuacccuuaugacgugcccgauuacgcuagccuccggucccugguugccagcucuggaacgcuugaguucaacaaugaauccuuuaacuggaccggcgugacacagaauggcaccagcucugcuugcaagcgcagauccaacaauagcuucuuuucucggcugaacuggcucacacaucugaaguucaaauauccugcccuuaaugucaccaugcccaacaacgagaaguuugacaaacuguacaucuggggagugcaccauccugggacggauaaugaccagauuuuccucuaugcgcaggccuccggccgcaucacaguuagcaccaagagaucccaacagacagugauuccgaacaucgggucucggccccgcgucagaaauauuccuagccggaucuccaucuacuggaccauugugaaacccggagauauccugcugauuaacagcaccggcaaucucaucgcuccucgcggguacuuuaagauuagaucuggaaaguccagcaucaugcggucugacgcccccaucggcaaauguaacagcgagugcauuacaccgaauggcuccaucccuaacgacaagcccuuccagaaugugaaccgcauuacguauggggcuuguccuagauacgucaaacagaauacccugaagcuggccacaggaaugcggaacguucccgaaaaacaaacccgcggcaucuuuggggcgauugccggauucaucgagaauggcugggaagggaugguggauggaugguauggcuuuagacaccagaacucugagggcaucgggcaggcugccgaccuuaagagcacacaagcugccauuaaucagaucaacggaaaacucaaccggcugauuggcaagaccaaugagaaguuccaccagaucgaaaaagaguucuccgaaguggaggggcgcauucaggaucuugaaaaguacgucgaggacacgaaaaucgaucuguggagcuauaacgccgagcuccugguggcucuggaaaaucaacauacaauugaccucaccgauucugagaugaacaagcuguuugaaagaaccaaaaagcagcuucgggagaaugcggaagacaugggaaacggcugcuucaagaucuaccacaaaugugauaaugccugcaucggguccauuagaaacggcacauaugaccaugauguuuaccgcgacgaggcucugaauaaccgguuucagaucaagggaguggagcucaaaagcggcuacaaggacuggauucuguggaucucuuucgccauuuccugcuuucuucugugugucgcccuccugggguucaucaugugggcuugccagaaaggaaauaucagauguaacauuugcaucuga

SEQ ID NO: 189827 - RNA, 1701 nt, Artificial Sequence; identical to SEQ ID NO: 183305
  derived and/or modified sequence opt5 from hemagglutinin__InfluenzaA__AEG65769

SEQ ID NO: 189828 - RNA, 1701 nt, Artificial Sequence
  derived and/or modified sequence opt5 from hemagglutinin__InfluenzaA__AEG65780
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauaaaauugaggugacaaacgcuaccgaacuggugcaaucuagcuccacaggcgagaucugcaauucuccgcaccagauccuugacggggaaaacuguacccugauugaugcccuccugggagacccccagugcgauggcuuucagaauaagaaaugggaccuguucgucgagagaagcaaggcccauuccaacuguuauccuuacgaugugcccgacuaugcuucucuccggagccugguugccgcuuccgggacgcuugaauuuaauaacgagagcuucaauuggaccggagugacacaaaacggcaccucuuccgccugcauccgcagaagcaauaacuccuuuuucucucggcugaauuggcucacacaccugaacuuuaaguacccugcgcuuaacgucaccaugcccaauaacgagcaguucgauaaacuguauauuuggggcgugcaucacccugggacggacaaggaucagaucuuucucuacgcccaggcugccggacgcauuacaguuagcaccaaaagaucucaacaggcugugaucccgaauauuggcucccggccccgcgucagaaacaucccuagccggguguccaucuauuggacaauugugaagcccggggacauccugcugauuaauucuaccggaaaccucaucgccccucgcggcuacuucaaaauuagaagcgggaaguccagcaucaugcggucugaugcgcccaucggaaaguguaauuccgccugcauuaccccgaacggcagcaucccuaaugacaaacccuuucagaacgucaaucgcauuacauacggcgcuuguccuagauauguuaagcagaacacgcugaaacuugccaccgggaugcggaaugugcccgaaaagcaaacacgcggaaucuucggcgcuauugccggguuuaucgagaacggaugggaaggcaugguggacgggugguacggauucagacaccaaaauucugagggccggggccaggccgcugaucugaaaagcacccaggcggccaucgaccagauuaacgggaagcucaacagacugaucggaaaaacaaaugagaaguuccaucagauugaaaaggaguuuuccgaagucgagggccgcauccaggaucuugaaaaauauguggaggacaccaagauugaucuguggucuuacaacgcugagcuccugguugcccuggaaaaucaacacacgaucgaccucacagauagcgagaugaacaaacuguucgaaaagaccaaaaagcagcuucgggagaaugccgaagacauggggaacggaugcuuuaagauuuaucauaaaugugauaaugcuugcaucggcuccaucagaaacgggaccuacgaccacgauguguaucgcgacgaggcccugaauaaccgguuccagauuaagggcgucgagcucaaaagcggauacaaggacuggauccuguggauuucuuuugcgaucuccugcuuccuucuguguguggcucuccugggcuuuauuaugugggccugccagaaagggaauaucagauguaacaucugcauuuga

SEQ ID NO: 189829 - RNA, 1701 nt, Artificial Sequence
  derived and/or modified sequence opt5 from hemagglutinin__InfluenzaA__AEG65813
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccgcuggacgcauuacaguuucuaccaagagaucccagcaggccgugaucccgaauauuggcagccggccccgcgucagaaacaucccuucccgggugucuaucuauuggacaauugugaaacccggggacauccugcugauuaauagcaccggaaaccucaucgcuccucgcggcuacuucaagauuagauccgggaaaagcucuaucaugcgguccgaugcccccaucggaaaguguaauagcgcgugcauuaccccgaacggcucuaucccuaaugacaagcccuuucagaacgucaaucgcauuacauacggcgccuguccuagauauguuaaacaaaacacgcugaaacuugcuaccgggaugcggaaugugcccgaaaaacagacacgcggaaucuucggcgccauugcuggguuuaucgagaacggaugggaaggcaugguggacgggugguacggauucagacaccagaauagcgagggccggggccaagccgccgaucugaaguccacccaggcugcgaucgaccagauuaacgggaaacucaacagacugaucggaaagacaaaugagaaauuccaucagauugaaaaggaguuuucugaagucgagggccgcauccaagaucuugaaaaguauguggaggacaccaaaacggaucuguggagcuacaacgccgagcuccugguugcucuggaaaaucagcacacaauugaccucaccgauuccgagaugaacaagcuguucgaaaagaccaagaaacagcuucgggagaaugccgaagacauggggaacggaugcuuuaagaucuaucauaagugugauaaugccugcauuggcagcaucagaaacgggacauacgaccacgauguguaucgcgacgaggcucugaauaaccgguuccagaucaaaggcgucgagcucaagucuggauacaaagacuggauucuguggaucuccuuugccauuagcugcuuccuucuguguguggcgcuccugggcuuuaucaugugggcuugccaaaaggggaauauuagauguaacaucugcaucuga

SEQ ID NO: 189830 - RNA, 1701 nt, Artificial Sequence
  derived and/or modified sequence opt5 from hemagglutinin__InfluenzaA__AEG79801
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccacagccgaccaacagucucucuaccagaaugcugaugccuacguguucgugggcaccagcagauauuccaagaaauuuaagccugagauugcuauccggccgaaaguccgcgacagagaggggcggaugaacuacuauuggacgcugguugaacccggagauaagauuacauucgaggccaccggcaaccugguggugccucgcuacgcguuugccauggaaagaaaugcugggagcggaaucauuaucucugacacacccguccaugauugcaacaccaccugucagacaccuaaaggcgccaucaauacgucccuccccuuccaaaacauucacccgaucaccauuggcaagugcccuaaguaugugaaaagcacaaagcugcggcuugcuaccgggcugcgcaauguucccucuauccagagcagaggacucuuuggcgccauugccggguucaucgagggaggcuggacagggaugguggacggaugguacggcuaucaucaccagaacgaacagggcuccggguacgcugcggaccugaaaucuacccaaaaugccaucgauaagauuacgaacaaagucaauagcgugaucgagaagaugaacacacaguuuaccgcuguuggaaaggaguucaaucaccuugaaaaacggauugagaaccugaauaagaaaguggacgauggcuuccucgacaucuggaccuacaacgccgaacugcugguccuccuggagaaugaacgcacacuugauuaucaugacuccaacgugaagaaccuguacgagaaagucagaaaucagcucaagaacaaugccaaggagauugggaacggauguuuugaguucuaucacaaaugcgauaauaccuguauggagagcgugaagaacggcacauacgacuauccuaaauacucugaagaggcuaagcugaaucgggaagagaucgaugggguuaaacuugaguccacgcgcaucuaucagauucuggccaucuacagcaccguggcgucuucccucguccuggugguuagccugggcgcuauuuccuuuuggaugugcucuaacggaagccuccaaugcagaaucuguauuuga

SEQ ID NO: 189831 - RNA, 1701 nt, Artificial Sequence
  derived and/or modified sequence opt5 from hemagglutinin__InfluenzaA__AEG79807
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaaggaaaauagcuacccuaaacuguccaagagcuauauuaacgauaagggcaaagaggugcuuguccugugggggauccaccaccccuccaccacagccgaccaacagucuauuuaccagaaugcugaugccuacguguucgugggaaccagcagauauuccaagaaauuuaagccugagaucgcuauucggccgaaaguccgcgaccaggaaggcagaaugaacuacuauuggacgcucguugagcccggggauaagaucacauucgaagccaccggaaaccugguggugccucgguacgcguuugccauggagcgcaaugcuggcagcgggauuaucaucucugacacacccguccaugauugcaacaccaccugucaaacaccuaaaggagccauuaauacgucccugcccuuccagaacauccacccgauuaccaucggcaagugcccuaaguaugugaaaagcacaaagcucagacuggcuaccggccuucggaauguucccucuauucagagccgcgggcuguuuggagccaucgccggcuucaucgaagggggauggacaggcaugguggacgggugguacggauaucaucaccagaacgagcaaggcuccggcuacgcugcggaccucaaaucuacccagaaugccauugauaagaucacgaacaaagucaauagcgugauugagaagaugaacacacaguuuaccgcuguugggaaggaguucaaucaccuggagaaaagaaucgaaaaccuuaauaagaaaguggacgauggauuccuggacauuuggaccuacaacgccgagcuccugguccugcucgaaaaugagcggacacuggauuaucaugacuccaacgugaagaaccuuuacgagaaaguccgcaaucagcugaagaacaaugccaaggaaaucggcaacggguguuuugaguucuaucacaaaugcgauaauaccuguauggaaagcgugaagaacggaacauacgacuauccuaaauacucugaggaagcuaagcucaauagagaggagaucgauggcguuaaacuggaauccacgcggauuuaucaaauccuugccauuuacagcaccguggcgucuucccugguccucgugguuagccugggggcuaucuccuuuuggaugugcucuaacggcagccugcagugccgcauuuguaucuga

SEQ ID NO: 189832 - RNA, 1701 nt, Artificial Sequence
  derived and/or modified sequence opt5 from hemagglutinin__InfluenzaA__AEG79835
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuaaguccuauauuaaugacaagggaaaagaagugcuuguccuguggggcauccaccaccccagcaccacagccgaucaacaguccauuuaccagaacgcugacaccuacguguucguggggacgucuagauauagcaagaaauuuaagccugagaucgccauucggccgaaaguccgcgaucaggagggaagaaugaauuacuauuggacacucguugaacccggcgacaagaucaccuucgaggcuacagggaaccugguggugccucgguacgccuuugcgauggaacgcaacgccggauccggcauuaucaucagcgauacccccguccaugacugcaauaccacaugucaaacgccuaaaggcgcuauuaacaccucucugcccuuccagaauauccacccgauuacaaucgggaagugcccuaaguaugugaaauccaccaagcucagacuggccacaggacuucggaacguucccagcauucagucucgcggccuguuuggggcuaucgccggauucaucgagggcggguggaccggaaugguggacggcugguacggcuaucaucaccagaaugaacaagggagcggauacgccgcugaucucaaauccacgcagaacgcgauugacaagaucacaaauaaagucaacucugugauugagaagaugaauacccaguuuaccgccguuggcaaggaguucaaccaccuggagaaaagaaucgagaaucuuaacaagaaaguggaugacggguuccuggauauuuggacauacaaugcugaacuccugguccugcucgagaacgaacggacccuggacuaucaugauagcaaugugaagaaccuuuacgagaaaguccgcaaccagcugaagaauaacgccaaggagaucggaaauggcuguuuugaguucuaucacaaaugcgacaacacauguauggaauccgugaagaaugggacguacgauuauccuaaauacagcgaagaggccaagcucaacagagaagagaucgacggcguuaaacuggagucuacccggauuuaucaaauccuugcuauuuacuccacaguggccagcucucugguccucgugguuucccugggagcgaucagcuuuuggaugugcuccaauggcucucugcagugccgcauuuguaucuga

SEQ ID NO: 189833 - RNA, 1701 nt, Artificial Sequence
  derived and/or modified sequence opt5 from hemagglutinin__InfluenzaA__AEH59363
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaggaacugcgggagcagcuuuccagcgucucuuccuucgaacgcuuugagaucuuccccaagaccagcucuuggccuaaccacgacuccaauaagggagugacagccgcuuguccccaagccggcgcgaaaucuuuuuauaagaaccugaucuggcucguuaaaaagggcaauagcuacccuaaacuguccaagagcuauauuaacgauaaggggaaagaagugcuuguccuguggggaauccaucaccccuccaccucugccgaccagcagagccucuaccagaaugcugaugccuacguguucgugggcacauccaaguauagcaaaaaguuuaaaccugagauugcugucagaccgaagguucgggaccaagaggggcgcaugaacuacuauuggacccugguggaacccggagauaaaaucacguucgaggccacaggcaaccugcucgugccuagauacgcguuugccauggaacggaaugcugggucuggaauuaucauuuccgacacccccguccacgauugcaacacaaccugucagaccccuaagggcgccaucaauacaagccugcccuuccagaacauccauccgauuacgaucggcaagugcccuaaauaugugaagucuaccaaacuucgccuggcuacagggcucagaaauguucccagcauucagucccggggacuguuuggcgccaucgccggguucauugagggaggcuggaccgggaugguggacggaugguacggcuaucaccaucaaaacgcucagggcucuggguacgcggccgaccuuaagagcacacagaaugcuaucgauaaaaucaccaacaaggucaauuccgugauugaaaagaugaacacgcaguuuacagccguuggaaaagaguucaaucaccuggagaagcgcaucgaaaaccucaauaaaaagguggacgauggcuuccuggacauuuggaccuacaacgccgagcugcucguccugcuugaaaaugagagaacccuggauuaucacgacagcaacgugaaaaaccucuacgaaaagguccggucucaacugaagaauaacgcuaaagagaucgggaauggauguuuugaguucuaucauaagugcgauaacacauguauggaauccgugaaaaauggcaccuacgacuauccuaaguacagcgaggaagccaaacuuaaccgcgaggaaauugaugggguuaagcuggagucuacaagaaucuaucagauccucgcgauuuacuccacgguggcuagcucccugguccuggugguuucucucggcgccaucagcuuuuggaugugcuccaauggaucucugcagugccggauuuguaucuga

SEQ ID NO: 189834 - RNA, 1701 nt, Artificial Sequence
  derived and/or modified sequence opt5 from hemagglutinin__InfluenzaA__AEH59367
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccacagccgaccaacagucucucuaccagaaugcugaugccuacguguucgugggcaccagcagauauuccaagaaauuuaagccugagauugcuauccggccgaaaguccgcgaccaggaggggagaaugaacuacuauugggcccugguugaacccggagauaagauuacguucgaggcgacaggcaaccugguggugccucgguacgccuuugcuauggaacgcaaugccgggagcggaaucauuaucucugacacccccguccaugauugcaacacaaccugucaaaccccuaaaggcgcuaucaauacaucccuccccuuccagaacauucacccgaucacgauuggcaagugcccuaaguaugugaaaagcaccaagcugagacuugccacagggcugcggaauguucccucuauccagagccgcggacucuuuggcgccauugcuggguucaucgagggaggcuggaccgggaugguggacggaugguacggcuaucaucaccagaacgaacaaggcuccggguacgcggccgaccugaaaucuacacagaaugcuaucgauaagauuaccaacaaagucaauagcgugaucgagaagaugaacacgcaguuuacagccguuggaaaggaguucaaucaccuugagaaaagaauugagaaccugaauaagaaaguggacgauggcuuccucgacaucuggaccuacaacgccgaacugcugguccuccuggagaaugaacggacccuugauuaucaugacuccaacgugaagaaccuguacgagaaaguccgcaaucagcucaagaacaaugcuaaggagauugggaacggauguuuugaguucuaucacaaaugcgauaauacauguauggaaagcgugaagaacggcaccuacgacuauccuaaauacucugaagaggccaagcugaauagagaagagaucgaugggguuaaacuugaguccacacggaucuaucaaauucuggcgaucuacagcacgguggcuucuucccucguccuggugguuagccugggcgccauuuccuuuuggaugugcucuaacggaagccuccagugccgcaucuguauuuga

SEQ ID NO: 189835 - RNA, 1701 nt, Artificial Sequence
  derived and/or modified sequence opt5 from hemagglutinin__InfluenzaA__AEH59369
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaaggccagcucuuggccuaaucacgauuccaacaagggagugaccgcugccuguccccaugcgggcgccaaaggcuuuuauaagaaucugaucuggcucguuaaaaaggggaacagcuacccuaaacugucuaaguccuauauuaaugacaagggaaaagaagugcuuguccuguggggcauccaccaccccagcacaaccgcugaucaacagucccucuaccagaacgccgacacauacguguucguggggaccucuagauauagcaagaaauuuaagccugagauugcuauccggccgaaaguccgcgaucaggagggaagaaugaauuacuauuggacgcugguugaacccggcgacaagauuacauucgaggccaccgggaaccugguggugccucgguacgcguuugccauggaacgcaacgcuggauccggcaucauuaucagcgauacacccguccaugacugcaauaccaccugucaaacaccuaaaggcgccaucaacacgucucuccccuuccagaauauucacccgaucaccauugggaagugcccuaaguaugugaaauccacaaagcugagacuugcuaccggacugcggaacguucccagcauccagucucgcggccucuuuggggccauugccggauucaucgagggcggguggacaggaaugguggacggcugguacggcuaucaucaccagaaugaacaagggagcggauacgcugcggaucugaaauccacccagaacgccaucgacaagauuacgaauaaagucaacucugugaucgagaagaugaauacacaguuuaccgcuguuggcaaggaguucaaccaccuugagaaaagaauugagaaucugaacaagaaaguggaugacggguuccucgauaucuggaccuacaaugccgaacugcugguccuccuggagaacgaacggacacuugacuaucaugauagcaaugugaagaaccuguacgagaaaguccgcaaccagcucaagaauaacgccaaggagauuggaaauggcuguuuugaguucuaucacaaaugcgacaacaccuguauggaauccgugaagaaugggacauacgauuauccuaaauacagcgaagaggcuaagcugaacagagaagagaucgacggcguuaaacuugagucuacgcggaucuaucaaauucuggccaucuacuccaccguggcgagcucucucguccuggugguuucccugggagcuauuagcuuuuggaugugcuccaauggcucucuccagugccgcaucuguauuuga

SEQ ID NO: 189836 - RNA, 1701 nt, Artificial Sequence; identical to SEQ ID NO: 189833
  derived and/or modified sequence opt5 from hemagglutinin__InfluenzaA__AEH59371

SEQ ID NO: 189837 - RNA, 1701 nt, Artificial Sequence
  derived and/or modified sequence opt5 from hemagglutinin__InfluenzaA__AEH59373
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagagagguugcuccccuccaucugggaaaaugcaacaucgccggcuggauucuggggaauccugaaugugagucucucagcacagccuccucuuggagcuacaucguggaaaccuccucuagcgacaacggaacgugcuauccgggcgauuuuauugacuacgaggagcugcgggaacagcuuuccagcgucucuuccuucgagcgcuuugaaaucuuccccaagaccagcucuuggccuaaucacgauuccaacaagggggugacagccgcuuguccccaugccggagcgaaaggcuuuuauaagaaucugaucuggcucguuaaaaagggcaacagcuacccuaaacugucuaaguccuauauuaaugacaaggggaaagaggugcuuguccuguggggaauccaccaccccagcaccacagccgaucaacagucccucuaccagaacgcugacaccuacguguucgugggcacgucuagauauagcaagaaauuuaagccugagauugccauccggccgaaaguccgcgaucaggaagggagaaugaauuacuauuggacacugguugagcccggagacaagauuaccuucgaagcuacaggcaaccugguggugccucgguacgccuuugcgauggagcgcaacgccggguccggaaucauuaucagcgauacccccguccaugacugcaauaccacaugucaaacgccuaaaggcgcuaucaacaccucucuccccuuccagaauauucacccgaucacaauuggcaagugcccuaaguaugugaaauccaccaagcugagacuugccacagggcugcggaacguucccagcauccagucucgcggacucuuuggcgcuauugccggguucaucgaaggaggcuggaccgggaugguggacggaugguacggcuauagacaucagaaugagcaaggcagcggguacgccgcugaucugaaauccacgcagaacgcgaucgacaagauuacaaauaaagucaacucugugaucgagaagaugaauacccaguuuaccgccguuggaaaggaguucaaccaccuugaacggcgcauugaaaaucugaacaaaaagguggaugacggcuuccucgauaucuggacauacaaugcugagcugcugguccuccuggaaaacgagagaacccuugacuaucacgauagcaaugugaaaaaccuguacgagaagguccggaaccagcucaaaaauaacgccaaggaaauugggaauggauguuuugaguucuaucauaagugcgacaacacauguauggaauccgugaaaaauggcacguacgauuauccuaaguacagcgaggaagccaaacugaaccgcgaggagaucgacgggguuaaacuugaaucuaccagaaucuaucaaauucuggcuaucuacuccacaguggccagcucucucguccuggugguuucccugggcgcgauuagcuuuuggaugugcuccaauggaucucuccagugccggaucuguauuuga

SEQ ID NO: 189838 - RNA, 1701 nt, Artificial Sequence; identical to SEQ ID NO: 189833
  derived and/or modified sequence opt5 from hemagglutinin__InfluenzaA__AEH59375

SEQ ID NO: 189839 - RNA, 1701 nt, Artificial Sequence
  derived and/or modified sequence opt5 from hemagglutinin__InfluenzaA__AEH59379
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccacagccgaucaacagucucucuaccagaacgcugacaccuacguguucgugggcacgagcagauauuccaagaaauuuaagccugagauugccauccggccgaaaguccgcgaucaggaggggagaaugaauuacuauuggacacugguugaacccggagacaagauuaccuucgaggcuacaggcaaccugguggugccucgguacgccuuugcgauggaacgcaacgccgggagcggaaucauuaucucugauacccccguccaugacugcaauaccacaugucaaacgccuaaaggcgcuaucaacaccucccuccccuuccagaauauucacccgaucacaauuggcaagugcccuaaguaugugaaaagcaccaagcugagacuugccacagggcugcggaacguucccucuauccagagccgcggacucuuuggcgcuauugccggguucaucgagggaggcuggaccgggaugguggacggaugguacggcuaucaucaccagaaugaacaaggcuccggguacgccgcugaucugaaaucuacgcagaacgcgaucgacaagauuacaaauaaagucaacagcgugaucgagaagaugaauacccaguuuaccgccguuggaaaggaguucaaccaccuugagaaaagaauugagaaucugaacaagaaaguggaugacggcuuccucgauaucuggacauacaaugcugaacugcugguccuccuggagaacgaacggacccuugacuaucaugauuccaaugugaagaaccuguacgagaaaguccgcaaccagcucaagaauaacgccaaggagacagggaauggauguuuugaguucuaucacaaaugcgacaacacguguauggaaagcgugaagaauggcaccuacgauuauccuaaauacucugaagaggccaagcugaacagagaagagauugacgggguuaaacuugaguccacacggaucuaucaaauccuggcuauuuacagcaccguggccucuucccucguccuggugguuagccugggcgcgaucuccuuuuggaugugcucuaauggaagccuccagugccgcauuuguaucuga

SEQ ID NO: 189840 - RNA, 1701 nt, Artificial Sequence; identical to SEQ ID NO: 189833
  derived and/or modified sequence opt5 from hemagglutinin__InfluenzaA__AEH59381

SEQ ID NO: 189841 - RNA, 1701 nt, Artificial Sequence
  derived and/or modified sequence opt5 from hemagglutinin__InfluenzaA__AEH59383
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuauuuccuauaucaaugacaagggaaaggaagugcuuguccuguggggcauucaccaccccagcaccacagccgaucaacagucccucuaccagaacgcugacaccuacguguucguggggacgucuagauauagcaaaaaguuuaaaccugagaucgccauucggccgaagguccgcgaucaggagggaagaaugaauuacuauuggacacugguugaacccggcgacaaaaucaccuucgaggcuacagggaaccugguggugccucgguacgccuuugcgauggaacgcaacgccggauccggcauuaucaucagcgauacccccguccaugacugcaauaccacaugucaaacgccuaagggcgcuauuaacaccucucuccccuuccagaauauccacccgauuacaaucgggaaaugcccuaaguaugugaaguccaccaaacugagacuugccacaggacugcggaacguucccagcauucagucucgcggccucuuuggggcuaucgccggauucaucgagggcggguggaccggaaugguggacggcugguacggcuaucaucaccagaaugaacaagggagcggauacgccgcugaucugaaguccacgcagaacgcgauugacaaaaucacaaauaaggucaacucugugauugagaaaaugaauacccaguuuaccgccguuggcaaggaguucaaccaccuugaaaagagaaucgagaaucugaacaaaaagguggaugacggguuccucgauauuuggacauacaaugcugaacugcugguccuccuggagaacgaacggacccuugacuaucaugauagcaaugugaaaaaccuguacgagaagguccgcaaccagcucaaaaauaacgccaaggagaucggaaauggcuguuuugaguucuaucacaagugcgacaacacauguauggaguccgugaaaaaugggacguacgauuauccuaaguacagcgaagaggccaaacugaacagagaagagaucgacggcguuaaacuugagucuacccggauuuaucaaauccuggcuauuuacuccacaguggccagcucucucguccuggugguuucccugggagcgaucagcuuuuggaugugcuccaauggcucucuccagugccgcauuuguaucuga

SEQ ID NO: 189842 - RNA, 1701 nt, Artificial Sequence
  derived and/or modified sequence opt5 from hemagglutinin__InfluenzaA__AEH59385
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccacagccgaucaacagucucucuaccagaacgcugacgccuacauuuucgugggcaccagcagauauuccaagaaauuuaagccugagaucgcuauucggccgaaagugcgcgaucaggaggggagaaugaauuacuauuggacgcuggucgaacccggagacaagaucacauucgaggccaccggcaaccugguugugccucgguacgcguuugccauggaacgcaacgcugggagcggaauuaucaucucugauacacccgugcaugacugcaauaccaccugucaaacaccuaaaggcgccauuaacacgucccuccccuuccagaauauccacccgauuaccaucggcaagugcccuaaguaugucaaaagcacaaagcugagacuugcuaccgggcugcggaacgugcccucuauucagagccgcggacucuuuggcgccaucgccggguucaucgagggaggcuggacagggaugguugacggaugguacggcuaucaucaccagaaugaacaaggcuccggguacgcugcggaucugaaaucuacccagaacgccauugacaagaucacgaauaaagugaacagcgucauugagaagaugaauacacaguuuaccgcugugggaaaggaguucaaccaccuugagaaaagaaucgagaaucugaacaagaaaguugaugacggcuuccucgauauuuggaccuacaaugccgaacugcuggugcuccuggagaacgaacggacacuugacuaucaugauuccaaugucaagaaccuguacgagaaagugcgcaaccagcucaagaauaacgccaaggagaucgggaauggauguuuugaguucuaucacaaaugcgacaacaccuguauggaaagcgucaagaauggcacauacgauuauccuaaauacucugaagaggcuaagcugaacagagaagagaucgacggggugaaacuugaguccacgcggauuuaucaaauccuggccauuuacagcaccguugcgucuucccucgugcuggucgugagccugggcgcuaucuccuuuuggaugugcucuaauggaagccuccagugccgcauuuguaucuga

SEQ ID NO: 189843 - RNA, 1701 nt, Artificial Sequence; identical to SEQ ID NO: 189833
  derived and/or modified sequence opt5 from hemagglutinin__InfluenzaA__AEH59387

SEQ ID NO: 189844 - RNA, 1701 nt, Artificial Sequence
  derived and/or modified sequence opt5 from hemagglutinin__InfluenzaA__AEH59393
augaaggccauccugguggucauucucuacaccuucgcuacagccaacgcggacacgcugugcaucggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaaaugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaggcuuuuauaagaaucuuauuuggcugguuaaaaaggggaacagcuacccuaaacucucuaaguccuauaucaaugacaagggaaaagaagugcugguccuuuggggcauucaccaccccagcaccacagccgaucaacagucccuguaccagaacgcugacaccuacguguucguggggacgucuagauauagcaagaaauuuaagccugagaucgccauucggccgaaaguccgcgaucaggagggaagaaugaauuacuauuggacacucguugaacccggcgacaagaucaccuucgaggcuacagggaaccugguggugccucgguacgccuuugcgauggaacgcaacgccggauccggcauuaucaucagcgauacccccguccaugacugcaauaccacaugucaaacgccuaaaggcgcuauuaacaccucucugcccuuccagaauauccacccgauuacaaucgggaagugcccuaaguaugugaaauccaccaagcucagacuggccacaggacuucggaacguucccagcauucagucucgcggccuguuuggggcuaucgccggauucaucgagggcggguggaccggaaugguggacggcugguacggcuaucaucaccagaaugaacaagggagcggauacgccgcugaucucaaauccacgcagaacgcgauugacaagaucacaaauaaagucaacucugugauugagaagaugaauacccaguuuaccgccguuggcaaggaguucaaccaccuggaaaagagaaucgagaaucuuaacaagaaaguggaugacggguuccuggauauuuggacauacaaugcugaacuccugguccugcucgagaacgaacggacccuggacuaucaugauagcaaugugaagaaccuuuacgagaaaguccgcaaccagcugaagaauaacgccaaggagaucggaaauggcuguuuugaguucuaucacaaaugcgacaacacauguauggaguccgugaagaaugggacguacgauuauccuaaauacagcgaagaggccaagcucaacagagaagagaucgacggcguuaaacuggagucuacccggauuuaucaaauccuugcuauuuacuccacaguggccagcucucugguccucgugguuucccugggagcgaucagcuuuuggaugugcuccaauggcucucugcagugccgcauuuguaucuga

SEQ ID NO: 189845 - RNA, 1701 nt, Artificial Sequence
  derived and/or modified sequence opt5 from hemagglutinin__InfluenzaA__AEH59397
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaggaacugcgggagcagcuuuccagcgucucuuccuucgaacgcuuugagaucuuccccaagaccagcucuuggccuucccacgacagcaacaagggagugacagccgcuuguccccaugccggcgcgaaaucuuuuuauaagaaucugaucuggcucguuaaaaagggcaacuccuacccuaaacugagcaaguccuauauuaaugauaaggggaaagaagugcuuguccuguggggaauccaccaccccucuaccagcgccgaccaacagucccucuaccagaacgcugaugccuacguguucgugggcacaagcaaguauucuaaaaaguuuaaaccugagauugcugucagaccgaagguucgggaccaggaggggcgcaugaauuacuauuggacccugguggaacccggagauaaaaucacguucgaggccacaggcaaccugcucgugccuagauacgcguuugccauggaacggaacgcuggguccggaauuaucauuagcgacacccccguccaugauugcaauacaaccugucaaaccccuaagggcgccaucaacacaucucugcccuuccagaauauccacccgauuacgaucggcaagugcccuaaauauguuaagagcaccaaacuucgccuggcuacagggcucagaaacgugcccuccauucagucucggggacuguuuggcgccaucgccggguucauugagggaggcuggaccgggaugguggacggaugguacggcuaucaucaccagaaugaacaaggcagcggguacgcugcggaccuuaaguccacacagaacgccaucgauaaaaucaccaauaaggucaacagcgugauugagaagaugaauacgcaguuuacagcuguuggaaaagaguucaaccaccuggaaaagcgcaucgagaaucucaacaaaaagguggacgauggcuuccuggacauuuggaccuacaaugccgaacugcucguccugcuugagaacgaaagaacccuggauuaucaugacucuaaugugaaaaaccucuacgagaagguccggucccagcugaagaacaaugccaaagagaucgaaaacggguguuuugaguucuaucacaagugcgauaauacauguauggaaagcgugaaaaacggaaccuacgacuauccuaaguacucugaggaagcuaaacuuaaucgcgaggagauugauggcguuaagcuggaauccacaagaaucuaucaaauccucgccauuuacagcacgguggcguccucucugguccuggugguuagccucggggcuaucuccuuuuggaugugcucuaacggcagccugcagugccggauuuguaucuga

SEQ ID NO: 189846 - RNA, 1701 nt, Artificial Sequence
  derived and/or modified sequence opt5 from hemagglutinin__InfluenzaA__AEH59399
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuaaguccuauauuaaugacaagggaaaagaagugcuuguccuguggggcauccaccaccccagcaccacagccgaucaacagucccucuaccagaacgcugacaccuacguguucguggggacgucuagauauagcaagaaauuuaagccugagauugccauccggccgaaaguccgcgaucaggagggaagaaugaauuacuauuggacaauuguugaacccggcgacaagaucaccuucgaggcuacagggaaccugguggugccucgguacgccuuugcgauggaacgcaacgccggauccggcauuaucaucagcgauacccccguccaugacugcaauaccacaugucaaacgccuaaaggcgcuauuaacaccucucugcccuuccagaauauccacccgauuacaaucgggaagugcccuaaguaugugaaauccaccaagcucagacuggccacaggacuucggaacguucccagcauucagucucgcggccuguuuggggcuaucgccggauucaucgagggcggguggaccggaaugguggacggcugguacggcuaucaucaccagaaugaacaagggagcggauacgccgcugaucucaaauccacgcagaacgcgauugacaagaucacaaauaaagucaacucugugauugagaagaugaauacccaguuuaccgccguuggcaaggaguucaaccaccuggagaaaagaaucgagaaucuuaacaagaaaguggaugacggguuccuggauauuuggacauacaaugcugaacuccugguccugcucgagaacgaacggacccuggacuaucaugauagcaaugugaagaaccuuuacgagaaaguccgcaaccagcugaagaauaacgccaaggagaucggaaauggcuguuuugaguucuaucacaaaugcgacaacacauguauggaauccgugaagaaugggacguacgauuauccuaaauacagcgaagaggccaagcucaacagagaagagaucgacggcguuaaacuggagucuacccggauuuaucaaauccuugcuauuuacuccacaguggccagcucucugguccucgugguuucccugggagcgaucagcuuuuggaugugcuccaauggcucucugcagugccgcauuuguaucuga

SEQ ID NO: 189847 - RNA, 1701 nt, Artificial Sequence
  derived and/or modified sequence opt5 from hemagglutinin__InfluenzaA__AEH59403
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaggaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuaaguccuauauuaaugacaagggaaaagaagugcuuguccuguggggcauccaccaccccagcaccacagccgaucaacagucccucuaccagaacgcugacaccuacguguucguggggacgucuagauauagcaagaaauuuaagccugagauugccauccggccgaaaguccgcgaucaggagggaagaaugaauuacuauuggacacugguugcucccggcgacaagauuaccuucgaagccacagggaaccugguggugccucgguacgcguuugccauggagcgcaacgcuggauccggcaucauuaucagcgauacccccguccaugacugcaauaccacaugucaaacgccuaaaggcgccaucaacaccucucuccccuuccagaauauucacccgaucacaauugggaagugcccuaaguaugugaaauccaccaagcugagacuugcuacaggacugcggaacguucccagcauccagucucgcggccucuuuggggccauugccggauucaucgaaggcggguggaccggaaugguggacggcugguacggcuaucaucaccagaaugagcaagggagcggauacgcugcggaucugaaauccacgcagaacgccaucgacaagauuacaaauaaagucaacucugugaucgaaaagaugaauacccaguuuaccgcuguuggcaaggaguucaaccaccuugagaaaagaauugaaaaucugaacaagaaaguggaugacggguuccucgauaucuggacauacaaugccgagcugcugguccuccuggaaaacgagcggacccuugacuaucaugauagcaaugugaagaaccuguacgaaaaaguccgcaaccagcucaagaauaacgccaaggagauuggaaauggcuguuuugaguucuaucacaaaugcgacaacacauguauggaauccgugaagaaugggacguacgauuauccuaaauacagcgaggaagcuaagcugaacagagaggaaaucgacggcguuaaacuugagucuacccggaucuaucaaauucuggccaucuacuccacaguggcgagcucucucguccuggugguuucccugggagcuauuagcuuuuggaugugcuccaauggcucucuccagugccgcaucuguauuuga

SEQ ID NO: 189848 - RNA, 1701 nt, Artificial Sequence
  derived and/or modified sequence opt5 from hemagglutinin__InfluenzaA__AEH59407
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaaaugcaacaucgccggguggauucugggaaauccugagugugaaucucugagcacagccuccucuuggagcuacaucguggagaccuccucuagcgacaacggcacgugcuauccgggggauuuuauugacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaggcuuuuauaagaaucuuaucuggcugguuaaaaaggggaacagcuacccuaaacucucuaaguccuauauuaaugacaagggaaaagaagugcugguccuuuggggcauccaccaccccagcaccacagccgaucaacagucccuguaccagaacgcugacaccuacguguucguggggacgucuagauauagcaagaaauuuaagccugagauugccauccggccgaaaguccgcgaucaggagggaagaaugaauuacuauuggacacucguugaacccggcgacaagauuaccuucgaggcuacagggaaccugguggugccucgguacgccuuugcgauggaacgcaacgccggauccggcaucauuaucagcgauacccccguccaugacugcaauaccacaugucaaacgccuaaaggcgcuaucaacaccucucugcccuuccagaauauucacccgaucacaauugggaagugcccuaaguaugugaaauccaccaagcucagacuggccacaggacuucggaacguucccagcauccagucucgcggccuguuuggggcuauugccggauucaucgagggcggguggaccggaaugguggacggcugguacggcuaucaucaccagaaugaacaagggagcggauacgccgcugaucucaaauccacgcagaacgcgaucgacaagauuacaaauaaagucaacucugugaucgagaagaugaauacccaguuuaccgccguuggcaaggaguucaaccaccuggaaaagagaauugagaaucuuaacaagaaaguggaugacggguuccuggauaucuggacauacaaugcugaacuccugguccugcucgagaacgaacggacccuggacuaucaugauagcaaugugaagaaccuuuacgagaaaguccgcaaccagcugaagaauaacgccaaggagauuggaaauggcuguuuugaguucuaucacaaaugcgacaacacauguauggaguccgugaagaaugggacguacgauuauccuaaauacagcgaagaggccaagcucaacagagaagagaucgacggcguuaaacuggagucuacccggaucuaucaaauucuugcuaucuacuccacaguggccagcucucugguccucgugguuucccugggagcgauuagcuuuuggaugugcuccaauggcucucugcagugccgcaucuguauuuga

SEQ ID NO: 189849 - RNA, 1701 nt, Artificial Sequence; identical to SEQ ID NO: 189848
  derived and/or modified sequence opt5 from hemagglutinin__InfluenzaA__AEH59409

SEQ ID NO: 189850 - RNA, 1701 nt, Artificial Sequence
  derived and/or modified sequence opt5 from hemagglutinin__InfluenzaA__AEH59411
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaggaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuaaguccuauauuaaugacaagggaaaagaagugcuuguccuguggggcauccaccaccccagcaccacagccgaucaacagucccucuaccagaacgcugacaccuacguguucguggggacgucuagauauagcaagaaauuuaagccugagauugccauccggccgaaaguccgcgaucaggagggaagaaugaauuacuauuggacacugguugaacccggcgacaagauuaccuucgaggcuacagggaaccugguggugccucgguacgccuuugcgauggaucgcaacgccggauccggcaucauuaucagcgacacccccguccaugacugcaauaccacaugucaaacgccuaaaggcgcuaucaacaccucucuccccuuccagaauauucacccgaucacaauugggaagugcccuaaguaugugaaauccaccaagcugagacuugccacaggacugcggaacguucccagcauccagucucgcggccucuuuggggcuauugccggauucaucgaaggcggguggaccggaaugguggauggcugguacggcuaucaucaccagaaugagcaagggagcggauacgccgcugaccugaaauccacgcagaacgcgaucgauaagauuacaaauaaagucaacucugugaucgaaaagaugaauacccaguuuaccgccguuggcaaggaguucaaccaccuugagaaaagaauugaaaaucugaacaagaaaguggacgauggguuccucgacaucuggacauacaaugcugagcugcugguccuccuggaaaacgagcggacccuugauuaucaugacagcaaugugaagaaccuguacgaaaaaguccgcaaccagcucaagaauaacgccaaggagauuggaaauggcuguuuugaguucuaucacaaaugcgauaacacauguauggaauccgugaagaaugggacguacgacuauccuaaauacagcgaggaagccaagcugaacagagaggaaaucgauggcguuaaacuugagucuacccggaucuaucaaauucuggcuaucuacuccacaguggccagcucucucguccuggugguuucccugggagcgauuagcuuuuggaugugcuccaauggcucucuccagugccgcaucuguauuuga

SEQ ID NO: 189851 - RNA, 1701 nt, Artificial Sequence
  derived and/or modified sequence opt5 from hemagglutinin__InfluenzaA__AEH59413
augaaggccauccuggugguccuccuguacaccuucgcuauugccaacgcggacacacuuugcaucggcuaucacgcuaauaacagcacggauaccguugacacagugcuggagaaaaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacauccucuagcgacaacggaaccugcuauccgggggauuuuaucaauuacgaagaacugcgggagcagcuuuccagcgucucuuccuucgaacgcuuugagaucuuccccaagacgagcucuuggccuaaccacgacuccaauaagggagugaccgccgcuuguccccaugccggcgcgaaaucuuuuuauaagaaccugauuuggcucguuaaaaagggcaauagcuacccuaaacuguccaagagcuauaucaacgauaaggggaaagaagugcuuguccuguggggcauucaccaccccuccacaucugccgaccaacagagccucuaccagaaugcugaugccuacguguucgugggcaccuccaaguauagcaaaaaguuuaaaccugagaucgcugucagaccgaagguucgggaccaggaggggcgcaugaacuacuauuggacacugguggaacccggagauaaaauuaccuucgaggccacgggcaaccugcucgugccuagauacgcguuugccauggaacggaaugcugggucuggaaucauuaucuccgacacacccguccaugauugcaacaccacaugucaaaccccugagggcgccaucaauaccagccugcccuuccagaacauucacccgaucacaauuggcaagugcccuaaguaugugaaaucuacgaaacuucgccuggcuaccgggcucagaaauguucccagcauccagucccggggacuguuuggcgccauugccggguucaucgaaggaggcuggacagggaugguggacggaugguacggcuaucaucaccagaacgagcaaggcucuggguacgcugcggaccuuaagagcacccagaaugccaucgauaagauuacaaacaaagucaauuccgugaucgagaagaugaacacccaguuuacggcuguuggaaaggaguucaaucaccuggagaaacgcauugaaaaccucaauaagaaaguggacgauggcuuccuggacaucuggacauacaacgccgagcugcucguccugcuugaaaaugagagaacccuggauuaucaugacagcaacgugaagaaccucuacgagaaaguccggucucagcugaagaauaacgccaaggaaauugggaauggauguuuugaguucuaucacaaaugcgauaacaccuguauggaauccgugaagaauggcacauacgacuauccuaaauacagcgaggaagcuaaacuuaaccgcgaggagaucgaugggguuaagcuggaaucuaccagaaucuaucaaauucucgccaucuacuccacaguggcgagcucccugguccuggugguuucucucggcgcuauuagcuuuuggaugugcuccaauggaucucugcagugccggaucuguauuuga

SEQ ID NO: 189852 - RNA, 1701 nt, Artificial Sequence
  derived and/or modified sequence opt5 from hemagglutinin__InfluenzaA__AEH59585
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcagauauuccaagaaauuuaagccggagauugcuauccggcccaaaguccgcgaucaggaggggagaaugaauuacuauuggacccugguugaaccuggagacaagauuacguucgaggccacaggcaaccugguggugccccgguacgcguuugccauggaacgcaacgcugggagcggaaucauuaucucugauaccccuguccaugacugcaauacaaccugucaaacccccaaaggcgccaucaacacaucccucccguuccagaauauucacccuaucacgauuggcaagugccccaaguaugugaaaagcaccaagcugagacuugcuacagggcugcggaacguuccuucuauccagagccgcggacucuuuggcgccauugccggguucaucgagggaggcuggaccgggaugguggacggaugguacggcuaucaucaccagaaugaacaaggcuccggguacgcugcggaucugaaaucuacacagaacgccaucgacgagauuaccaauaaggucaacagcgugaucgagaaaaugaauacgcaguuuacaguugugggaaaggaguucaaccaccuugagaagagaauugaaaaucugaacaaaaaggucgaugacggcuuccucgauaucuggaccuacaaugcugagcugcuggugcuccuggaaaacgagcggacccuugacuaucaugauuccaaugucaaaaaccuguacgagaaggugcgcagccagcucaaaaacaaugccaaggaaauugggaacggauguuuugaguucuaucacaagugcgacaauacauguauggaaucuguuaaaaacggcaccuacgauuaucccaaguacuccgaggaagccaaacugaauagagaggagaucgacggggugaaacuugaaagcacacggaucuaucaaauucuggcuaucuacucuacggucgccuccagccucgugcugguugugucccugggcgcgauuucuuuuuggaugugcagcaacggaucccuccagugccgcaucuguauuuga

SEQ ID NO: 189853 - RNA, 1701 nt, Artificial Sequence
  derived and/or modified sequence opt5 from hemagglutinin__InfluenzaA__AEH59587
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaauccaacaagggagugacagccgcuuguccccaugccggcgcgaaaucuuuuuauaagaaucugaucuggcucguuaaaaagggcaacagcuacccuaaacuguccaagagcuauauuaaugauaaggggaaagaggugcuuguccuguggggaauccaccaccccuccaccucugccgaccaacagagccucuaccagaacgcugaugccuacguguucgugggcacauccagauauagcaagaaauuuaagccugagauugcuauccggccgaaaguccgcgaccaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccuuuauccagagccgcggacucuucggcgccauugccggguuuaucgaaggaggcuggaccgggaugguggacggaugguacggcuaucaucaccagaaugagcaaggcuccggguacgcugcggaccugaaaucuacacagaacgccaucgauaagauuaccaauaaagucaacagcgugaucgagaagaugaauacgcaguucacaguugugggaaaggaguucaacccucuugagaaaagaauugaaaaucugaacaagaaagucgacgauggcuuucucgacaucuggaccuacaaugcugagcugcuggugcuccuggaaaacgagcggacccuugauuaucacgacuccaaugucaagaaccuguacgagaaagugcgcagccagcucaagaacaaugccaaggaaauugggaacggauguuucgaguuuuaucauaaaugcgauaauacauguauggaaucuguuaagaacggcaccuacgacuaucccaaauacuccgaggaagccaagcugaauagagaggagaucgauggggugaaacuugaaagcacacggaucuaucaaauucuggcuaucuacucuacggucgccuccagccucgugcugguugugucccugggcgcgauuucuuucuggaugugcagcaacggaucccuccagugccgcaucuguauuuga

SEQ ID NO: 189854 - RNA, 1701 nt, Artificial Sequence; identical to SEQ ID NO: 186857
  derived and/or modified sequence opt5 from hemagglutinin__InfluenzaA__AEH59589

SEQ ID NO: 189855 - RNA, 1701 nt, Artificial Sequence
  derived and/or modified sequence opt5 from hemagglutinin__InfluenzaA__AEH59591
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacaagauuaccaauaaagucaacuccgugaucgagaagaugaauacgcaguuuacaguugugggaaaggaguucaaccaccuugagaaaagaauugagaaucugaacaagaaagucgaugacggcuuccucgauaucuggaccuacaaugcugaacugcuggugcuccuggagaacgaacggacccuugacuaucaugauagcaaugucaagaaccuguacgagaaagugcgcucucagcucaagaacaaugccaaggagauugggaacggauguuuugaguucuaucacaaaugcgacaauacauguauggaauccguuaagaacggcaccuacgauuauccuaaauacagcgaagaggccaagcugaauagagaagagaucgacggggugaaacuugagucuacacggaucuaucaaauucuggcuaucuacuccacggucgccagcucccucgugcugguugugucucugggcgcgauuagcuuuuggaugugcuccaacggaucucuccagugccgcaucuguauuuga

SEQ ID NO: 189856 - RNA, 1701 nt, Artificial Sequence
  derived and/or modified sequence opt5 from hemagglutinin__InfluenzaA__AEH59593
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaauccaacaagggagugacagccgcuuguccccaugccggcgcgaaaucuuuuuauaagaaucugaucuggcucguuaaaaagggcaacagcuacccuaaacuguccaagagcuauauuaaugauaaggggaaagaggugcuuguccuguggggaauccaccaccccuccaccucugccgaccaacagagcauuuaccagaacgcugaugccuacguguucgugggcacauccagauauagcaagaaauuuaagccugagaucgcuauucggccgaaaguccgcgaccaggaagggagaaugaauuacuauuggacccucguugagcccggagauaagaucacguucgaagccacaggcaaccugguggugccucgguacgcguuugccauggagcgcaacgcugggucuggaauuaucaucuccgacacccccguccaugauugcaauacaaccugucaaaccccuaaaggcgccauuaacacaagccugcccuuccagaauauccacccgauuacgaucggcaagugcccuaaguaugugaaaucuaccaagcucagacuggcuacagggcuucggaacguucccagcauucagucccgcggacuguuuggcgccaucgccggguucaucgaaggaggcuggaccgggaugguggacggaugguacggcuaucaucaccagaaugagcaaggcucuggguacgcugcggaccucaaaagcacacagaacgccauugauaagaucaccaauaaagucaacuccgugauugagaagaugaauacgcaguuuacagcuguuggaaaggaguucaaccaccuggagaaaagaaucgaaaaucuuaacaagaaaguggacgauggcuuccuggacauuuggaccuacaaugccgagcuccugguccugcucgaaaacgagcggacccuggauuaucaugacagcaaugugaagaaccuuuacgagaaaguccgcucucagcugaagaacaaugccaaggaaaucgggaacggauguuuugaguucuaucacaaaugcgauaauacauguauggaauccgugaagaacggcaccuacgacuauccuaaauacagcgaggaagcuaagcucaauagagaggagaucgaugggguuaaacuggaaucuacacggauuuaucaaauccuugccauuuacuccacgguggcgagcucccugguccucgugguuucucugggcgcuaucagcuuuuggaugugcuccaacggaucucugcagugccgcauuuguaucuga

SEQ ID NO: 189857 - RNA, 1701 nt, Artificial Sequence; identical to SEQ ID NO: 186491
  derived and/or modified sequence opt5 from hemagglutinin__InfluenzaA__AEH59595

SEQ ID NO: 189858 - RNA, 1701 nt, Artificial Sequence; identical to SEQ ID NO: 186857
  derived and/or modified sequence opt5 from hemagglutinin__InfluenzaA__AEH59597

SEQ ID NO: 189859 - RNA, 1701 nt, Artificial Sequence; identical to SEQ ID NO: 189852
  derived and/or modified sequence opt5 from hemagglutinin__InfluenzaA__AEH59599

SEQ ID NO: 189860 - RNA, 1701 nt, Artificial Sequence
  derived and/or modified sequence opt5 from hemagglutinin__InfluenzaA__AEH59601
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaacugcaauaucgccggguggauucugggaaacccugagugugaaucucucagcacagcuuccucuuggagcuacaucguggagaccuccucuagcgacaauggcacgugcuauccgggggauuuuauugacuacgaagaacugcgggagcagcuuuccagcgucucuuccuucgaacgcuuugagaucuuccccaaaaccagcucuuggccuaaccacgauuccaauaagggagugacagccgcuuguccccaugccggcgccaagagcuuuuauaaaaaccugaucuggcucguuaagaaaggcaauucuuacccuaagcuguccaaaagcuauauuaacgacaaggggaaggaagugcuuguccuguggggaauccaccaccccuccaccucugccgaucaacagagccucuaccagaaugcugacgccuacguguucgugggcacauccagauauagcaaaaaguuuaaaccugagauugcuauccggccgaagguccgcgaucaggaggggagaaugaacuacuauuggacccugguugaacccggagacaaaauuacguucgaggccacaggcaaccugguggugccucgguacgcguuugccauggaacgcaaugcugggucuggaaucauuaucuccgauacccccguccaugacugcaacacaaccugucaaaccccuaagggcgccaucaauacaagccuccccuuccagaacauucacccgaucacgauuggcaaaugcccuaaguaugugaagucuaccaaacugagacuugcuacagggcugcggaauguucccagcauccagucccgcggacucuuuggcgccauugccggguucaucgagggaggcuggaccgggaugguggacggaugguacggcuaucaucaccagaacgaacaaggcucuggguacgcugcggaucuuaagagcacacagaaugccaucgacaaaauuaccaacaaggucaauuccgugaucgagaaaaugaacacgcaguuuacaguugugggaaaggaguucaaucaccuugaaaagagaauugagaaccugaauaaaaaggucgaugacggcuuccucgauaucuggaccuacaacgcugaacugcuggugcuccuggagaaugaacggacccuugacuaucaugauagcaacgucaaaaaccuguacgagaaggugcgcucucagcucaaaaauaacgccaaggagauugggaauggauguuuugaguucuaucacaagugcgacaacacauguauggaguccguuaaaaauggcaccuacgauuauccuaaguacagcgaagaggccaaacugaacagagaagagaucgacggggugaagcuggagucuacacggaucuaucaaauucuggcuaucuacuccacggucgccagcucccucgugcugguugugucucugggcgcgauuagcuuuuggaugugcuccaauggaucucuccagugccgcaucuguauuuga

SEQ ID NO: 189861 - RNA, 1701 nt, Artificial Sequence; identical to SEQ ID NO: 186491
  derived and/or modified sequence opt5 from hemagglutinin__InfluenzaA__AEH59604

SEQ ID NO: 189862 - RNA, 1701 nt, Artificial Sequence; identical to SEQ ID NO: 186491
  derived and/or modified sequence opt5 from hemagglutinin__InfluenzaA__AEH59614

SEQ ID NO: 189863 - RNA, 1701 nt, Artificial Sequence
  derived and/or modified sequence opt5 from hemagglutinin__InfluenzaA__AEH59624
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucuuucuaccagaacgcugacgccuacguguuugugggcacaagcagauauuccaagaaauucaagccggagauugcuauccggcccaaaguccgcgaucaggaggggagaaugaauuacuauuggacccucguugaaccuggagacaagauuacguuugaggccacaggcaaccugguggugccccgguacgcguucgccauggaacgcaacgcugggagcggaaucauuaucucugauaccccuguccaugacugcaauacaaccugucaaacccccaaaggcgccaucaacacaucccugccguuucagaauauucacccuaucacgauuggcaagugccccaaguaugugaaaagcaccaagcucagacuggcuacagggcuucggaacguuccuucuauccagagccgcggacuguucggcgccauugccggguuuaucgagggaggcuggaccgggaugguggacggaugguacggcuaucaucaccagaaugaacaaggcuccggguacgcugcggaucucaaaucuacacagaacgccaucgacgagauuaccaauaaggucaacagcgugaucgagaaaaugaauacgcaguucacagcuguuggaaaggaguucaaccaccuggagaagagaauugaaaaucuuaacaaaaagguggaugacggcuuucuggauaucuggaccuacaaugccgagcuccugguccugcucgaaaacgagcggacccuggacuaucaugauuccaaugugaaaaaccuuuacgagaagguccgcagccagcugaaaaacaaugccaaggaaauugggaacggauguuucgaguuuuaucacaagugcgacaauacauguauggaaucugugaaaaacggcaccuacgauuaucccaaguacuccgaggaagcuaaacucaauagagaggagaucgacgggguuaagcuggaaagcacacggaucuaucaaauucuugccaucuacucuacgguggcguccagccugguccucgugguuucccugggcgcuauuucuuucuggaugugcagcaacggaucccugcagugccgcaucuguauuuga

SEQ ID NO: 189864 - RNA, 1698 nt, Artificial Sequence
  derived and/or modified sequence opt5 from hemagglutinin__InfluenzaA__AEH77259
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagauguuccccaaggagagcucuuggccuaaccacacggugaccggaguuuccgccagcugcucucauaauggcgaauccagcuuuuaucgcaaccugcuuuggcugacagagaaaaauggccucuaccccaaccugucuaaguccuaugcuaauaacaaagaaaaggaggugcugguccucuggggagugcaccacccuccgagcaucuccgaccagaaaacccuguaccauacagaaaacgccuacgugucugucguuagcucccacuauagcagaaaguucacccccgagaucgcuaagcggccuaaagugcgcgaucaggaggggagaauuaauuacuauuggacgcuucuggaacccggcgacacaaucauuuuugaggccaacgggaaucucaucgcgccucgguacgccuucgcucugucucgcggauuuggcuccgggauuaucaacagcaaugcccccauggauaagugugacgcuaaaugccagaccccgcaaggagccauuaacucuagccuuccuuuccagaaugugcaucccgucacaaucggcgaauguccuaaguaugugagauccgcgaaacugcggaugguuaccggccuccgcaacauccccucuauucagagcagagggcuguuuggagccaucgcuggcuucauugaagggggauggaccggcaugguggaugggugguacggauaucaccaccagaaugagcaaggcuccggcuacgccgcugaccaaaagagcacacagaacgccaucaaugggauuacgaacaaagucaauucugugaucgagaagaugaacacccaguuuacagccguuggaaaggaguucaauaaacuggaacggcgcauggagaaccucaacaagaaaguggaugacggcuucaucgauauuuggaccuacaaugcugaacugcuuguccugcucgagaacgaaagaacacuggacuuucaugacuccaaugugaagaaccuuuaugagaaagucaagaaucagcugaagaacaaugcgaaagagaucgggaacggaugcuucgaauuuuaccacaaguguaaugaugagugcauggaaagcgugaaaaacggcaccuaugacuaccccaaguauucugaggaguccaaacucaaucgggaaaagauugaugggguuaagcuggagagcaugggcguguaccagauccuggccauuuauuccacggucgcuucuagccucguguuccugguuucccuuggagccaucucuuuuuggaugugcagcaacggcucccugcagugucgcaucugcauuuga

SEQ ID NO: 189865 - RNA, 1701 nt, Artificial Sequence; identical to SEQ ID NO: 185680
  derived and/or modified sequence opt5 from hemagglutinin__InfluenzaA__AEH77270

SEQ ID NO: 189866 - RNA, 1701 nt, Artificial Sequence; identical to SEQ ID NO: 183056
  derived and/or modified sequence opt5 from hemagglutinin__InfluenzaA__AEH77279

SEQ ID NO: 189867 - RNA, 1701 nt, Artificial Sequence; identical to SEQ ID NO: 186795
  derived and/or modified sequence opt5 from hemagglutinin__InfluenzaA__AEI29215

SEQ ID NO: 189868 - RNA, 1701 nt, Artificial Sequence; identical to SEQ ID NO: 185693
  derived and/or modified sequence opt5 from hemagglutinin__InfluenzaA__AEI29225

SEQ ID NO: 189869 - RNA, 1701 nt, Artificial Sequence
  derived and/or modified sequence opt5 from hemagglutinin__InfluenzaA__AEI29591
augaagaccaucauugcccugagcuacaucuucugccucguguuugcucaggaccugcccggcaacgauaauuccacagccacgcuuugucuggggcaccaugcggucccuaacggaacccucguuaaaacaauuaccaaugaccaaaucgaggugacaaacgcuaccgaacuggugcagucuagcuccacaggcaagauuugcgauaauccgcacagaauccuugacgggaucaacuguacccugauugaugcccuccugggagacccccauugcgauggcuuccagaaugagaaaugggaccuguuugucgaacggucuaaggccuucagcaacuguuauccuuacgaugugcccgacuaugcuucccuccgcucucugguugccagcuccgggacgcuugaguuuaucaaugaaggauucaacuggaccggcgugacacagaauggcgggagcucugcuugcaaaagaggaccugauaacggcuuuuucucccggcugaauuggcucuacaagagcgggucuaccuaucccguccaaaacgugacaaugccuaauaacgacaacuccgauaagcuguacauuuggggaguucaccauccgagcaccgacaaagagcagacgaaucuuuaugugcaggccucuggcaaggucacaguguccaccaaacgcagccagcaaacagugauccccaacgucggguccagaccuuggguucggggacugucuagccgcguguccauuuacuggaccaucgugaagcccggcgacauucucgucaucaauagcaacggcaaucugaucgcgccuagaggguacuauaaaaugcggaccggaaagucuuccauuaugcgcagcgaugcccccaucggcacauguucuagcgagugcauuacgccgaacggguccaucccuaaugacaagcccuuucagaacgugaauaaaauuaccuacggagcuuguccuaaguauguuaaacagaacacacugaagcucgccaccggcaugagaaaugugcccgaaaaacagacacgggggaucuucggagcuaucgccggcuuuauugagaacggcugggaagggaugaucgauggaugguacggcuuccgccaccaaaauucugaggggaccggacaggcggccgaccuuaagagcacgcaggcugccauugaucaaaucaacggcaaacugaauagagucauugagaagacaaacgaaaaguuucaccagaucgagaaagaguucuccgaaguggaagggcggauccaggaccuggagaaguauguugaggauaccaaaauugaccucuggagcuacaacgcugaacugcuuguggcccuggagaaucagcauaccaucgaucucacagacucugaaaugaacaagcuguucgagaaaacccgcagacaacugcgggaaaaugccgaggauaugggcaacggaugcuuuaagauuuaucacaagugugacaaugcuugcaucggcuccauuagaaacgggacauacgaccaugaugucuaccgcgacgaggcgcucaauaaccgguuccagaucaaaggaguggaacuuaagagcggcuauaaagauuggauucuguggaucucuuuugccaucuccugcuuccugcucugugucgugcugcuuggguuuauuaugugggcuugccagaagggaaauaucagauguaacauuugcaucuga

SEQ ID NO: 189870 - RNA, 1701 nt, Artificial Sequence; identical to SEQ ID NO: 183056
  derived and/or modified sequence opt5 from hemagglutinin__InfluenzaA__AEI54347

SEQ ID NO: 189871 - RNA, 1701 nt, Artificial Sequence; identical to SEQ ID NO: 183142
  derived and/or modified sequence opt5 from hemagglutinin__InfluenzaA__AEI54358

SEQ ID NO: 189872 - RNA, 1701 nt, Artificial Sequence; identical to SEQ ID NO: 183657
  derived and/or modified sequence opt5 from hemagglutinin__InfluenzaA__AEI54369

SEQ ID NO: 189873 - RNA, 1701 nt, Artificial Sequence; identical to SEQ ID NO: 183540
  derived and/or modified sequence opt5 from hemagglutinin__InfluenzaA__AEI54380

SEQ ID NO: 189874 - RNA, 1701 nt, Artificial Sequence; identical to SEQ ID NO: 189803
  derived and/or modified sequence opt5 from hemagglutinin__InfluenzaA__AEI54391

SEQ ID NO: 189875 - RNA, 1701 nt, Artificial Sequence
  derived and/or modified sequence opt5 from hemagglutinin__InfluenzaA__AEI54402
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcuauucuccgcaccagauccuugacggggaaaauuguacccugauugaugcccuccugggagacccccagugcgauggcuuucaaaacaaaaagugggaccuguucgucgagagaagcaaagccuacuccaauuguuauccuuacgaugugcccgacuaugcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguacccugcccuuaaugucaccaugcccaacaacgagaaauucgauaagcuguauauuuggggcgugcaccauccugggacggacaaugaucagaucuuucucuacgcgcaggccucuggacgcauuacaguuuccaccaaaagaagccaacagacagugaucccgaacauuggcucccggccccgcgucagaaauaucccuucucggaucagcauuuacuggaccaucgugaagcccggggacauucugcugaucaacuccaccggaaaucucauugcuccucgcggcuauuucaaaaucagaagcgggaagucuuccaucaugcggagcgaugcccccauuggaaaguguaacucugaaugcaucacaccgaauggcagcauuccuaacgacaaacccuuucagaaugugaaccgcaucacguacggcgcuuguccuagauaugucaagcagaauacccugaaacuugccacagggaugcggaacguucccgagaagcaaacccgcggaauuuucggcgcgaucgccggguuuaucgaaaauggaugggagggcaugguggacgggugguacggauucagacaccagaacuccgagggcauuggccaggcugccgaucugaaaucuacacaagcugccaucgaccagauuaaugggaagcucaaccggcugaucggaaaaaccaacgaaaaguuccaccagauugagaaggaauuuagcgagguggaaggcagaauccaggaucuugagaaauaugucgaggacacgaagauugaucugugguccuacaaugccgaacuccugguggcucuggagaaccaacauacaaucgaccucaccgauagcgaaaugaauaaacuguucgagaagaccaaaaagcagcuucgcgaaaacgcggaggacauggggaauggaugcuuuaagaucuaucacaaaugugauaacgccugcauuggcucuauccggaaugggacauacgaccaugauguuuacagagacgaggcucugaacaaucgcuuccagauuaagggcguggaacucaaauccggauauaaggacuggauccuguggauuagcuuugccaucucuugcuuccuucugugugucgcccuccugggcuuuaucaugugggcuugccagaaagggaacauucgguguaauaucugcauuuga

SEQ ID NO: 189876 - RNA, 1701 nt, Artificial Sequence; identical to SEQ ID NO: 184952
  derived and/or modified sequence opt5 from hemagglutinin__InfluenzaA__AEI54413

SEQ ID NO: 189877 - RNA, 1701 nt, Artificial Sequence; identical to SEQ ID NO: 183305
  derived and/or modified sequence opt5 from hemagglutinin__InfluenzaA__AEI54424

SEQ ID NO: 189878 - RNA, 1701 nt, Artificial Sequence
  derived and/or modified sequence opt5 from hemagglutinin__InfluenzaA__AEI54446
augaagaccaucauugcccugagcuacauccucugccugguguucgcucagaaacuucccgagaacgacaauuccacagccacgcugugucucggccaccaugcggucccuaacgggaccauuguuaagacaaucaccaaugaucaaauugaagugacaaacgcuaccgagcuggugcagucuagcuccacaggagaaaucugcaauucuccgcaccagauccuugacggcgagaacuguacccugauugaugcccuccugggggacccccagugcgauggauuucaaaauaaaaagugggaccuguucgucgaaagaagcaaagcccauuccaacuguuauccuuacgaugugcccgacuaugcuucucuccggagccugguugccuccagcggcacgcuugaguuuaauaacgagucuuucaauuggaccggggugacacagaacggaaccuccagcgcuugcauccgcagaucuaauaacuccuuuuucagccggcugaauuggcucacacaccugaacuuuaaguacccugcccuuaacgucaccaugcccaauaacgaacaguucgauaagcuguauauuuggggcgugcaucacccuggcacggacaaagaucagaucuuucucuacgcgcaagccgcugggcgcauuacaguuucuaccaagagaucccagcaggccgugaucccgaauauuggaagccggccccgcgucagaaacaucccuucccgggugucuaucuauuggacaauugugaaacccggcgacauccugcugauuaauagcaccgggaaccucaucgcuccucgcggauacuucaagauuagauccggcaaaagcucuaucaugcgguccgaugcccccaucgggaaguguaauagcgcgugcauuaccccgaacggaucuaucccuaaugacaagcccuuucagaacgucaaucgcauuacauacggcgccuguccuagauauguuaaacaaaacacgcugaaacuugcuaccggcaugcggaaugugcccgagaagcagacacgcgggaucuucggagccauugcuggcuuuaucgaaaacgggugggagggaaugguggacggcugguacggguucagacaccagaauagcgagggacggggccaagccgccgaucugaaguccacccaggcugcgaucgaccagauuaacggcaaacucaacagacugaucgggaagacaaaugaaaaauuccaucagauugagaaggaauuuucugaggucgaaggacgcauccaagaucuugagaaguauguggaggacaccaaaauugaucuguggagcuacaacgccgaacuccugguugcucuggagaaucagcacacgaucgaccucacagauuccgaaaugaacaagcuguucgagaaaaccaagaaacagcuucgggaaaaugccgaggacaugggcaacgggugcuuuaagauuuaucauaagugugauaaugccugcaucggaagcaucagaaacggcaccuacgaccacgauguguaucgcgacgaggcucugaauaaccgguuccagauuaaaggggucgaacucaagucuggcuacaaagacuggauccuguggauuuccuuugccaucagcugcuuccuucuguguguggcgcuccugggauuuauuaugugggcuugccaaaagggcaauaucagauguaacaucugcauuuga

SEQ ID NO: 189879 - RNA, 1701 nt, Artificial Sequence
  derived and/or modified sequence opt5 from hemagglutinin__InfluenzaA__AEI54457
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccgcuggacgcauuacaguuucuaccaagagaucccagcaggccgugaucccgaauauuggcagccggccccgcgucagaaacaucccuucccgggugucuaucuauuggacaauugugaaacccggggacauccugcugauuaauagcaccggaaaccucaucgcuccucgcggcuacuucaagauuagauccgggaaaagcucuaucaugcgguccgaugcccccaucggaaaguguaauagcgcgugcauuaccccgaacggcucuaucccuaaugacaagcccuuucagaacgucaaucgcauuacauacggcgccuguccuagauauguuaaacaaaacacgcugaaacuugcuaccgggaugcggaaugugcccgaaaaacagacacgcggaaucuucggcgccauugcuggguuuaucgagaacggaugggaaggcaugguggacgggugguacggauucagacaccagaauagcgagggccggggccaagccgccgaucugaaguccacccaggcugcgaucgaccagauuaacgggaaacucaacagacugaucggaaagacaaaugagaaauuccaucagauugaaaaggaguuuucugaagucgagggccgcauccaagaucuugaaaaguauguggaggacaccaaaauugaucuguggagcuacaacgccgagcuccugguugcucuggaaaaucagcacacgaucgaccucacagauuccgagaugaacaagcuguucgaaaagaccaagaaacagcuucgggagaaugccgaagacauggggaacggaugcuuuaagauuuaucauaagugugauaaugccugcaucggcagcaucagaaacgggaccuacgaccacgauguguaucgcgacgaggcucugaauaaccgguuccagauuaaaggcgucgagcucaagucuggauacaaagacuggauccuguggauuuccuuugccaucagcugcuuccuucuguguguggcgcuccugggcuuuauuaugugggcuugccaaaaggggaauaucagauguaacaucugcauuuga

SEQ ID NO: 189880 - RNA, 1701 nt, Artificial Sequence; identical to SEQ ID NO: 188557
  derived and/or modified sequence opt5 from hemagglutinin__InfluenzaA__AEI54468

SEQ ID NO: 189881 - RNA, 1701 nt, Artificial Sequence; identical to SEQ ID NO: 188557
  derived and/or modified sequence opt5 from hemagglutinin__InfluenzaA__AEI54479

SEQ ID NO: 189882 - RNA, 1701 nt, Artificial Sequence; identical to SEQ ID NO: 189879
  derived and/or modified sequence opt5 from hemagglutinin__InfluenzaA__AEI54490

SEQ ID NO: 189883 - RNA, 1701 nt, Artificial Sequence; identical to SEQ ID NO: 189878
  derived and/or modified sequence opt5 from hemagglutinin__InfluenzaA__AEI54501

SEQ ID NO: 189884 - RNA, 1701 nt, Artificial Sequence
  derived and/or modified sequence opt5 from hemagglutinin__InfluenzaA__AEI59979
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgagaucugcgacuccccgcaccagauucuugauggggaaaauuguacccugaucgacgcccuccugggagauccccagugcgacggcuuucaaaacaaaaagugggaucuguucgucgagagaucuaaagccuauagcaauuguuacccuuaugacgugcccgauuacgcuucccuccggucucugguugccagcuccgggacgcuugaauuuaacaaugagagcuucaacuggaccggagugacacagaauggcaccucuuccgcuugcauucgcagaagcaacaauuccuuuuucucucggcugaacuggcucacacaucugaaguuuaaguauccugcccuuaaugucaccaugcccaacaacgagcaguucgacaaacuguacaucuggggcgugcaccauccugggacggauaaugaccagauuuuucucuaugcgcaagccagcggacgcaucacaguuucuaccaagagaucccagcagacagugauuccgaacaucggcagccggccccgcgucagaaauaucccuucccggauuucuaucuacuggaccauugugaaacccggggauauccugcugauuaacagcaccggaaaucucaucgcuccucgcggcuacuucaagaucagauccgggaaaagcucuauuaugcgguccgacgcccccaucggaaaguguaacagcgaaugcauuacaccgaauggcucuaucccuaacgacaagcccuuucagaaugugaaccgcauuacguauggcgcuuguccuagauacgucaaacaaaauacccugaaacuugccacagggaugcggaacguucccgagaaacagacccgcggaaucuucggcgcgaucgccggguuuauugaaaauggaugggagggcaugguggaugggugguauggauucagacaccagaacagcgagggccggggccaagcugccgaccugaaguccacacaggcugccaucgaucagauuaaugggaaacucaacagacugaucgaaaagaccaacgagaaauuccaccagauugaaaaggaguuuucugaaguggagggacgcauccaagaccuugagaaguacgucgaagauacgaaaauugaccuguggagcuauaaugccgagcuccugguggcucuggaaaaccagcauacaaucgaucucaccgacuccgagaugaauaagcuguucgaaaagaccaagaaacagcuucgggagaacgcggaggauaugggcaaugggugcuuuaagaucuaccacaagugugacaacgccugcauuggaagcaucagaaauggcacauaugaucaugacguuuaccgcgacgaagcucugaacaaucgguuccagauuaaagggguggagcucaagucuggcuacaaagauuggauccuguggauuuccuuugccaucagcugcuuccuucugugugucgcccuccugggauuuaucaugugggcuugccaaaagggcaacauuagauguaauaucugcauuuga

SEQ ID NO: 189885 - RNA, 1698 nt, Artificial Sequence; identical to SEQ ID NO: 188981
  derived and/or modified sequence opt5 from hemagglutinin__InfluenzaA__AEI59990

SEQ ID NO: 189886 - RNA, 1698 nt, Artificial Sequence; identical to SEQ ID NO: 188983
  derived and/or modified sequence opt5 from hemagglutinin__InfluenzaA__AEI60001

SEQ ID NO: 189887 - RNA, 1701 nt, Artificial Sequence
  derived and/or modified sequence opt5 from hemagglutinin__InfluenzaA__AEI60012
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcaucagaucuuccaacaauagcuuuuucucucgccugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccuccggacggauuacaguuagcaccaagcgcucccagcagacagugaucccgaacauuggcucuagaccccggguccgcaauaucccuagcagaaucuccauuuacuggaccaucgugaaacccggggauauucugcugaucaacagcaccggaaaucucauugcuccucggggcuacuucaagauccgcucugggaaauccagcaucaugagaucugacgcccccauuggaaaguguaacagcgaaugcaucacaccgaauggcuccauuccuaacgacaagcccuuucagaaugugaaccggaucacguauggcgcuuguccucgcuacgucaaacaaaauacccugaagcuggccacagggaugagaaacguucccgagaaacagacccggggaauuuucggcgcgaucgccggguuuaucgaaaauggaugggagggcaugguggaugggugguauggauuccgccaccagaacucugagggcagaggccaagcugccgaccuuaagagcacacaggcugccauugaucagaucaaugggaaacucaaccggcugauuggaaagaccaacgaaaaauuccaccagaucgagaaggaauuuuccgagguggaaggcaagauucaagaccuugagaaauacgucgaggauacgaagaucgaccuguggagcuauaaugccgaacuccugguggcucuggagaaccagcauacaauugaucucaccgacucugaaaugaauaaacuguucgagaagaccaaaaagcagcuuagagaaaacgcggaggauauggggaauggaugcuuuaagaucuaccacaaaugugacaacgccugcaucggcuccauucgcaaugggacauauaaccaugauguuuaccgggacgaggcucugaauaacagauuccagaucaagggcguggaacucaaaagcggauacaaggacuggauucuguggaucucuuuugccauuuccugcuuccuucugugugucgcccuccugggcuuuaucaugugggcuugccaaaaagggaauauccgcuguaacauuugcaucuga

SEQ ID NO: 189888 - RNA, 1701 nt, Artificial Sequence; identical to SEQ ID NO: 185458
  derived and/or modified sequence opt5 from hemagglutinin__InfluenzaA__AEI60023

SEQ ID NO: 189889 - RNA, 1701 nt, Artificial Sequence
  derived and/or modified sequence opt5 from hemagglutinin__InfluenzaA__AEI60034
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauccgcagaucuaacaauuccuuuuucagccggcugaacuggcucacacaucugaaguuuaaauauccugcccuuaaugucaccaugcccaacaacgagcaguucgacaagcuguacauuuggggcgugcaccauccugggacggauaaagaccagaucuuucucuaugcgcaagccucuggacgcauuacaguuuccaccaagagaagccagcagacagugaucccgaauauuggcucccggccccgcgucagaaacaucccuucucggaucagcauuuacuggaccaucgugaaacccggggauauucugcugaucaauuccaccggaaaccucauugcuccucgcggcuacuucaagaucagaagcgggaagucuuccaucaugcggagcgacgcccccauuggaaaauguaauucugagugcaucacaccgaacggcagcauuccuaaugacaagcccuuucagaacgugaaucgcaucacguauggcgcuuguccuagauacgucaaacaaaacacccugaaacuugccacagggaugcggaauguucccgaaaaacagacccgcggaauuuucggcgcgaucgccggguuuaucgagaacggaugggaaggcaugguggaugggugguauggauucagacaccaaaauuccgagggccggggccaggcugccgaccugaagucuacacaggcugccauugaucagaucaacgggaaacucaauagacugauuggaaagaccaacgagaaguuccaccagaucgaaaaagaguuuagcgaaguggagggccgcauucaagaccuugaaaaguacgucgaggauacgaaaaucgaccugugguccuauaacgccgagcuccugguggcucuggaaaaucagcauacaauugaucucaccgacagcgagaugaacaagcuguucgaaaagaccaagaagcagcuucgggagaaugcggaagauauggggaacggaugcuuuaaaaucuaccacaagugugacaaugccugcaucggcucuauuagaaacgggacauaugaucaugacguuuaccgcgacgaggcucugaauaaccgguuccagaucaaaggcguggagcucaaguccggauacaaagauuggauucuguggaucagcuuugccauuucuugcuuccuucugugugucgcccuccugggcuuuaucaugugggcuugccaaaaggggaauaucagauguaacauuugcaucuga

SEQ ID NO: 189890 - RNA, 1701 nt, Artificial Sequence
  derived and/or modified sequence opt5 from hemagglutinin__InfluenzaA__AEI60045
augaagaccaucauugcccugagcuacauccucugccugguguucgcucagaaacuucccggcaacgacaauuccacagccacgcugugucucgggcaccaugcggucccuaacggaaccauuguuaagacaaucaugaaugaucaaauugaggugaccaacgcuacagaacuggugcagucuagcuccaccggcgagaucugcgacucuccgcaccagauccuugaugggaaaaauuguacacugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacccuugaguuuaacaaugaaucuuucaacuggacgggagugacccagaauggcacauccagcgcuugcauccgcagaucuaagaacuccuuuuucagccggcugaauuggcucacccaucugaacuuuaaauauccugcccuuaaugucacaaugcccaacaacgagcaguucgacaagcuguacauuuggggcgugcaccauccugggaccgauaaagaccagaucuuucucuaugcgcaagccucuggacgcauuacgguuuccacaaagagaagccagcagaccgcuaucccgaauauuggcuaccggccccgcgugagaaacaucccuucccggaucucuauuuacuggacaaucgucaaacccggggauauucugcugaucaauagcaccggaaaccucauugccccucgcggcuauuucaagaucagauccggaaagagcucuaucaugcgguccgacgcucccauugggaaauguaauagcgagugcaucaccccgaacggcucuauuccuaaugacaagcccuuucagaacgugaaucgcaucacauacggcgccuguccuagauaugugaaacaaaacacgcugaaacuugcgaccgggaugcggaauguccccgaaaaacagacacgcggaauuuucggcgccaucgcuggguuuaucgagaacggaugggaaggcaugguugaugggugguacggauucagacaccagaauagcgagggccggggccaagccgcugaccugaaguccacccaggccgccauugaucagaucaacgggaaacucaauagacugauuggaaagacaaacgagaaguuccaccagaucgaaaaagaguuuucugaaguggagggccgcauucaagaccuugaaaaguauguggaggauaccaaaaucgaccuguggagcuacaacgcugagcuccuggucgcgcuggaaaaucagcauacgauugaucucacagacuccgagaugaacaagcuguucgaaaagaccaagaagcagcuucgggagaaugccgaagauauggggaacggaugcuuuaaaaucuaucacaagugugacaaugcuugcaucggcagcauuagaaacgggaccuacgaucaugacguguaccgcgacgaggcccugaauaaccgguuccagaucaaaggcguugagcucaagucuggauauaaagauuggauucuguggaucuccuuugccauuagcugcuuccuucuguguguggcucuccugggcuuuaucaugugggccugccaaaaggggaauaucagauguaacauuugcaucuga

SEQ ID NO: 189891 - RNA, 1701 nt, Artificial Sequence
  derived and/or modified sequence opt5 from hemagglutinin__InfluenzaA__AEI60086
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccacagccgaccaacagucucucuaccagaaugcugaugccuacguguucgugggcaccagcagauauuccaagaaauuuaagccugagauugcuauccggccgaaaguccgcgaccaggaggggagaaugaacuacuauuggacgcugguugaacccggagauaagauuacauucgaggccaccggcaaccugguggugccucgguacgcguuugccauggaacgcaaugcugggagcggaaucauuaucucugacacacccguccaugauugcaacaccaccugucaaacaccuaaaggcgccaucaauacgucccuccccuuccagaacauucacccgaucaccauuggcaagugcccuaaguaugugaaaagcacaaagcugagacuugcuaccgggcugcggaauguucccucuauccagagccgcggacucuuuggcgccauugccggguucaucgagggaggcuggacagggaugguggacggaugguacggcuaucaucaccagaacgaacaaggcuccggguacgcugcggaccugaaaucuacccagaaugccaucgauaagauuacgaacaaagucaauagcgugaucgagaagaugaacacacaguuuaccgcuguuggaaaggaguucaaucaccuugagaaaagaauugagaaccugaauaagaaaguggacgauggcuuccucgacaucuggaccuacaacgccgaacugcugguccuccuggagaaugaacggacacuugauuaucaugacuccaacgugaagaaccuguacgagaaaguccgcaaucagcucaagaacaaugccaaggagauugggaacggauguuuugaguucuaucacaaaugcgauaauaccuguauggaaagcgugaagaacggcacauacgacuauccuaaauacucugaagaggcuaagcugaauagagaagagaucgaugggguuaaacuugaguccacgcggaucuaucaaauucuggccaucuacagcaccguggcgucuucccucguccuggugguuagccugggcgcuauuuccuuuuggaugugcucuaacggaagccuccagugccgcaucuguauuuga

SEQ ID NO: 189892 - RNA, 1701 nt, Artificial Sequence
  derived and/or modified sequence opt5 from hemagglutinin__InfluenzaA__AEI60109
augaagaccacaaucgcccugagcuacauucucugccugguguucgcucagaaacuucccggcaacgacaauuccacggccacccugugucucgggcaccaugcggucccuaacggaacacugguuaagaccaucacaaaugaucaaauugaggugaccaacgcuacagaacuugugcaaaauucuagcaccggcagaaucugcgacuccccgcaccagauucuggauggggagaacuguacgcucaucgacgcccugcugggagauccccauugcgacggcuuucagaauaaagaaugggaucucuucgucgagcggucuaaggccuauagcaacuguuacccuuauaaugugcccgacuacguuucccugcgcucucuuguggcuagcuccgggacccuggaauuuaacaaugagagcuucaacuggacaggagucgcccaggaugggucuuccuaugcuugcaaaagacggagcaauaaguccuuuuucucucgccucaacuggcugcaccagcuuaauuacaaguauccugcccugaacgugaccaugcccaacaaugagaacuuugacaaacucuacaucuggggcguucaucacccuggcacagauagcgaccagauuucucuguacgcgcaggccuccggaagagugaccgucagcacgaagcggucccaacagacagugaucccgaauauuggcuaucgccccugggugagaggggucucuagcaucauuuccaucuacuggaccauuguuaaaccuggagauauccugcucaucaacagcacaggcaaucugauugcuccccggggguauuucaagauccgcucuggaaaauccagcauuaugagaucugacgccccuaucggcaaguguaacagcgaaugcauuacccccaauggcuccaucccgaacgacaagccuuuucagaaugugaaccggaucaccuacgggcccuguccucgcuaugugaaacagaauacacuuaagcuggcuacgggaaugagaaacguccccgagaaacaaacccggggcauuuucggggccaucgcgggauuuauugaaaauggcugggaggggaugaaggauggaugguacggcuuccgccaccagaacucugagggcacagggcaggccgcugacaucaaaagcacccaagccgcuauuaaucagaucaacggaaagcucaacagacugaucgagaaaacaaaugaaaaguuucaucagauugaaaaggaguucuccgaaguggagggccggauccaggaucuugagaaauauguugaagacaccaagauugaucuguggagcuacaacgccgagcuccugguggcccuggaaaaucaacacacgaucgaccucacagauucugagaugaacaaacuguucgaaagaaccaagaaacagcuucgcgagaaugcugaggacauggggaacggaugcuuuaagauuuaccauaagugugauaauaccugcaucggcuccauucggaacgggacauaugaccacgaugucuacagagacgaagcgcugaauaaccgcuuccacaucaaaggcguggagcucaagagcggauauaaagacuggauccuguggauuucuuuugccaccuccugcuuccuucuguguaucguucuccugggcuuuauuaugugggcuugccagaaggggaauauccgguguaacauuugcaucuga

SEQ ID NO: 189893 - RNA, 1701 nt, Artificial Sequence
  derived and/or modified sequence opt5 from hemagglutinin__InfluenzaA__AEI86734
augaaggccauccuggugguccuccuguacaccuucgcuacagccaacgcggacacgcuuugcguuggcuaucacgcuaauaacagcaccgauacaguggacaccgugcuggagaaaaaugucacagugacccauuccguuaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauugucgagaccuccaacucugacaauggcacgugcuauccgggggauuuuaucgacuacgaagaacugcgggagcagcuuagcuccgugagcucuuucgaacgcuuugagauuuuccccaagaccuccagcuggccuaaccacgauucuaauaagggaguuacagccgcuuguccccaugccggcgcgaaauccuuuuauagaaaccugaucuggcucgugaagaaaggcaauagcuacccuaagcugucuaaauccuauaucaacgacaaggggaaggaaguccuugugcuguggggcauucaccaccccagcaccuccgccgaucaacagucucucuaccagaaugcugacacauacguguucgucggaaccagccgguauuccaaaaaguuuaaaccugagaucgccauucgcccgaagguuagagaucaggaggggcggaugaacuacuauuggacgcugguggaacccggagacaaaaucacauucgaggcuaccggcaaccugguggucccucgcuacgccuuugcgauggaaagaaaugccgggagcggaauuaucauuucugauacacccgugcaugacugcaacaccaccugucaaacaccuaagggcgcuaucaauacgucccuccccuuccagaacauccacccgauuaccaucggcaaaugcccuaaguauguuaagagcacaaaacugcggcuugccaccgggcugcgcaaugugcccucuauucagagcagaggacucuuuggcgcuaucgccggguucauugagggaggcuggacagggauggucgacggaugguacggcuaucaucaccagaacgaacaaggcuccggguacgccgcugaucugaagucuacccagaaugcgaucgacgagaucacgaacaaagugaauagcguuauugagaagaugaacacacaguuuaccgccgugggaaaagaguucaaucaccuugagaagcggaucgaaaaccugaauaagaaagucgaugacggcuuccucgauauuuggaccuacaacgcugagcugcuggugcuccuggaaaaugagcgcacacuugacuaucaugauuccaacgucaagaaccuguacgagaaagugagaagccagcucaagaauaacgccaaagaaaucgggaauggauguuuugaguucuaucacaagugcgacaacaccuguauggaaucuguuaagaauggcacauacgauuauccuaaauacuccgaggaagccaagcugaaccgggaggagauugacggggugaaacuugaaagcacgcgcaucuaucaaauccuggcuauuuacucuaccgucgccuccagccucgugcugguugugucccugggcgcgaucucuuuuuggaugugcagcaauggaucccuccagugcagaauuuguaucuga

SEQ ID NO: 189894 - RNA, 1701 nt, Artificial Sequence
  derived and/or modified sequence opt5 from hemagglutinin__InfluenzaA__AEI86764
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccugaucacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaucugguggugccucgguacgcguuugccauggaacgcaacgcugggucuggaaucauuaucuccgacacccccguccaugacugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggauggaugguacggcuaucaucaccagaacgaacaaggcucuggguacgcugcggaccugaaaagcacacagaaugccaucgauaagauuaccaacaaagucaauuccgugaucgagaagaugaacacgcaguuuacagcuguuggaaaggaguucaaucaccuugaaaagagaauugagaaccugaauaagaaaguggacgauggcuuccucgacaucuggaccuacaacgccgaacugcugguccuccuggagaaugaacggacccuugauuaucaugacagcaacgugaagaaucuguacgagaaaguccgcucucagcucaagaacaacgccaaggagauugggaauggauguuuugaguucuaucacaaaugcgauaacacauguauggaguccgugaagaauggcaccuacgacuauccuaaauacagcgaagaggcuaagcugaacagagagaaaaucgaugggguuaaacuugaaucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 189895 - RNA, 1701 nt, Artificial Sequence; identical to SEQ ID NO: 189894
  derived and/or modified sequence opt5 from hemagglutinin__InfluenzaA__AEI86774

SEQ ID NO: 189896 - RNA, 1701 nt, Artificial Sequence
  derived and/or modified sequence opt5 from hemagglutinin__InfluenzaA__AEI86784
augaaggugauccuggucguucuccuguacaccuucgccacagcuaacgccgacacgcuuugcauuggcuaucacgcgaauaacagcaccgauacaguggacaccgugcuggagaaaaaugucacagugacccauuccguuaaccuccuggaagauaagcacaaugggaaacuuuguaagcugagaggaguggcuccccuccaucugggcaaaugcaacaucgccggguggauucugggaaauccugagugugaaucucucagcacagccuccucuuggagcuacaucgucgagaccuccucuagcgacaacggcacgugcuauccgggggauuuuauugacuacgaggaacugcgggagcagcuuuccagcgugucuuccuucaagcgcuuugaaaucuuccccaagaccagcucuuggccuaaucacgauuccaacaaaggaguuacagcugccuguccccaugcuggcgccaagagcuuuuauaaaaaucugaucuggcucgugaagaaaggcaacucuuacccuaagcuguccaagagcuauauuaaugacaaagggaaggagguccuugugcuguggggaauccaccaccccuccaccucugcggaucaacagagccucuaccagaacgccgacgcuuacguguucgucggcacauccagauauagcaaaaaguuuaaaccugaaauugccauccggccgaagguucgcgaucaggaggggagaaugaauuacuauuggacccugguggagcccggagacaaaauuacguucgaagcuacaggcaaccugguggucccucgguacgccuuugcgauggagcgcaacgccgggucuggaaucauuaucuccgauacccccgugcaugacugcaauacaaccugucaaaccccuaagggcgcuaucaacacaagccuccccuuccagaauauucacccgaucacgauuggcaagugcccuaaauauguuaagucuaccaaacugagacuugccacagggcugcggaacgugcccagcauccagucccgcggacucuuuggcgcuauugccggguucaucgaaggaggcuggaccgggauggucgacggaugguacggcuaucaucaccagaaugagcaaggcucuggguacgccgcugaucuuaagagcacacagaacgcgaucgacaaaauuaccaauaaggugaacuccguuaucgaaaagaugaauacgcaguuuacagccgugggaaaagaguucaaccaccuugagaagagaauugaaaaucugaacaaaaaggucgaugacggcuuccucgauaucuggaccuacaaugcugagcugcuggugcuccuggaaaacgagcggacccuugacuaucaugauagcaaugucaaaaaccuguacgaaaaggugcgcucucagcucaagaacaaugccaaagagauugggaacggauguuuugaguucuaucacaagugcgacaauacauguauggaauccguuaaaaacggcaccuacgauuauccuaaguacagcgaggaagccaaacugaauagagaggaaaucgacggggugaagcuggagucuacacggaucuaucaaauucuggcuaucuacuccacggucgccagcucccucgugcugguugugucucugggcgcgauuagcuuuuggaugugcuccaacggaucucuccagugccgcaucuguauuuga

SEQ ID NO: 189897 - RNA, 1701 nt, Artificial Sequence
  derived and/or modified sequence opt5 from hemagglutinin__InfluenzaA__AEI86794
augaagaccauccuggugguccuccuguacacauucgccacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcaauuuuauugauuacgaagaacugcgggagcagcuuuccagcgucucuuccuucgaacgcuuugagaucuuccccaagacaagcucuuggccugaccacgauuccaacaagggagugaccgcugccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccaaguauagcaaaaaguuuaaaccugagauugccaucagaccgaagguccgggaucaggaggggcgcaugaauuacuauuggacgcugguugaacccggagacaaaauuacauucgaggcuaccggcaaccugguggccccuagauacgcguuugccauggaacggaacgcugggucuggaaucauuaucuccgauacacccgugcaugacugcaauaccaccugucaaacaccuaagggcgccaucaacacgagccuccccuuccagaauauucacccgaucaccauuggcaagugcccuaaauaugucaagucuacaaaacugcgccuugcuaccgggcugagaaacgugcccagcauccagucccggggacucuuuggcgccauugccggguucaucgagggaggcuggacagggaugguugacggaugguacggcuaucaucaccagaaugaacaaggcucuggguacgcugcggaucuuaagagcacccagaacgccaucgacaaaauuacgaauaaggugaacuccgucaucgagaagaugaauacacaguuuaccgcugugggaaaagaguucaaccaccuggaaaagcgcauugagaaucugaacaaaaagguugaugacggcuuccucgauaucuggaccuacaaugccgaacugcuggugcuccuggagaacgaaagaacacuugacuaucaugauagcaaugucaaaaaccuguacgagaaggugcggucucagcucaagaacaaugccaaagagauugggaacggauguuuugaguucuaucacaagugcgacaauaccuguauggaguccgucaaaaacggcacauacgauuauccuaaguacagcgaagaggcuaaacugaaucgcgaagagaucgacggggugaaacuugagucuacgagaaucuaucaaauucuggccaucuacuccaccguugcgagcucccucgugcuggucgugucucugggcgcuauuagcuuuuggaugugcuccaacggaucucuccagugccggaucuguauuuga

SEQ ID NO: 189898 - RNA, 1701 nt, Artificial Sequence
  derived and/or modified sequence opt5 from hemagglutinin__InfluenzaA__AEI86804
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccugaccacgauuccaacaagggagugacagccgcuuguccccaugccggcgcgaaaucuuuuuauaagaaucugauguggcucguuaaaaagggcaacagcuacccuaaacuguccaagagcuauaucaaugacaaggggaaagaagugcuuguccuguggggcauucaccaccccuccaccucugccgaucaacagagccucuaccagaacgcugacgccuacguguucgugggaacauccagauauagcaagaaauuuaagccugagaucgcuauucggccgaaaguccgcgaucaggaggggagaaugaauuacuauuggacccugguugaacccggagacaagaucacguucgaggccacaggcaaccugguggugccucgguacgcguuugccauggaacgcaacgcugggucuggaauuaucauuuccgauacccccguccaugacugcaauacaaccugucaaaccccuaaaggcgccaucaacacaagccuccccuuccagaauauccacccgauuacgaucggcaagugcccuaaguaugugaaaucuaccaagcugagacuugcuacagggcugcggaacguucccagcauucagucccgcggacucuuuggcgccaucgccggguucauugagggaggcuggaccgggaugguggacggaugguacggcuaucaucaccagaaugaacaaggcucuggguacgcugcggaucugaaaagcacacagaacgccaucgacaagaucaccaauaaagucaacuccgugauugagaagaugaauacgcaguuuacagcuguuggaaaggaguucaaccaccuugagaaaagaaucgagaaucugaacaagaaaguggaugacggcuuccucgauauuuggaccuacaaugccgaacugcugguccuccuggagaacgaacggacccuugacuaucaugauagcaaugugaagaaccuguacgagaaaguccgcucucagcucaagaacaaugccaaggagaucgggaacggauguuuugaguucuaucacaaaugcgacaauacauguauggaauccgugaagaacggcaccuacgauuauccuaaauacagcgaagaggcuaagcugaauagagaagagauugacgggguuaaacuugagucuacacggaucuaucaaauccuggccauuuacuccgcgguggcuagcucccucguccuggugguuucucugggcgccaucagcuuuuggaugugcuccaacggaucucuccagugccgcauuuguaucuga

SEQ ID NO: 189899 - RNA, 1701 nt, Artificial Sequence; identical to SEQ ID NO: 189894
  derived and/or modified sequence opt5 from hemagglutinin__InfluenzaA__AEI86814

SEQ ID NO: 189900 - RNA, 1701 nt, Artificial Sequence
  derived and/or modified sequence opt5 from hemagglutinin__InfluenzaA__AEI86824
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccugaucacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaucugguggugccucgguacgcguuugccauggaacgcaacgcugggucuggaaucauuaucuccgacacccccguccaugacugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggauggaugguacggcuaucaucaccagaacgaacaaggcucuggguacgcugcggaccugaaaagcacacaggaugccaucgacaagauuaccaauaaagucaacuccgugaucgagaagaugaauacgcaguuuacagcuguuggaaaggaguucaaccaccuugaaaagagaauugagaaucugaacaagaaaguggaugacggcuuccucgauaucuggaccuacaaugccgaacugcugguccuccuggagaacgaacggacccuugacuaucaugauagcaaugugaagaaccuguacgagaaaguccgcucucagcucaagaauaacgccaaggagauugggaacggauguuuugaguucuaucacaaaugcgacaauacauguauggaguccgugaagaacggcaccuacgauuauccuaaauacagcgaagaggcuaagcugaauagagagaaaaucgacgggguuaaacuugaaucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 189901 - RNA, 1701 nt, Artificial Sequence
  derived and/or modified sequence opt5 from hemagglutinin__InfluenzaA__AEI86834
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccggggaauuuuauugauuacgaagaacugcgggagcagcuuuccagcgucucuuccuucgaacgcuuugagaucuuccccaagaccagcucuuggccugaccacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagccggaaguuuaaaccugagauugcuauccgcccgaaggucagagaucaggaggggcggaugaauuacuauuggacccugguugaacccggagacaaaauuacguucgaggccacaggcaaccugguggcgccucgcuacgccuuugcuauggaaagaaacgccgggucuggaaucauuaucuccgauacccccgugcaugacugcaauacaaccugucaaaccccuaagggcgcuaucaacacaagccuccccuuccagaauauucacccgaucacgauuggcaaaugcccuaaguaugucaagucuaccaaacugcggcuugccacagggcugcgcaacgugcccagcauccaguccagaggacucuuuggcgccauugcuggguucaucgagggaggcuggaccgggaugguugacggaugguacggcuaucaucaccagaaugaacaaggcucuggguacgcggccgaucuuaagagcacacagaacgcuaucgacaaaauuaccaauaaggugaacuccgucaucgagaaaaugaauacgcaguuuacagccgugggaaaggaguucaaccaccuugaaaagcggauugagaaucugaacaaaaagguugaugacggcuuccucgauaucuggaccuacaaugccgaacugcuggugcuccuggagaacgaacgcacccuugacuaucaugauagcaaugucaaaaaccuguacgagaaggugagaucucagcucaaaaacaaugcuaaggagauugggaacggauguuuugaguucuaucacaagugcgacaauacauguauggaguccgucaaaaacggcaccuacgauuauccuaaguacagcgaagaggccaaacugaaucgggaagagaucgacggggugaagcuggagucuacacgcaucuaucaaauucuggcgaucuacuccacgguugcuagcucccucgugcuggucgugucucugggcgccauuagcuuuuggaugugcuccaacggaucucuccagugcagaaucuguauuuga

SEQ ID NO: 189902 - RNA, 1701 nt, Artificial Sequence; identical to SEQ ID NO: 188608
  derived and/or modified sequence opt5 from hemagglutinin__InfluenzaA__AEI86854

SEQ ID NO: 189903 - RNA, 1701 nt, Artificial Sequence
  derived and/or modified sequence opt5 from hemagglutinin__InfluenzaA__AEI86864
augaaggccauccugguggcucuccuguacaccuucgccacagcgaacgcugacacgcuuugcauuggcuaucacgccaauaacagcaccgauacagucgacaccguucuggagaaaaaugugacagugacccauuccgucaaccuccuggaagauaagcacaaugggaaacuuuguaagcugagaggaguggcuccccuccaucugggcaaaugcaacaucgccggguggauucugggaaauccugagugugaaucucucagcacagccuccucuuggagcuacaucguugagaccuccucuagcgacaacggcacgugcuauccgggggauuuuauuaauuacgaagaacugcgggagcagcuuuccagcgugucuuccuucgaacgcuuugagaucuuccccaagaccagcucuuggccuaaccacgacuccaauaagggagucacagcugccuguccccaugcgggcgccaagagcuuuuauaaaaaccugaucuggcucgugaaaaagggcaauucuuacccuaaacuguccaagagcuauauuaacgauaaggggaaagaaguucuugugcuguggggaauccaccaccccuccaccacagcugaccaacagucucucuaccagaaugccgaugcuuacgucuucgugggcaccagcagauauuccaagaaauuuaagccugagauugccauccggccgaaagugcgcgaccaggaggggagaaugaacuacuauuggacgcuggucgaacccggagauaagauuacauucgaggcgaccggcaaccugguugugccucgguacgccuuugcuauggaacgcaaugccgggagcggaaucauuaucucugacacacccgugcaugauugcaacaccaccugucaaacaccuaaaggcgcuaucaauacgucccuccccuuccagaacauucacccgaucaccauuggcaagugcccuaaguaugucaaaagcacaaagcugagacuugccaccgggcugcggaaugugcccucuauccagagccgcggacucuuuggcgccauugcuggguucaucgagggaggcuggacagggaugguugacggaugguacggcuaucaucaccagaacgaacaaggcuccggguacgcggccgaccugaaaucuacccagaaugcuaucgauaagauuacgaacaaagugaauagcgucaucgagaagaugaacacacaguuuaccgccgugggaaaggaguucaaucaccuugagaaaagaauugagaaccugaauaagaaaguugacgauggcuuccucgacaucuggaccuacaacgccgaacugcuggugcuccuggagaaugaacggacacuugauuaucaugacuccaacgucaagaaccuguacgagaaagugcgcaaucagcucaagaacaaugcuaaggagauugggaacggauguuuugaguucuaucacaaaugcgauaauaccuguauggaaagcgucaagaacggcacauacgacuauccuaaauacucugaagaggccaagcugaauagagaagagaucgauggggugaaacuugaguccacgcggaucuaucaaauucuggcgaucuacagcaccguugcuucuucccucgugcuggucgugagccugggcgccauuuccuuuuggaugugcucuaacggaagccuccagugccgcaucuguauuuga

SEQ ID NO: 189904 - RNA, 1701 nt, Artificial Sequence; identical to SEQ ID NO: 189894
  derived and/or modified sequence opt5 from hemagglutinin__InfluenzaA__AEI86874

SEQ ID NO: 189905 - RNA, 1701 nt, Artificial Sequence
  derived and/or modified sequence opt5 from hemagglutinin__InfluenzaA__AEI86894
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccggggaauuuuauugauuacgaagaacugcgggagcagcuuuccagcgucucuuccuucgaacgcuuugagaucuuccccaagaccagcucuuggccugaccacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggcgccucgguacgccuuugcuauggaacgcaacgccgggucuggaaucauuaucuccgauacccccgugcaugacugcaauacaaccugucaaaccccuaaaggcgcuaucaacacaagccuccccuuccagaauauucacccgaucacgauuggcaagugcccuaaguaugucaaaucuaccaagcugagacuugccacagggcugcggaacgugcccagcauccagucccgcggacucuuuggcgccauugcuggguucaucgagggaggcuggaccgggaugguugacggaugguacggcuaucaucaccagaaugaacaaggcucuggguacgcggccgaucugaaaagcacacagaacgcuaucgacaagauuaccaauaaagugaacuccgucaucgagaagaugaauacgcaguuuacagccgugggaaaggaguucaaccaccuugagaaaagaauugagaaucugaacaagaaaguugaugacggcuuccucgauaucuggaccuacaaugccgaacugcuggugcuccuggagaacgaacggacccuugacuaucaugauagcaaugucaagaaccuguacgagaaagugcgcucucagcucaagaacaaugcuaaggagauugggaacggauguuuugaguucuaucacaaaugcgacaauacauguauggaauccgucaagaacggcaccuacgauuauccuaaauacagcgaagaggccaagcugaauagagaagagaucgacggggugaaacuugagucuacacggaucuaucaaauucuggcgaucuacuccacgguugcuagcucccucgugcuggucgugucucugggcgccauuagcuuuuggaugugcuccaacggaucucuccagugccgcaucuguauuuga

SEQ ID NO: 189906 - RNA, 1701 nt, Artificial Sequence
  derived and/or modified sequence opt5 from hemagglutinin__InfluenzaA__AEI86904
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaaaaaucugaucuggcucguuaaaaagggcaacucuuacccuaaacuguccaagagcuauauuaaugacaaggggaaagaagugcuuguccuguggggaauccaccaccccuccacaaccgcggaucaacagucucucuaccagaacgccgacgcuuacguguucgugggcacgagcagauauuccaagaaauuuaagccugagauugccauccggccgaaaguccgcgaucaggaggggagaaugaauuacuauuggacacugguugaacccggagacaagauuaccuucgaggcuacaggcaaccugguggugccucgguacgccuuugcgauggaacgcaacgccgggagcggaaucauuaucucugauacccccguccaugacugcaauaccacaugucaaacgccuaaaggcgcuaucaacaccucccuccccuuccagaauauucacccgaucacaauuggcaagugcccuaaguaugugaaaagcaccaagcugagacuugccacagggcugcggaacguucccucuauccagagccgcggacucuuuggcgcuauugccggguucaucgagggaggcuggaccgggaugguggacggaugguacggcuaucaucaccagaaugaacaaggcuccggguacgccgcugaucugaaaucuacgcagaacgcgaucgacaagauuacaaauaaagucaacagcgugaucgagaagaugaauacccaguuuaccgccguuggaaaggaguucaaccaccuugagaaaagaauugagaaucugaacaagaaaguggaugacggcuuccucgauaucuggacauacaaugcugaacugcugguccuccuggagaacgaacggacccuugacuaucaugauuccaaugugaagaaccuguacgagaaaguccgcaaccagcucaagaauaacgccaaggagauugggaauggauguuuugaguucuaucacaaaugcgacaacacauguauggaaagcgugaagaauggcacguacgauuauccuaaauacucugaagaggccaagcugaacagagaagagaucgacgggguuaaacuugaguccacccggaucuaucaaauucuggcuaucuacagcacaguggccucuucccucguccuggugguuagccugggcgcgauuuccuuuuggaugugcucuaauggaagccuccagugccgcaucuguauuuga

SEQ ID NO: 189907 - RNA, 1701 nt, Artificial Sequence
  derived and/or modified sequence opt5 from hemagglutinin__InfluenzaA__AEI86914
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuagacuguccaaaagcuauauuaacgauaaggggaaggaagugcuuguccuguggggaauccaccaccccuccaccacagccgaccaacagucucucuaccagaaugcugaugccuacguguucgugggcaccagccgguauuccaaaaaguuuaaaccugagauugcuauccgcccgaaggucagagaccaggaggggcggaugaacuacuauuggacgcugguugaacccggagauaaaauuacauucgaggccaccggcaaccugguggugccucgcuacgcguuugccauggaaagaaaugcugggagcggaaucauuaucucugacacacccguccaugauugcaacaccaccugucaaacaccuaagggcgccaucaauacgucccuccccuuccagaacauucacccgaucaccauuggcaaaugcccuaaguauguuaagagcacaaaacugcggcuugcuaccgggcugcgcaaugugcccucuauccagagcagaggacucuuuggcgccauugccggguucaucgagggaggcuggacagggaugguggacggaugguacggcuaucaucaccagaacgaacaaggcuccggguacgcugcggaccugaagucuacccagaaugccaucgauaaaauuacgaacaaggucaauagcgugaucgagaaaaugaacacacaguuuaccgcuguuggaaaggaguucaaucaccuugaaaagcggauugagaaccugaauaaaaagguggacgauggcuuccucgacaucuggaccuacaacgccgaacugcugguccuccuggagaaugaacgcacacuugauuaucaugacuccaacgugaaaaaccuguacgagaaggucagaaaucagcucaaaaacaaugccaaggagauugggaacggauguuuugaguucuaucacaagugcgauaauaccuguauggagagcgugaaaaacggcacauacgacuauccuaaguacucugaagaggcuaaacugaaucgggaagagaucgaugggguuaaacuugaguccacgcgcaucuaucaaauucuggccaucuacagcaccguggcgucuucccucguccuggugguuagccugggcgcuauuuccuuuuggaugugcucuaacggaagccuccagugcagaaucuguauuuga

SEQ ID NO: 189908 - RNA, 1701 nt, Artificial Sequence
  derived and/or modified sequence opt5 from hemagglutinin__InfluenzaA__AEI86924
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggucuuuauugauuacgaagaacugcgggagcagcuuuccagcgugucuuccuucgaacgcuuugagaucuuccccaagaccagcucuuggccuaaucacgacuccaacaagggaguuacagccgcuuguccccaugccggcgcgaaaucuuuuuauaagaaucugaucuggcucauuaaaaagggcaacagcuacccuaaacuguccaagagcuauaucaaugauaaggggaaagaagugcuuguccuguggggcauucaccaccccuccaccacagccgaccaacagucucucuaccagaacgcugaugccuacguguucgugggaaccagcagauauuccaagaaauuuaagccugagaucgcuguccggccgaaaguucgcgaccaggaggggagaaugaauuacuauuggacgcugguggaacccggagauaagauuacauucgaggccaccggcaaccugguggucccucgguacgcguuugccauggaacgcaacgcugggagcggaaucauuaucucugacacacccgugcaugauugcaauaccaccugucaaacaccuaaaggcgccaucaacacgucccuccccuuccagaauauucacccgaucaccauuggcaagugcccuaaguauguuaaaagcacaaagcugagacuugcuaccgggcugcggaacgugcccucuauccagagccgcggacucuuuggcgccauugccggguucaucgagggaggcuggacagggauggucgacggaugguacggcuaucaucaccagaaugaacaaggcuccggguacgcugcggaccugaaaucuacccagaacgccaucgauaagauuacgaauaaagugaacagcguuaucgagaagaugaauacacaguuuaccgcugugggaaaggaguucaaccaccuugagaaaagaauugagaaucugaacaagaaagucgacgauggcuuccucgacaucuggaccuacaaugccgaacugcuggugcuccuggagaacgaacggacacuugauuaucaugacuccaaugucaagaaccuguacgagaaagugcgcaaccagcucaagaauaacgccaaggagauugggaauggauguuuugaguucuaucacaaaugcgauaacaccuguauggaaagcguuaagaauggcacauacgacuauccuaaauacucugaagaggcuaagcugaacagagaagagaucgauggggugaaacuugaguccacgcggaucuaucaaauucuggccaucuacagcaccgucgcgucuucccucgugcugguugugagccugggcgcuauuuccuuuuggaugugcucuaauggaagccuccagugccgcaucuguauuuga

SEQ ID NO: 189909 - RNA, 1701 nt, Artificial Sequence; identical to SEQ ID NO: 189894
  derived and/or modified sequence opt5 from hemagglutinin__InfluenzaA__AEI86934

SEQ ID NO: 189910 - RNA, 1701 nt, Artificial Sequence; identical to SEQ ID NO: 188608
  derived and/or modified sequence opt5 from hemagglutinin__InfluenzaA__AEI86944

SEQ ID NO: 189911 - RNA, 1701 nt, Artificial Sequence
  derived and/or modified sequence opt5 from hemagglutinin__InfluenzaA__AEI86964
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggucuuuauugauuacgaagaacugcgggagcagcuuuccagcgugucuuccuucgaacgcuuugagaucuuccccaagaccagcucuuggccuaaucacgacuccaacaagggaguuacagccgcuuguccccaugccggcgcgaaaucuuuuuauaagaaucugaucuggcucgugaaaaagggcaacagcuacccuaaacuguccaagagcuauauuaaugauaaggggaaagaaguccuugugcuguggggaauccaccaccccuccaccacagccgaccaacagucucucuaccagaacgcugaugccuacguguucgucggcaccagcagauauuccaagaaauuuaagccugagauugcuguucggccgaaagugcgcgaccaggaggggagaaugaauuacuauuggacgcugguggaacccggagauaagaucacauucgaggccaccggcaaccuggucgugccucgguacgcguuugccauggaacgcaacgcugggagcggaauuaucauuucugacacacccguucaugauugcaauaccaccugucaaacaccuaaaggcgccaucaacacgucccuccccuuccagaauauccacccgauuaccaucggcaagugcccuaaguaugugaaaagcacaaagcugagacuugcuaccgggcugcggaacguccccucuauucagagccgcggacucuuuggcgccaucgccggguucauugagggaggcuggacagggaugguggacggaugguacggcuaucaucaccagaaugaacaaggcuccggguacgcugcggaccugaaaucuacccagaacgccaucgauaagaucacgaauaaaguuaacagcgugauugagaagaugaauacacaguuuaccgcugucggaaaggaguucaaccaccuugagaaaagaaucgagaaucugaacaagaaaguggacgauggcuuccucgacauuuggaccuacaaugccgaacugcugguccuccuggagaacgaacggacacuugauuaucaugacuccaaugugaagaaccuguacgagaaaguucgcaaccagcucaagaauaacgccaaggagaucgggaauggauguuuugaguucuaucacaaaugcgauaacauguguauggaaagcgugaagaauggcaccuacgacuauccuaaauacucugaagaggcuaagcugaacagagaagagauugauggggucaaacuugaguccacacggaucuaucaaauccuggccauuuacagcacgguggcgucuucccucguucugguggucagccugggcgcuaucuccuuuuggaugugcucuaauggaagccuccagugccgcauuuguaucuga

SEQ ID NO: 189912 - RNA, 1701 nt, Artificial Sequence; identical to SEQ ID NO: 188850
  derived and/or modified sequence opt5 from hemagglutinin__InfluenzaA__AEI86974

SEQ ID NO: 189913 - RNA, 1701 nt, Artificial Sequence; identical to SEQ ID NO: 188608
  derived and/or modified sequence opt5 from hemagglutinin__InfluenzaA__AEI86984

SEQ ID NO: 189914 - RNA, 1701 nt, Artificial Sequence; identical to SEQ ID NO: 188608
  derived and/or modified sequence opt5 from hemagglutinin__InfluenzaA__AEI86994

SEQ ID NO: 189915 - RNA, 1701 nt, Artificial Sequence
  derived and/or modified sequence opt5 from hemagglutinin__InfluenzaA__AEI87004
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugaaaggaguugcgccccuccaucugggcaagugcaacaucgccggguggauucugggaaauccugagugugaaucucucagcacagcuuccucuuggagcuacaucguggagaccuccucuagcgacaacggcacgugcuauccggggaauuuuauugauuacgaagaacugagagagcagcuuuccagcgucucuuccuucgaacgguuugagaucuuccccaagaccagcucuuggccugaccacgauuccaacaaaggagugacagccgcuuguccccaugccggcgccaagagcuuuuauaaaaaucugaucuggcucguuaagaaaggcaacucuuacccuaagcuguccaagagcuauauuaaugacaaagggaaggaagugcuuguccuguggggaauccaccaccccuccaccucugccgaucaacagggccucuaccagaacgcugacgccuacguguucguggggacaagccgcuauuccaaaaaguuuaaaccugagauugcuaucagaccgaagguccgggaucaggagggacgcaugaauuacuauuggacccugguugaacccggcgacaaaauuacguucgaggccacagggaaccugguggcgccuagauacgccuuugcuauggaacggaacgccggaagcggcaucauuaucucugauacccccgugcaugacugcaauacaaccugucaaaccccuaagggcgcuaucaacacaucccuccccuuccagaauauucacccgaucacgauugggaagugcccuaaauaugucaagagcaccaaacugcgccuugccacaggacugagaaacgugcccucuauccagagccggggccucuuuggggccauugcuggauucaucgagggcggguggaccggaaugguugacggcugguacggcuaucaucaccagaaugaacaaggguccggauacgcggccgaucugaagucuacacagaacgcuaucgacaaaauuaccaauaaggugaacagcgucaucgagaagaugaauacgcaguuuacagccgugggcaaagaguucaaccaccuugaaaagcgcauugagaaucugaacaaaaagguugaugacggguuccucgauaucuggaccuacaaugccgaacugcuggugcuccuggagaacgaaagaacccuugacuaucaugauuccaaugucaaaaaccuguacgagaaggugcggagccagcucaagaacaaugcuaaagagauuggaaacggcuguuuugaguucuaucacaagugcgacaauacauguauggagucugucaaaaacgggaccuacgauuauccuaaguacuccgaagaggccaaacugaaucgcgaagagaucgacggcgugaaacuugagagcacaagaaucuaucaaauucuggcgaucuacucuacgguugcuuccagccucgugcuggucgugucccugggagccauuucuuuuuggaugugcagcaacggcucccuccagugccggaucuguauuuga

SEQ ID NO: 189916 - RNA, 1701 nt, Artificial Sequence
  derived and/or modified sequence opt5 from hemagglutinin__InfluenzaA__AEI87014
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacaagauuaccaauaaagucaacuccgugaucgagaagaugaauacgcaguuuacagcuguuggaaaggaguucaaccaccuugagaaaagaauugagaaucugaacaagaaaguggaugacggcuuccucgauaucuggaccuacaaugccgaacugcugguccuccuggagaacgaacggacccuugacuaucaugauagcaaugugaagaaccuguacgagaaaguccgcucucagcucaagaacaaugccaaggagauugggaacggauguuuugaguucuaucacaaaugcgacaauacauguauggaauccgugaagaacggcaccuacgauuauccuaaauacagcggggaagcuaagcugaauagagaggaaaucgacggcguuaaacuugagucuacacggaucuaucaaauucuggccaucuacuccacgguggcgagcucccucguccuggugguuucucugggagcuauuagcuuuuggaugugcuccaacggcucucuccagugccgcaucuguauuuga

SEQ ID NO: 189917 - RNA, 1701 nt, Artificial Sequence
  derived and/or modified sequence opt5 from hemagglutinin__InfluenzaA__AEI87034
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccugaucacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaucugguggugccucgguacgcguuugccauggaacgcaacgcugggucuggaaucauuaucuccgacacccccguccaugacugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggauggaugguacggcuaucaucaccagaacgaacaaggcucuggguacgcugcggaccugaaaagcacacagaaugccaucgauaagauuaccaacaaagucaauuccgugaucgagaagaugaacacgcaguuuacagcuauuggaaaggaguucaaucaccuugagaaaagaaucgagaaccugaauaagaaaguugacgauggcuuccucgacauuuggaccuacaacgccgaacugcuggugcuccuggagaaugaacggacccuugauuaucaugacagcaacgucaagaaucuguacgagaaagugcgcucucagcucaagaacaacgccaaggagaucgggaauggauguuuugaguucuaucacaaaugcgauaacacauguauggaauccgucaagaauggcaccuacgacuauccuaaauacagcgaagaggcuaagcugaacagagaagagaucgauggggugaaacuugagucuacacggauuuaucaaauccuggccauuuacuccacgguugcgagcucccucgugcuggucgugucucugggcgcuaucagcuuuuggaugugcuccaauggaucucuccagugccgcauuuguaucuga

SEQ ID NO: 189918 - RNA, 1701 nt, Artificial Sequence; identical to SEQ ID NO: 188608
  derived and/or modified sequence opt5 from hemagglutinin__InfluenzaA__AEI87044

SEQ ID NO: 189919 - RNA, 1701 nt, Artificial Sequence; identical to SEQ ID NO: 186857
  derived and/or modified sequence opt5 from hemagglutinin__InfluenzaA__AEI87054

SEQ ID NO: 189920 - RNA, 1701 nt, Artificial Sequence
  derived and/or modified sequence opt5 from hemagglutinin__InfluenzaA__AEI87064
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccacagccgaucaacagucucucuaccagaacgcugacaccuacguguucgugggcacgagcagauauuccaagaaauuuaagccugagauugccauccggccgaaaguccgcgaucaggaggggagaaugaauuacuauuggacacugguugaacccggagacaagauuaccuucgaggcuacaggcaaccugguggugccucgguacgccuuugcgauggaacgcaacgccgggagcggaaucauuaucucugauacccccguccaugacugcaauaccacaugucaaacgccuaaaggcgcuaucaacaccucccuccccuuccagaauauucacccgaucacaauuggcaagugcccuaaguaugugaaaagcaccaagcugagacuugccacagggcugcggaacguucccucuauccagagccgcggacucuuuggcgcuauugccggguucaucgagggaggcuggaccgggaugguggacggaugguacggcuaucaucaccagaaugaacaaggcuccggguacgccgcugaucugaaaucuacgcagaacgcgaucgacaagauuacaaauaaagucaacagcgugaucgagaagaugaauacccaguuuaccgccguuggaaaggaguucaaccaccuugagaaaagaauugagaaucugaacaagaaaguggaugacggcuuccucgauaucuggacauacaaugcugaacugcugguccuccuggagaacgaacggacccuugacuaucaugauuccaaugugaagaaccuguacgagaaaguccgcaaccagcucaagaauaacgccaaggagauugggaauggauguuuugaguucuaucacaaaugcgacaacacauguauggaaagcgugaagaauggcacguacgauuauccuaaauacucugaagaggccaagcugaacagagaagagaucgacgggguuaaacuugaguccacccggaucuaucaaauucuggcuaucuacagcacagccgcgucuucccucgugcuggucgugagccugggcgcuauuuccuuuuggaugugcucuaauggaagccuccagugccgcaucuguauuuga

SEQ ID NO: 189921 - RNA, 1701 nt, Artificial Sequence
  derived and/or modified sequence opt5 from hemagglutinin__InfluenzaA__AEI87074
augaaggccacccuggugguccuccuguacacauucgcuacggccaacgcggacacccuuugcaucggcuaucacgcuaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacguccucuagcgacaacggaaccugcuauccgggggauuuuaucaauuacgaagaacugcgggagcagcuuuccagcgucucuuccuucgaacgcuuugagauuuuccccaagacaagcucuuggccuaaccacgacuccaauaagggagugaccgccgcuuguccccaugccggcgcgaaaucuuuuuauaagaaccugaucuggcucguuaaaaagggcaauagcuacccuaaacuguccaagagcuauaucaacgauaaggggaaagaagugcuuguccuguggggcauucaccaccccuccacaaccgccgaccaacagucucucuaccagaaugcugaugccuacguguucgugggcacgagcagauauuccaagaaauuuaagccugagaucgcuauucggccgaaaguccgcgaccaggaggggagaaugaacuacuauuggacacugguugaacccggagauaagaucaccuucgaggccacaggcaaccugguggugccucgguacgcguuugccauggaacgcaaugcugggagcggaauuaucauuucugacacccccguccaugauugcaacaccacaugucaaacgccuaaaggcgccaucaauaccucccuccccuuccagaacauccacccgauuacaaucggcaagugcccuaaguaugugaaaagcaccaagcugagacuugcuacagggcugcggaauguucccucuauucagagccgcggacucuuuggcgccaucgccggguucauugagggaggcuggaccgggaugguggacggaugguacggcuaucaucaccagaacgaacaaggcuccggguacgcugcggaccugaaaucuacgcagaaugccaucgauaagaucacaaacaaagucaauagcgugauugagaagaugaacacccaguuuaccgcuguuggaaaggaguucaaucaccuugagaaaagaaucgagaaccugaauaagaaaguggacgauggcuuccucgacauuuggacauacaacgccgaacugcugguccuccuggagaaugaacggacccuugauuaucaugacuccaacgugaagaaccuguacgagaaaguccgcaaucagcucaagaacaaugccaaggagaucgggaacggauguuuugaguucuaucacaaaugcgauaauacauguauggaaagcgugaagaacggcacguacgacuauccuaaauacucugaagaggcuaagcugaauagagaagagauugaugggguuaaacuugaguccacccggaucuaucaaauccuggccauuuacagcacaguggcgucuucccucguccuggugguuagccugggcgcuaucuccuuuuggaugugcucuaacggaagccuccagugccgcauuuguaucuga

SEQ ID NO: 189922 - RNA, 1701 nt, Artificial Sequence
  derived and/or modified sequence opt5 from hemagglutinin__InfluenzaA__AEI87094
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccugaucacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaucugguggugccucgguacgcguuugccauggaacgcaacaccgggucuggaaucauuaucuccgacacacccguccaugacugcaacaccaccugucaaacaccuaaaggcgcuaucaauacgagccuccccuuccagaacauucacccgaucaccauuggcaagugcccuaaguaugugaaaucuacaaagcugagacuugccaccgggcugcggaauguucccagcauccagucccgcggacucuuuggcgcuauugccggguucaucgagggaggcuggacagggaugguggauggaugguacggcuaucaucaccagaacgaacaaggcucuggguacgccgcugaccugaaaagcacccagaaugcgaucgauaagauuacgaacaaagucaauuccgugaucgagaagaugaacacacaguuuaccgccguuggaaaggaguucaaucaccuugaaaagagaauugagaaccugaauaagaaaguggacgauggcuuccucgacaucuggaccuacaacgcugaacugcugguccuccuggagaaugaacggacacuugauuaucaugacagcaacgugaagaaucuguacgagaaaguccgcucucagcucaagaacaacgccaaggagauugggaauggauguuuugaguucuaucacaaaugcgauaacaccuguauggaguccgugaagaauggcacauacgacuauccuaaauacagcgaagaggccaagcugaacagagagaaaaucgaugggaucaaacuugaaucuacgcggauuuaucaaauccuggcuauuuacuccaccguugccagcucccucgugcuggucgugucucugggcgcgaucagcuuuuggaugugcuccaauggaucucuccagugccgcauuuguaucuga

SEQ ID NO: 189923 - RNA, 1701 nt, Artificial Sequence; identical to SEQ ID NO: 189922
  derived and/or modified sequence opt5 from hemagglutinin__InfluenzaA__AEI87104

SEQ ID NO: 189924 - RNA, 1698 nt, Artificial Sequence; identical to SEQ ID NO: 186650
  derived and/or modified sequence opt5 from hemagglutinin__InfluenzaA__AEI91963

SEQ ID NO: 189925 - RNA, 1701 nt, Artificial Sequence; identical to SEQ ID NO: 186857
  derived and/or modified sequence opt5 from hemagglutinin__InfluenzaA__AEI91977

SEQ ID NO: 189926 - RNA, 1701 nt, Artificial Sequence; identical to SEQ ID NO: 188381
  derived and/or modified sequence opt5 from hemagglutinin__InfluenzaA__AEI91978

SEQ ID NO: 189927 - RNA, 1701 nt, Artificial Sequence; identical to SEQ ID NO: 187323
  derived and/or modified sequence opt5 from hemagglutinin__InfluenzaA__AEI91998

SEQ ID NO: 189928 - RNA, 1701 nt, Artificial Sequence
  derived and/or modified sequence opt5 from hemagglutinin__InfluenzaA__AEI91999
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagccuauuccaacuguuacccuuaugaugugcccgacuacgcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaucugaacuuuaaguauccugcccuuaacgucaccaugcccaauaacgagcaguucgauaagcuguacauuuggggcgugcaccauccugggacggacaaagaucagaucuuucucuaugcgcaagccucuggacgcauuacaguuuccaccaagagaagccagcaggcugugaucccgaauauuggcucccggccccgcgucagaaacaucccuucucggaucagcauuuacuggacaaucgugaaacccggggacauucugcugaucaauuccaccggaaaccucauugccccucgcggcuacuucaagaucagaagcgggaaaucuuccaucaugcggagcgaugcucccauuggaaaguguaauucugaaugcaucaccccgaacggcagcauucugaaugacaagccuuuucagaacgugaaucgcaucacauauggcgccugucccagauacgucaaacaaaacacgcuuaagcuggcgaccgggaugcggaauguuccugagaaacagacacgcggaauuuucggcgccaucgcuggguuuaucgaaaacggaugggagggcaugguggacgggugguauggauucagacaccaaaauuccgagggccggggccaggccgcugaucucaagucuacccaggccgccauugaccagaucaacgggaaacugaacagacuuauuggaaagacaaaugaaaaauuccaccagaucgagaaggaauuuagcgagguggaaggccgcauucaagaucuggagaaguacgucgaggacaccaaaaucgaucucugguccuauaacgcugaacugcugguggcgcucgagaaucagcauacgauugaccugacagauagcgaaaugaacaaacuuuucgagaagaccaagaaacagcugcgggaaaaugccgaggacauggggaacggaugcuuuaagaucuaccacaagugugauaaugcuugcaucggcucuauuagaaacgggaccuaugaccaugauguuuaccgcgacgaggcccucaauaaccgguuccagaucaaaggcguggaacugaaguccggauacaaagacuggauucuuuggaucagcuuugccauuucuugcuuccugcucugugucgcucugcugggcuuuaucaugugggccugccaaaaggggaauaucagauguaacauuugcaucuga

SEQ ID NO: 189929 - RNA, 1698 nt, Artificial Sequence
  derived and/or modified sequence opt5 from hemagglutinin__InfluenzaA__AEI92018
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucgccgaccagaaaacccuguaccauacagagaaugcuuacgugagcgucguuuccucucacuauagcagaaaguucacccccgaaauugccaagcggccuaaagugcgcgaucaggagggcagaaucaacuacuauuggacgcuucuggagcccggggacacaauuaucuuugaagcgaauggaaaccucauugccccucgguacgcuuucgcccugucccgcggcuuugggagcggaaucauuaauucuaacgcucccauggauaagugugacgccaaaugccagaccccgcaaggcgcgaucaauuccagccuuccuuuccagaacgugcaucccgucacaaucggcgaguguccuaaguaugugagaucugccaaacugcggaugguuaccgggcuccgcaauauucccagcauccaguccagaggacuguuuggcgcuauugccggguucaucgaaggaggcuggaccgggaugguggauggaugguacggcuaucaccaccagaacgagcaaggcucuggguacgcugccgaccaaaagagcacacagaaugccauuaacggaaucacgaauaaagucaacuccgugaucgaaaagaugaauacccaguuuacagcuguuggcaaggaguucaacaaacuggagcggcgcauggaaaaccucaauaagaaaguggaugacggguucauugauaucuggaccuacaacgcggagcugcuuguccugcucgaaaaugagagaacacuggacuuucaugacagcaacgugaagaaucuuuaugaaaaagucaagucucagcugaagaacaaugccaaagagauuggaaacggcugcuucgaguuuuaccacaaguguaaugaugaaugcauggaguccgugaaaaacgggaccuaugacuaccccaaguauagcgaagagucuaaacucaaucgggagaagaucgauggcguuaagcuggaauccaugggaguguaccagauucuggcuaucuauagcacggucgccuccucucucgugcugcuuguuagccugggcgccaucuccuucuggaugugcucuaacgggagccuccagugucgcauuugcaucuga

SEQ ID NO: 189930 - RNA, 1701 nt, Artificial Sequence; identical to SEQ ID NO: 189905
  derived and/or modified sequence opt5 from hemagglutinin__InfluenzaA__AEJ10400

SEQ ID NO: 189931 - RNA, 1701 nt, Artificial Sequence
  derived and/or modified sequence opt5 from hemagglutinin__InfluenzaA__AEJ10410
augaagaccauccuggugguccuccuguacacauucgccacggcuaacgccgacacccuuugcauuggcuaucacgcgaauaacagcacagauaccaucgacacaguucuggagaaaaaugugaccgugacacauuccgucaaccuccuggaagauaagcacaaugggaaacuuuguaagcugagaggaguggcuccccuccaucugggcaaaugcaacauugccggguggauccugggaaauccugagugugaaucucucagcaccgccuccucuuggagcuacauuguugagacguccucuagcgacaacggaaccugcuauccggggaauuuuaucgauuacgaagaacugcgggagcagcuuuccagcgugucuuccuucgaacgcuuugagaucuuccccaagacaagcucuugguccgaccacgauagcaacaagggagucaccgcugccuguccucaugcuggcgccaaaucuuuuuauaagaaucugauuuggcucgugaaaaagggcaacuccuaccccaaacugagcaaguccuauaucaaugacaaggggaaagaaguucuugugcuguggggcauucaccacccuucuacaagcgcggaucaacagucccucuaccagaacgccgacgcuuacgucuucgugggcaccagcagauauucuaagaaauuuaagcccgagaucgccauucggccuaaagugcgcgaucaggaggggagaaugaauuacuauuggacgcuggucgaaccgggagacaagaucacauucgaggcuaccggcaaccugguugcccccagauacgcguuugccauggaacgcaacgcuggguccggaauuaucaucagcgauacaccugugcaugacugcaauaccaccugucaaacacccaaaggcgccauuaacacgucucucccuuuccagaauauccaccccauuaccaucggcaagugcccgaaguaugugaaaagcacaaagcugagacuugcuaccgggcugcggaacgucccuuccauucagucucgcggacucuuuggcgccaucgccggguucaucgagggaggcuggacagggaugguggacggaugguacggcuaucaucaccagaaugaacaaggcagcggguacgcugcggaucugaaauccacccagaacgccauugacaagaucacgaauaaaguuaacagcgugauugagaagaugaauacacaguuuaccgcugucggaaaggaguucaaccaccuugaaaaacggaucgagaaucugaacaagaaaguggaugacggcuuccucgauauuuggaccuacaaugccgaacugcugguucuccuggagaacgaacggacacuugacuaucaugauucuaaugugaagaaccuguacgagaaaguccgcucccagcucaagaacaaugccaaggagaucgggaacggauguuuugaguucuaucacaaaugcgacaauaccuguauggagagcgugaagaacggcacauacgauuaucccaaauacucugaagaggcuaagcugaauagagaagagaucgacggggucaaacuugaguccacgcggauuuaucaaauccuggccauuuacagcaccguggcguccucucucguucugguggucagccugggcgcuaucuccuuuuggaugugcucuaacggaagccuccagugccgcauuuguaucuga

SEQ ID NO: 189932 - RNA, 1701 nt, Artificial Sequence
  derived and/or modified sequence opt5 from hemagglutinin__InfluenzaA__AEJ10420
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauagacacaaugggaagcuguguaaacugcggggaguugcgccccuccaucugggcaagugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgcgagcagcuuuccagcgucucuuccuucgaaagauuugagaucuuccccaaaaccagcucuuggccugaucacgacuccaauaagggagugacagccgcuuguccccaugccggcgccaagagcuuuuauaaaaaccugaucuggcucguuaagaaaggcaauucuuacccuaagcuguccaaaagcuauauuaacgauaaggggaaggaagugcuuguccuguggggaauccaccaccccuccaccucugccgaccaacagagccucuaccagaaugcugaugccuacguguucgugggcacaucccgguauagcaaaaaguuuaaaccugagauugcuauccgcccgaaggucagagaccaggaggggcggaugaacuacuauuggacccugguugaacccggagauaaaauuacguucgaggccacaggcaaucugguggugccucgcuacgcguuugccauggaaagaaacgcugggucuggaaucauuaucuccgacacccccguccaugacugcaacacaaccugucaaaccccuaagggcgccaucaauacaagccuccccuuccagaacauucacccgaucacgauuggcaaaugcccuaaguaugugaagucuaccaaacugcggcuugcuacagggcugcgcaauguucccagcauccaguccagaggacucuuuggcgccauugccggguucaucgagggaggcuggaccgggaugguggauggaugguacggcuaucaucaccagaacgaacaaggcucuggguacgcugcggaccuuaagagcacacagaaugccaucgauaaaauuaccaacaaggucaauuccgugaucgagaaaaugaacacgcaguuuacagcuguuggaaaggaguucaaucaccuugaaaagcggauugagaaccugaauaaaaagguggacgauggcuuccucgacaucuggaccuacaacgccgaacugcugguccuccuggagaaugaacgcacccuugauuaucaugacagcaacgugaaaaaucuguacgagaaggucagaucucagcucaaaaacaacgccaaggagauugggaauggauguuuugaguucuaucacaagugcgauaacacauguauggaguccgugaaaaauggcaccuacgacuauccuaaguacagcgaagaggcuaaacugaaccgggaagagaucgaugggguuaaacuugagucuacacgcaucuaucaaauucuggccaucuacuccacgguggcgagcucccucguccuggugguuucucugggcgcuauuagcuuuuggaugugcuccaauggaucucuccagugcagaaucuguauuuga

SEQ ID NO: 189933 - RNA, 1701 nt, Artificial Sequence
  derived and/or modified sequence opt5 from hemagglutinin__InfluenzaA__AEJ10430
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacaaccgccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaucccccuacauccgcggaucaacagucucucuaccagaacgccgacgcuuacguguucgugggcaccagcagauauuccaagaaauuuaagccggagauugccauccggcccaaaguccgcgaucaggaggggagaaugaauuacuauuggacgcugguugaaccuggagacaagauuacauucgaggcuaccggcaaccugguggugccccgguacgccuuugcgauggaacgcaacgccgggagcggaaucauuaucucugauacaccuguccacgacugcaauaccaccugucaaacacccaaaggcgcuaucaacacgucccucccguuccagaauauucacccuaucaccauuggcaagugccccaaguaugugaaaagcacaaagcugagacuugccaccgggcugcggaacguuccuucuauccagagccgcggacucuuuggcgcuauugccggguucaucgagggaggcuggacagggaugguggacggaugguacggcuaucaucaccagaaugaacaaggcuccggguacgccgcugaucugaaaucuacccagaacgcgaucgacgagauuacgaauaaggucaacagcgugaucgagaaaaugaauacacaguuuaccgccguuggaaaggaguucaaccaccuugagaagagaauugaaaaucugaacaaaaagguggaugacggcuuccucgauaucuggaccuacaaugcugagcugcugguccuccuggaaaacgagcggacacuugacuaucaugauuccaaugugaaaaaccuguacgagaagguccgcagccagcucaaaaacaaugccaaggaaauugggaacggauguuuugaguucuaucacaagugcgacaauaccuguauggaaucugugaaaaacggcacauacgauuaucccaaguacuccgaggaagccaaacugaauagagaggagaucgacgggguuaaacuugaaagcacgcggaucuaucaaauucuggcuaucuacucuaccguggccuccagccucguccuggugguuucccugggcgcgauuucuuuuuggaugugcagcaacggaucccuccagugccgcaucuguauuuga

SEQ ID NO: 189934 - RNA, 1701 nt, Artificial Sequence
  derived and/or modified sequence opt5 from hemagglutinin__InfluenzaA__AEJ10440
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccacagccgaucaacagauucucuaccagaacgcugacaccuacguguucgugggcacgucuagauauagcaagaaauuuaagccugagaucgccauucggccgaaaguccgcgaucaggaggggagaaugaauuacuauuggacacugguugaacccggagacaagaucaccuucgaggcuacaggcaaccugguggugccucgguacgccuuugcgauggaacgcaacgccggguccggaauuaucaucagcgauacccccguccaugacugcaauaccacaugucaaacgccuaaaggcgcuauuaacaccucucuccccuuccagaauauccacccgauuacaaucggcaagugcccuaaguaugugaaauccaccaagcugagacuugccacagggcugcggaacguucccagcauucagucucgcggacucuuuggcgcuaucgccggguucaucgagggaggcuggaccgggaugguggacggaugguacggcuaucaucaccagaaugaacaaggcagcggguacgccgcugaucugaaauccacgcagaacgcgauugacaagaucacaaauaaagucaacucugugauugagaagaugaauacccaguuuaccgccguuggaaaggaguucaaccaccuugagaaaagaaucgagaaucugaacaagaaaguggaugacggcuuccucgauauuuggacauacaaugcugaacugcugguccuccuggagaacgaacggacccuugacuaucaugauagcaaugugaagaaccuguacgagaaaguccgcaaccagcucaagaauaacgccaaggagaucgggaauggauguuuugaguucuaucacaaaugcgacaacacauguauggaauccgugaagaauggcacguacgauuauccuaaauacagcgaagaggccaagcugaacagagaagagaucgacgggguuaaacuugagucuacccggauuuaucaaauccuggcuauuuacuccacaguggccagcucucucguccuggugguuucccugggcgcgaucagcuuuuggaugugcuccaauggaucucuccagugccgcauuuguaucuga

SEQ ID NO: 189935 - RNA, 1701 nt, Artificial Sequence; identical to SEQ ID NO: 189848
  derived and/or modified sequence opt5 from hemagglutinin__InfluenzaA__AEJ10450

SEQ ID NO: 189936 - RNA, 1701 nt, Artificial Sequence
  derived and/or modified sequence opt5 from hemagglutinin__InfluenzaA__AEJ10480
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaggaacugcgggagcagcuuuccagcgucucuuccuucgaacgcuuugagaucuuccccaagaccagcucuuggccuaaccacgacuccaauaagggagugacagccgcuuguccccaagccggcgcgaaaucuuuuuauaagaaccugaucuggcucguuaaaaagggcaauagcuacccuaaacuguccaagagcuauauuaacgauaaggggaaagaagugcuuguccuguggggaauccaucaccccuccaccucugccgaccagcagagccucuaccaguccgcugaugccuacguguucgugggcacaagcaaguauucuaaaaaguuuaaaccugagauugcugucagaccgaagguucgggaccaagaggggcgcaugaauuacuauuggacccugguggaacccggagauaaaaucacguucgaggccacaggcaaccugcucgugccuagauacgcguuugccauggaacggaacgcuggguccggaauuaucauuagcgacacccccguccacgauugcaauacaaccugucagaccccuaagggcgccaucaacacaucucugcccuuccagaauauccauccgauuacgaucggcaagugcccuaaauauguuaagagcaccaaacuucgccuggcuacagggcucagaaacgugcccuccauucagucucggggacuguuuggcgccaucgccggguucauugagggaggcuggaccgggaugguggacggaugguacggcuaucaccaucaaaaugcucagggcagcggguacgcggccgaccuuaaguccacacagaacgcuaucgauaaaaucaccaauaaggucaacagcgugauugaaaagaugaauacgcaguuuacagccguuggaaaagaguucaaccaccuggagaagcgcaucgaaaaucucaacaaaaagguggacgauggcuuccuggacauuuggaccuacaaugccgagcugcucguccugcuugaaaacgagagaacccuggauuaucacgacucuaaugugaaaaaccucuacgaaaagguccggucccaacugaagaacaaugcuaaagagaucgggaacggauguuuugaguucuaucauaagugcgauaauacauguauggaaagcgugaaaaacggcaccuacgacuauccuaaguacucugaggaagccaaacuuaaucgcgaggaaauugaugggguuaagcuggaguccacaagaaucuaucagauccucgcgauuuacagcacgguggcuuccucucugguccuggugguuagccucggcgccaucuccuuuuggaugugcucuaacggaagccugcagugccggauuuguaucuga

SEQ ID NO: 189937 - RNA, 1701 nt, Artificial Sequence
  derived and/or modified sequence opt5 from hemagglutinin__InfluenzaA__AEJ10490
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacaaccgccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaucccccuacauccgcggaucaacagucucucuaccagaacgccgacgcuuacguguucgugggcaccagcagauauuccaagaaauuuaagccggagauugccauccggcccaaaguccgcgaucaggaggggagaaugaauuacuauuggacgcugguugaaccuggagacaagauuacauucgaggcuaccggcaaccugguggugccccgguacgccuuugcgauggaacgcaacgccgggagcggaaucauuaucucugauacaccuguccacgacugcaauaccaccugucaaacacccaaaggcgcuaucaacacgucccucccguuccagaauauucacccuaucaccauuggcagaugccccaaguaugugaaaagcacaaaacugcggcuugccaccgggcugcgcaacguuccuucuauccagagcagaggacucuuuggcgcuauugccggguucaucgagggaggcuggacagggaugguggacggaugguacggcuaucaucaccagaaugaacaaggcuccggguacgccgcugaucugaagucuacccagaacgcgaucgacggaauuacgaauaaagucaacagcgugaucgagaagaugaauacacaguuuaccgccguuggcaaagaguucaaccaccuugaaaagcggauugagaaucugaacaagaaaguggaugacggguuccucgauaucuggaccuacaaugcugaacugcugguccuccuggagaacgaacgcacacuugacuaucaugauuccaaugugaagaaccuguacgagaaagucagaagccagcucaagaacaaugccaaagagauuggaaacggcuguuuugaguucuaucacaagugcgacaauaccuguauggagucugugaagaacgggacauacgauuaucccaaauacuccgaagaggccaagcugaaucgggaagagaucgacggcguuaaacuugagagcacgaugaucuaucaaauucuggcuaucuacucuaccguggccuccagccucguccugauugugucccugggagcgaucucuuuuuggaugugcagcaacggcucccuccagugccgcauuuguaucuga

SEQ ID NO: 189938 - RNA, 1701 nt, Artificial Sequence
  derived and/or modified sequence opt5 from hemagglutinin__InfluenzaA__AEJ10500
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagggaagcacaauggaaaacuuuguaagcugagaggcguugcuccccuccaucuggggaaaugcaacaucgccggauggauucugggcaauccugagugugaaucucucagcacagccuccucuuggagcuacaucguggagaccuccucuagcgauaacgggacgugcuauccgggagacuuuauugauuacgaagaacugcgggagcagcuuuccagcgucucuuccuucgaacgcuuugagaucuuccccaagaccagcucuuggccuaaucacgacuccaacaagggcgugacagccgcuuguccccaugccggcgcgaaaggguuuuauaagaaucugaucuggcucguuaaaaagggaaacagcuacccuaaacugaauaagucuuauauuaacgauaagggcaaagaagugcuuguccugugggggauccaccaccccuccaccacagccgaccaacagagccucuaccagaaugcugauaccuacguguucgugggaacguccagauauucuaagaaauuuaagccugagauugccauccggccgaaaguccgcgaccaggagggcagaaugaacuacuauuggacacugguugaacccggggauaagauuaccuucgaggcuacaggaaaccugguggugccucgguacgccuuugcgauggaacgcaaugccggcagcggcaucauuaucuccgacacccccguccaugauugcaacaccacaugucaaacgccuaaaggggcuaucaauaccagccuccccuuccagaacauucacccgaucacaauuggaaagugcccuaaguaugugaaaucuaccaagcugagacuugccacaggccugcggaauguucccuccauccagagccgcgggcucuuuggagcuauugccggcuucaucgaagggggauggaccggcaugguggacggcugguacggguaucaucaccagaacgaacaaggaucuggcuacgccgcugaccugaaaagcacgcagaaugcgaucgauaagauuacaaacaaagucaauuccgugaucgagaagaugaacacccaguuuaccgccguugggaaggaguucaaucaccuugagaaaagaauugagaaccugaauaagaaaguggacgauggauuccucgacaucuggacauacaacgcugaacugcugguccuccuggagaaugaacggacccuugauuaucaugacucuaacgugaagaaccuguacgagaaaguccgcaaucagcucaagaacaaugccaaggagauuggcaacggguguuuugaguucuaucacaaaugcgauaauacauguauggagagcgugaagaacggcacguacgacuauccuaaauacuccgaagaggccaagcugaauagagaagagaucgauggaguuaaacuugagagcacccggaucuaucaaauucuggcuaucuacucuacaguggccuccagccucguccuggugguuucucugggcgcgauuuccuuuuggaugugcagcaacgggucccuccagugccgcaucuguauuuga

SEQ ID NO: 189939 - RNA, 1701 nt, Artificial Sequence; identical to SEQ ID NO: 189891
  derived and/or modified sequence opt5 from hemagglutinin__InfluenzaA__AEJ10510

SEQ ID NO: 189940 - RNA, 1701 nt, Artificial Sequence
  derived and/or modified sequence opt5 from hemagglutinin__InfluenzaA__AEJ10520
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaauuaugauuccaacaagggagugacagccgcuuguccccacgccggcgcgaaaucuuuuuacaagaaucugaucuggcucguuaaaaagggcaacagcuauccuaaacuguccaagagcuacauuaaugacaaggggaaagaagugcuuguccuguggggaauccaucaccccuccaccucugccgaucaacagagccucuaccagaacgcugacgccuauguguucgugggcacauccagauacagcaagaaauuuaagccugagauugcuauccggccgaaaguccgcgaucaggaggggagaaugaauuauuacuggacccugguugaacccggagacaagauuacguucgaggccacaggcaaccugguggugccucgguaugcguuugccauggaacgcaacgcugggucuggaaucauuaucuccgauacccccguccacgacugcaauacaaccugucaaaccccuaaaggcgccaucaacacaagccuccccuuccagaauauucauccgaucacgauuggcaagugcucuaaguacgugaaaagcaccaagcugagacuugcuacagggcugcggaacguuccuuccauccagucucgcggacucuuuggcgccauugccggguucaucgagggaggcuggaccgggaugguggacggaugguauggcuaccaccaucagaaugaacaaggcagcggguacgcugcggaucugaaauccacacagaacgccaucgacgagauuaccaauaaggucaacagcgugaucgagaaaaugaauacgcaguuuacagcuguuggaaaggaguucaaccaccuugagaagagaauugaaaaucugaacaaaaagguggaugacggcuuccucgauaucuggaccuauaaugccgagcugcugguccuccuggaaaacgagcggacccuugacuaccacgauucuaaugugaaaaaccuguaugagaagguccgcucccagcucaaaaacaaugccaaggaaauugggaacggauguuuugaguucuaccauaagugcgacaauacauguauggaaagcgugaaaaacggcaccuaugauuaccccaaguauucugaggaagcuaaacugaauagagaggagaucgacgggguuaaacuugaauccacacggaucuaccaaauucuggccaucuacagcacgguggcguccucucucguccuggugguuagccugggcgcuauuuccuuuuggaugugcucuaacggaagccuccagugccgcaucuguauuuga

SEQ ID NO: 189941 - RNA, 1701 nt, Artificial Sequence; identical to SEQ ID NO: 185693
  derived and/or modified sequence opt5 from hemagglutinin__InfluenzaA__AEJ10530

SEQ ID NO: 189942 - RNA, 1701 nt, Artificial Sequence; identical to SEQ ID NO: 185693
  derived and/or modified sequence opt5 from hemagglutinin__InfluenzaA__AEJ10540

SEQ ID NO: 189943 - RNA, 1701 nt, Artificial Sequence; identical to SEQ ID NO: 185693
  derived and/or modified sequence opt5 from hemagglutinin__InfluenzaA__AEJ10550

SEQ ID NO: 189944 - RNA, 1701 nt, Artificial Sequence
  derived and/or modified sequence opt5 from hemagglutinin__InfluenzaA__AEJ10570
augaaggccauccuggugguccuccuguacacccuugcuacagccaacgcggacacgcugugcauuggcuaucacgcuaauaacagcaccgauacaguugacaccgugcucgagaaaaaugugacagucacccauuccgugaaccugcuugaagauaagcacgacgggaaacuguguaagcucagaggaguugcuccccugcaucugggcaaaugcaauaucgccggguggauucucggaaacccugagugugaaucucugagcacagccuccucuuggagcuacaucguggagaccuccucuagcgauaauggcacgugcuauccgggggacuucauugauuacgaggaacuucgggagcagcuguccagcgucucuuccuuugaacgcuucgagaucuuucccaagaccagcucuuggccuaaccacgacuccaauaagggagugacagccgcuuguccccaugccggcgcgaaaucuuucuauaagaaccucaucuggcugguuaaaaagggcaauagcuacccuaaacuuuccaagagcuauauuaacgauaaggggaaagaagugcugguccucuggggaauccaccaccccuccaccucugccgaccaacagagccuguaccagaaugcugaugccuacguguuugugggcacauccagauauagcaagaaauucaagccugagauugcuauccggccgaaaguccgcgaccaggaggggagaaugaacuacuauuggacccugguugaacccggagauaagauuacguuugaggccacaggcaaucucguggugccucgguacgcguucgccauggaacgcaacgcugggucuggaaucauuaucuccgacacccccguccaugacugcaacgccacaugucaaaccccuaaaggcgcuaucaauaccagccugcccuuucagaacauucacccgaucacaauuggcaagugcccuaaguaugugaaaucuacgaaacuuagacuggccaccgggcuccggaauguucccagcauccagucccgcggacuguucggcgccauugcuggguuuaucgagggaggcuggacagggaugguggauggaugguacggcuaucaucaccagaacgaacaaggcucuggguacgcggccgaccuuaaaagcacccagaaugcuaucgauaagauuacaaacaaagucaauuccgugaucgagaagaugaacacccaguucacggccguuggaaaggaguuuaaucaccuggaaaagagaauugagaaccucaauaagaaaguggacgauggcuuccuggacaucuggacauacaacgccgaacugcucguccugcuugagaaugaacggacccuggauuaucaugacagcaacgugaagaaucucuacgagaaaguccgcucucagcugaagaacaacgcuaaggagauugggaauggauguuucgaauuuuaucacaaaugcgauaacaccuguauggaguccgugaagaauggcacauacgacuauccuaaauacagcgaagaggccaaacuuaacagagaagagaucgaugggguuaagcuggagucuacccggaucuaucaaauucucgcgaucuacuccacaguggcuagcucccugguccuggugguuucucucggcgccauuagcuucuggaugugcuccaauggaucucugcagugccgcaucuguauuuga

SEQ ID NO: 189945 - RNA, 1701 nt, Artificial Sequence; identical to SEQ ID NO: 189944
  derived and/or modified sequence opt5 from hemagglutinin__InfluenzaA__AEJ10580

SEQ ID NO: 189946 - RNA, 1701 nt, Artificial Sequence
  derived and/or modified sequence opt5 from hemagglutinin__InfluenzaA__AEJ36302
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcuauaacggcacgugcuacccgggggacuuuauugauuaugaagaacugcgggagcagcuuuccagcgucucuuccuucgaacgcuuugagaucuuccccaagaccagcucuuggccuaaucacgaccccaacaagggagugacagccgcuuguccucaugccggcgcgaaauccuuuuacaagaaucugaucuggcucguuaaaaagggcaacagcuaucccaaacugucuaaguccuacauuaaugauaaggggaaagaagugcuuguccuguggggaauccaccacccuagcaccuccgccgaccaacagagacucuaccagaacgcugaugccuaugcuuucgugggcacaucucgguacagcaagaaauuuaagccggagauugccauccgccccaaagugagagaccaggaggggcggaugaauuauuacuggacccuggucgaaccuggagauaagauuacguucgaggcgacaggcaaccugguugugccccgcuaugccuuugcuauggaaagaaacgccggguccggaaucauuaucagcgacaccccugcucaugauugcaauacaaccugucaaacccccaaaggcgccaucaacacaucucucccguuccagaaugugcacccuauuacgaucggcaagugccccaaguacgucaaauccaccaagcugcggcuugccacagggcugcgcaacgugccuagcauucagucuagaggacucuuuggcgcuaucgcgggguucauugagggaggcuggaccgggaugguugacggaugguauggcuaccaucaccagaaugaacaaggcagcggguacgccgcugaccugaaauccacacagaacgccuuugaugagaucaccaauaaggugaacucugucaucgagaaaaugaauacgcaguucacagccgugggaaaggaguucaaccaccuugagaagcggauugaaaaucugaacaaaaagguugacgauggcuuucucgacaucuggaccuauaaugcugagcugcuggugcuccuggaaaacgagcgcacccuugauuaccaugacagcaaugucaaaaaccuguaugagaaggugagaucccagcucaaaaacaaugccaaggaaacagggaacggauguuucgaguuuuaccacaagugcgauaauaccuguauggaaagcgucaaaaacggcacauaugacuaccccaaguauucugaggaagcgaaacugaaucgggaggagauugauggggugaaacuugaauccacgcgcaucuaccaaauucuggcuaucuacagcaccguugccucuucccucgugcuggucgugagccugggcgccaucuccuucuggaugugcucuaacggaagccuccagugcagaauuuguaucuga

SEQ ID NO: 189947 - RNA, 1701 nt, Artificial Sequence
  derived and/or modified sequence opt5 from hemagglutinin__InfluenzaA__AEJ36312
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccugaucacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaucugguggugccucgguacgcguuugccauggaacgcaacgcugggucuggaaucauuaucuccgacacccccguccaugacugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggauggaugguacggcuaucaucaccagaacgaacaaggcucuggguacgcugcggaccugaaaagcacacagaaugccaucgauaagauuaccaacaaagucaauuccgugaucgagaagaugaacauucaguuuacggcuguuggaaaggaguucaaucaccuugagaaaagaaucgagaaccugaauaagaaaguggacgauggcuuccucgacauuuggacauacaacgccgaacugcugguccuccuggagaaugaacggacccuugauuaucaugacagcaacgugaagaaucuguacgagaaaguccgcucucagcucaagaacaacgccaaggagaucgggaauggauguuuugaguucuaucacaaaugcgauaacaccuguauggaauccgugaagaauggcacauacgacuauccuaaauacagcgaagaggcuaagcugaacagagaagagaucgaugggguuaaacuugagucuacccggauuuaucaaauccuggccauuuacuccacaguggcgagcucccucguccuggugguuucucugggcgcuaucagcuuuuggaugugcuccaauggaucucuccagugccgcauuuguaucuga

SEQ ID NO: 189948 - RNA, 1701 nt, Artificial Sequence
  derived and/or modified sequence opt5 from hemagglutinin__InfluenzaA__AEJ37853
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggaggccuccucuagcgacaacgggaccugcuauccgggcgauuuuauugacuacgaagaacugcgggagcagcuuuccagcgucucuuccuucgaacgcuuugagaucuuccccaagacgagcucuuggccuaaucacgauuccaacaagggagugaccgcugccuguccccaugcgggcgccaagagcuuuuauaaaaaucugaucuggcucguuaaaaagggcaacucuuacccuaaacuguccaagagcuauauuaaugacaaggggaaagaagugcuuguccuguggggaauccaccaccccuccacaucugcugaucaacagagccucuaccagaacgccgacgcuuacguguucgugggcaccuccagauauagcaagaaauuuaagccugagauugccauccggccgaaaguccgcgaucaggaggggagaaugaauuacuauuggacacugguugaacccggagacaagauuaccuucgaggcgacgggcaaccugguggugccucgguacgccuuugcuauggaacgcaacgccgggucuggaaucauuaucuccgauacacccguccaugacugcaauaccacaugucaaaccccuaaaggcgcuaucaacaccagccuccccuuccagaauauucacccgaucacaauuggcaagugcccuaaguaugugaaaucuacgaagcugagacuugccaccgggcugcggaacguucccagcauccagucccgcggacucuuuggcgccauugcuggguucaucgagggaggcuggacagggaugguggacggaugguacggcuaucaucaccagaaugaacaaggcucuggguacgcggccgaucugaaaagcacccagaacgcuaucgacaagauuacaaauaaagucaacuccgugaucgagaagaugaauacccaguuuacggccguuggaaaggaguucaaccaccuugagaaaagaauugagaaucugaacaagaaaguggaugacggcuuccucgauaucuggacauacaaugccgaacugcugguccuccuggagaacgaacggacccuugacuaucaugauagcaaugugaagaaccuguacgagaaaguccgcucucagcucaagaacaaugcuaaggagauugggaacggauguuuugaguucuaucacaaaugcgacaauauguguauggaauccgugaagaacggcaccuacgauuauccuaaauacagcgaagaggccaagcugaauagagaagagaucgacgggguuaaacuugagucuacacggaucuaucaaauucuggcgaucuacuccaccguggcuagcucccucguccuggugguuucucugggcgccauuagcuuuuggaugugcuccaacggaucucuccagugccgcaucuguauuuga

SEQ ID NO: 189949 - RNA, 1701 nt, Artificial Sequence
  derived and/or modified sequence opt5 from hemagglutinin__InfluenzaA__AEJ37863
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaacugcgcgaucaggaggggagaaugaauuacuauuggacccuggucgaacccggagacaagauuacguucgaggccacaggcaaccucguugugccucgguacgcguuugccauggaacgcaacgcugggucuggaaucauuaucuccgauacccccgugcaugacugcaauacaaccugucaaaccccuaaaggcgccaucaacacaagccugcccuuccagaauauucacccgaucacgauuggcaagugcccuaaguaugucaaaucuaccaaacuuagacuggcuacagggcuccggaacgugcccagcauccagucccgcggacuguuuggcgccauugccggguucaucgagggaggcuggaccgggaugguugacggaugguacggcuaucaucaccagaaugaacaaggcucuggguacgcugcggaucuuaaaagcacacagaacgccaucgacaagauuaccaauaaagugaacuccgucaucgagaagaugaauacgcaguuuacagcugugggaaaggaguucaaccaccuggaaaagagaauugagaaucucaacaagaaaguugaugacggcuuccuggauaucuggaccuacaaugccgaacugcucgugcugcuugagaacgaacggacccuggacuaucaugauagcaaugucaagaaccucuacgagaaagugcgcucucagcugaagaacaaugccaaggagauugggaacggauguuuugaguucuaucacaaaugcgacaauacauguauggaguccgucaagaacggcaccuacgauuauccuaaauacagcgaagaggcuaaacuuaauagagaagagaucgacggggugaagcuggagucuacacggaucuaucaaauucucgccaucuacuccacgguugcgagcucccuggugcuggucgugucucucggcgcuauuagcuuuuggaugugcuccaacggaucucugcagugccgcaucuguauuuga

SEQ ID NO: 189950 - RNA, 1701 nt, Artificial Sequence; identical to SEQ ID NO: 186857
  derived and/or modified sequence opt5 from hemagglutinin__InfluenzaA__AEJ37873

SEQ ID NO: 189951 - RNA, 1701 nt, Artificial Sequence; identical to SEQ ID NO: 189905
  derived and/or modified sequence opt5 from hemagglutinin__InfluenzaA__AEJ37883

SEQ ID NO: 189952 - RNA, 1701 nt, Artificial Sequence
  derived and/or modified sequence opt5 from hemagglutinin__InfluenzaA__AEJ37893
augaaggccauccuggugguccuccuguacaccuucgcuacaacgaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcaauuuuauugauuacgaagaacugcgggagcagcuuuccagcgucucuuccuucgaacgcuuugagaucuuccccaagacaagcucuuggccugaccacgauuccaacaagggagugaccgcugccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggccccucgguacgcguuugccauggaacgcaacgcugggucuggaaucauuaucuccgauaaacccgugcaugacugcaauacaaccugucaaaccccuaagggcgccaucaacacaagccuccccuuccagaauauucacccgaucacgauuggcaagugcccuaaauaugucaagucuaccaaacugagacuugcuacagggcugcggaacgugcccagcauccagucccgcggacucuuuggcgccauugccggguucaucgagggaggcuggaccgggaugguugacggaugguacggcuaucaucaccagaaugaacaaggcucuggguacgcugcggaucuuaagagcacacagaacgccaucgacaaaauuaccaauaaggugaacuccgucaucgagaagaugaauacgcaguuuacagcugugggaaaagaguucaaccaccuggaaaagagaauugagaaucugaacaaaaagguugaugacggcuuccucgauaucuggaccuacaaugccgaacugcuggugcuccuggagaacgaacggacccuugacuaucaugauagcaaugucaaaaaccuguacgagaaggugcgcucucagcucaagaacaaugccaaagagauugggaacggauguuuugaguucuaucacaagugcgacaauacauguauggaguccgucaaaaacggcaccuacgauuauccuaaguacagcgaagaggcuaaacugaauagagaagagaucgacggggugaaacuugagucuacacggaucuaucaaauucuggccaucuacuccacgguugcgagcucccucgugcuggucgugucucugggcgcuauuagcuuuuggaugugcuccaacggaucucuccagugccgcaucuguauuuga

SEQ ID NO: 189953 - RNA, 1701 nt, Artificial Sequence; identical to SEQ ID NO: 189905
  derived and/or modified sequence opt5 from hemagglutinin__InfluenzaA__AEJ37903

SEQ ID NO: 189954 - RNA, 1701 nt, Artificial Sequence
  derived and/or modified sequence opt5 from hemagglutinin__InfluenzaA__AEJ37923
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccggggaauuuuauugauuacgaagaacugcgggagcagcuuuccagcgucucuuccuucgaacgcuuugagaucuuccccaagaccagcucuuggccugaccacgauuccaacaagggagugacagccgcuuguccccaugccggcgcgaaauccuuuuauaagaaucugaucuggcucguuaaaaagggcaacucuuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggcgccucgguacgccuuugcuaucgaacgcauggccgggucuggaauuaucaucuccgauacccccgugcaugacugcaacacaaccugucaaaccccuaaaggcgcuauuaauacaagccuccccuuccagaacauccacccgauuacgaucggcaagugcccuaaguaugucaaaucuaccaagcugagacuugccacagggcugcggaaugugcccagcauucagucccgcggacucuuuggcgccaucgcuggguucaucgagggaggcuggaccgggaugguugacggaugguacggcuaucaucaccagaacgaacaaggcucuggguacgcggccgaucugaaaagcacacagaaugcuauugacaagaucaccaacaaagugaauagcgucauugagaagaugaacacgcaguuuacagccgugggaaaggaguucaaucaccuugagaaaagaaucgagaaccugaauaagaaaguugaugacggcuuccucgauauuuggaccuacaacgccgaacugcuggugcuccuggagaaugaacggacccuugacuaucaugauagcaacgucaagaaucuguacgagaaagugcgcucucagcucaagaacaacgcuaaggagaucgggaauggauguuuugaguucuaucacaaaugcgacaacacauguauggaauccgucaagaauggcaccuacgauuauccuaaauacagcgaagaggccaagcugaacagagaagagaucgacggggugaaacuugagucuacacggauuuaucaaauccuggcgauuuacuccacgguugcuagcucccucgugcuggucgugucucugggcgccaucagcuuuuggaugugcuccaauggaucucuccagugccgcauuuguaucuga

SEQ ID NO: 189955 - RNA, 1701 nt, Artificial Sequence
  derived and/or modified sequence opt5 from hemagglutinin__InfluenzaA__AEJ37943
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuaccauuggacccugguugaacccggagacaagauuacguucgaggccacaggcaaccugguggugccucgguaugcguuugccauggaacgcaacgcugggucuggaaucauuaucuccgauacccccguccacgacugcaauacaaccugucaaaccccuaaaggcgccaucaacacaagccuccccuuccagaauauucauccgaucacgauuggcaagugcccuaaguacgugaaaucuaccaagcugagacuugcuacagggcugcggaacguucccagcauccagucccgcggacucuuuggcgccauugccggguucaucgagggaggcuggaccgggaugguggacggaugguauggcuaccaccaccagaaugaacaaggcucuggguaugcugcggaucugaaaagcacacagaacgccaucgacaagauuaccaauaaagucaacuccgugaucgagaagaugaauacgcaguuuacagcuguuggaaaggaguucaaccaucuugagaaaagaauugagaaucugaacaagaaaguggaugacggcuuccucgauaucuggaccuacaaugccgaacugcugguccuccuggagaacgaacggacccuugacuaccacgauagcaaugugaagaaccuguaugagaaaguccgcucucagcucaagaacaaugccaaggagauugggaacggauguuuugaguucuaccauaaaugcgacaauacauguauggaauccgugaagaacggcaccuaugauuacccuaaauauagcgaagaggcuaagcugaauagagaagagaucgacgggguuaaacuugagucuacacggaucuaccaaauucuggccaucuauuccacgguggcgagcucccucguccuggugguuucucugggcgcuauuagcuuuuggaugugcuccaacggaucucuccagugccgcaucuguauuuga

SEQ ID NO: 189956 - RNA, 1701 nt, Artificial Sequence; identical to SEQ ID NO: 189905
  derived and/or modified sequence opt5 from hemagglutinin__InfluenzaA__AEJ37953

SEQ ID NO: 189957 - RNA, 1701 nt, Artificial Sequence
  derived and/or modified sequence opt5 from hemagglutinin__InfluenzaA__AEJ37963
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccggggaauuuuauugauuacgaagaacugcgggagcagcuuuccagcgucucuuccuucgaacgcuuugagaucuuccccaagaccagcucuuggccugaccacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggcgccucgguacgccuuugcuauggaacgcaacgccgggucuggaaucauuaucuccgauacccccgugcaugacugcaauacaaccugucaaaccccuaaaggcgcuacaaacacgagccuccccuuccagaauauccacccgauuaccaucggcaagugcccuaaguaugucaaaucuacaaagcugagacuugccaccgggcugcggaacgugcccagcauucagucccgcggacucuuuggcgccaucgcuggguucauugagggaggcuggacagggaugguugacggaugguacggcuaucaucaccagaaugaacaaggcucuggguacgcggccgaucugaaaagcacccagaacgcuaucgacaagaucacgaauaaagugaacuccgucauugagaagaugaauacacaguuuaccgccgugggaaaggaguucaaccaccuugagaaaagaaucgagaaucugaacaagaaaguugaugacggcuuccucgauauuuggaccuacaaugccgaacugcuggugcuccuggagaacgaacggacacuugacuaucaugauagcaaugucaagaaccuguacgagaaagugcgcucucagcucaagaacaaugcuaaggagaucgggaacggauguuuugaguucuaucacaaaugcgacaauaccuguauggaauccgucaagaacggcacauacgauuauccuaaauacagcgaagaggccaagcugaauagagaagagauugacggggugaaacuugagucuacgcggaucuaucaaauccuggcgauuuacuccaccguugcuagcucccucgugcuggucgugucucugggcgccaucagcuuuuggaugugcuccaacggaucucuccagugccgcauuuguaucuga

SEQ ID NO: 189958 - RNA, 1701 nt, Artificial Sequence; identical to SEQ ID NO: 186857
  derived and/or modified sequence opt5 from hemagglutinin__InfluenzaA__AEJ37973

SEQ ID NO: 189959 - RNA, 1701 nt, Artificial Sequence; identical to SEQ ID NO: 189905
  derived and/or modified sequence opt5 from hemagglutinin__InfluenzaA__AEJ37983

SEQ ID NO: 189960 - RNA, 1701 nt, Artificial Sequence; identical to SEQ ID NO: 188557
  derived and/or modified sequence opt5 from hemagglutinin__InfluenzaA__AEK21369

SEQ ID NO: 189961 - RNA, 1698 nt, Artificial Sequence; identical to SEQ ID NO: 186640
  derived and/or modified sequence opt5 from hemagglutinin__InfluenzaA__AEK21380

SEQ ID NO: 189962 - RNA, 1701 nt, Artificial Sequence
  derived and/or modified sequence opt5 from hemagglutinin__InfluenzaA__AEK21396
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccguggaucuccuggaagacaagcacaacgggaaacuuuguaagcugagaggaguugcuccccuccaucugggcaaaugcaauaucgccggguggauucugggaaacccugagugugaaucucucagcacagccuccucuuggagcuacaucguggagaccuccucuagcgauaauggcacgugcuauccgggggacuuuauugauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccaaguauagcaaaaaguuuaaaccugagauugcuaucagaccgaagguccgggaccaggaggggcgcaugaacuacuauuggacccugguugaacccggagauaaaauuacguucgaggccacaggcaaucugcucgugccuagauacgcguuugaaauggagcggaagucuggguccggaaucauuaucagcgacacccccgugcaugacugcaacacaaccugucaaaccccuaagggcgccaucaacacaucucugcccuuccagaauauucacccgaucacgauuggcaaaugcccuaaguaugucaaaagcaccaaacuucgccuggcuacagggcucagaaacgugcccuccauccagucucggggacuguuuggcgccauugcuggguucaucgaaggaggcuggaccgggaugguugauggaugguacggcuaucaucaccagaaugagcaaggcagcggguacgccgccgaccuuaaguccacacagaacgcuaucgaugagauuaccaauaaggugaacagcgucaucgaaaagaugaauacgcaguuuacagcggugggaaaagaguucaaccaccuggaaaagcgcauugagaaucucaacaaaaagguugacgauggcuuccuggacaucuggaccuacaaugccgaacugcucgugcugcuugagaacgagagaacccuggauuaucaugacucuaaugucaaaaaccucuacgaaaaggugcggucccagcugaagaauaacgcuaaagagauugggaacggauguuuugaguucuaucacaagugcgauaauacauguauggagagcgucaaaaacggcaccuacgacuauccuaaguacucugaagaggccaaacuuaaucgcgagaagaucgauggggugaagcuggaauccacaagaaucuaucaaauucucgccaucuacagcacgguugcuuccucucuggugcuggucgugagccucggcgccauuuccuuuuggaugugcucuaacggaagccugcagugccggaucuguauuuga

SEQ ID NO: 189963 - RNA, 1701 nt, Artificial Sequence
  derived and/or modified sequence opt5 from hemagglutinin__InfluenzaA__AEK21406
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcaugucuuccuucgaacgcuuugagaucuuccccaagaccagcucuuggccugaucacgacuccaauaagggagucacagccgcuuguccccaugccggcgcgaaauccuuuuauaagaaccugaucuggcucgugaaaaagggcaauucuuacccuaaacuguccaagagcuauauuaacgauaaggggaaagaaguucuugugcuguggggaauccaccaccccuccaccucugccgaccaacagagccucuaccagaaugcugaugccuacgucuucgugggcacauccagauauagcaagaaauuuaagccugagauugcuauccggccgaaagugcgcgaccaggaggggagaaugaacuacuauuggacccuggucgaacccggagauaagauuacguucgaggccacaggcaaucugguugugccucgguacgcguuugccauggaacgcaacgcugggucuggaaucauuaucuccgacacccccgugcaugacugcaacacaaccugucaaaccccuaaaggcgccaucaauacaagccuccccuuccagaacauucacccgaucacgauuggcaagugcccuaaguaugucaaaucuaccaagcugagacuugcuacagggcugcggaaugugcccagcauccagucccgcggacucuuuggcgccauugccggguucaucgagggaggcuggaccgggaugguugauggaugguacggcuaucaucaccagaacgaacaaggcucuggguacgcugcggaccugaaaagcacacagaaugccaucgauaagauuaccaacaaagugaauagcgucaucgagaagaugaacacgcaguuuacagcugugggaaaggaguucaaucaccuugagaaaagaauugagaaccugaauaagaaaguugacgauggcuuccucgacaucuggaccuacaacgccgaacugcuggugcuccuggagaaugaacggacccuugauuaucaugacagcaacgucaagaaucuguacgagaaagugcgcucucagcucaagaacaacgccaaggagauugggaauggauguuuugaguucuaucacaaaugcgauaacacauguauggaauccgucaagaauggcaccuacgacuauccuaaauacagcgaagaggcuaagcugaacagagaagagaucgauggggugaaacuugagucuacacggaucuaucaaauucuggccaucuacuccacgguugcgagcucccucgugcuggucgugucucugggcgcuauuagcuuuuggaugugcuccaauggaucucuccagugccgcaucuguauuuga

SEQ ID NO: 189964 - RNA, 1701 nt, Artificial Sequence
  derived and/or modified sequence opt5 from hemagglutinin__InfluenzaA__AEK21416
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggucuuuauugauuacgaagaacugcgggagcagcuuuccagcgugucuuccuucgaacgcuuugagaucuuccccaagaccagcucuuggccuaaucacgacuccaacaagggaguuacagccgcuuguccccaugccggcgcgaaaucuuuuuauaagaaucugaucuggcucgugaaaaagggcaacagcuacccuaaacuguccaagagcuauauuaaugauaaggggaaagaaguccuugugcuguggggaauccaccaccccuccaccacagccgaccaacagucucucuaccagaacgcugaugccuacguguucgucggcaccagcagauauuccaagaaauuuaagccugagauugcuguucggccgaaagugcgcgaccaggaggggagaaugaauuacuauuggacgcugguggaacccggagauaagaucacauucgaggccaccggcaaccuggucgugccucgguacgcguuugccauggaacgcaacgcugggagcggaauuaucauuucugacacacccguucaugauugcaauaccaccugucaaacaccuaaaggcgccaucaacacgucccuccccuuccagaauauccacccgauuaccaucggcaagugcccuaaguaugugaaaagcacaaagcugagacuugcuaccgggcugcggaacguccccucuauucagagccgcggacucuuuggcgccaucgccggguucauugagggaggcuggacagggaugguggacggaugguacggcuaucaucaccagaaugaacaaggcuccggguacgcugcggaccugaaaucuacccagaacgccaucgauaagaucacgaauaaaguuaacagcgugauugagaagaugaauacacaguuuaccgcugucggaaaggaguucaaccaccuugagaaaagaaucgagaaucugaacaagaaaguggacgauggcuuccucgacauuuggaccuacaaugccgaacugcugguccuccuggagaacgaacggacacuugauuaucaugacuccaaugugaagaaccuguacgagaaaguucgcaaccagcucaagaauaacgccaaggagaucgggaauggauguuuugaguucuaucacaaaugcgauaacaccuguauggaaagcgugaagaauggcacauacgacuauccuaaauacucugaagaggcuaagcugaacagagaagagauugauggggucaaacuugaguccacgcggaucuaucaaauccuggccauuuacagcaccguggcgucuucccucguucugguggucagccugggcgcuaucuccuuuuggaugugcucuaauggaagccuccagugccgcauuuguaucuga

SEQ ID NO: 189965 - RNA, 1701 nt, Artificial Sequence
  derived and/or modified sequence opt5 from hemagglutinin__InfluenzaA__AEK21426
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccggggaauuuuauugauuacgaagaacugcgggagcagcuuuccagcgucucuuccuucgaacgcuuugagaucuuccccaagaccagcucuuggccugaccacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggcgccucgguacgccuuugcuauggaacgcaacgccgggucuggaaucauuaucuccgauacccccgugcaugacugcaauacaaccugucaaaccccuaaaggcgcuaucaacacaagccuccccuuccagaauauucacccgaucacgauuggcaagugcccuaaguaugucagaucuaccaaacugcggcuugccacagggcugcgcaacgugcccagcauccaguccagaggacucuuuggcgccauugcuggguucaucgagggaggcuggaccgggaugguugacggaugguacggcuaucaucaccagaaugaacaaggcucuggguacgcggccgaucuuaagagcacacagaacgcuaucgacaaaauuaccaauaaggugaacuccgucaucgagaaaaugaauacgcaguuuacagccgugggaaaggaguucaaccaccuugaaaagcggauugagaaucugaacaaaaagguugaugacggcuuccucgauaucuggaccuacaaugccgaacugcuggugcuccuggagaacgaacgcacccuugacuaucaugauagcaaugucaaaaaccuguacgagaaggugagaucucagcucaaaaacaaugcuaaggagauugggaacggauguuuugaguucuaucacaagugcgacaauacauguauggaguccgucaaaaacggcaccuacgauuauccuaaguacagcgaagaggccaaacugaaucgggaagagaucgacggggugaagcuggagucuacacgcaucuaucaaauucuggcgaucuacuccacgguugcuagcucccucgugcuggucgugucucugggcgccauuagcuuuuggaugugcuccaacggaucucuccagugcagaaucuguauuuga

SEQ ID NO: 189966 - RNA, 1701 nt, Artificial Sequence; identical to SEQ ID NO: 186857
  derived and/or modified sequence opt5 from hemagglutinin__InfluenzaA__AEK21436

SEQ ID NO: 189967 - RNA, 1701 nt, Artificial Sequence
  derived and/or modified sequence opt5 from hemagglutinin__InfluenzaA__AEK21456
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacaagauuaccaauaaagucaacuccgugaucgagaagaugaauacgcaguuuacagcuguuggaaaggaguucaaccaccuugagaaaagaauugagaaucugaacaagaaaguggaugacggcuuccucgauaucuggaccuacaaugccgaacugcugguccuccuggagaacgaacggacccuugacuaucaugauagcaaugugaagaaccuguacgagaaaguccgcucucagcucaagaacaaugccaaggagauugggaacggauguuuugaguucuaucacaaaugcgacaauacauguauggaaaacgugaagaauggcaccuacgauuauccuaaauacuccgaagaggcuaagcugaacagagaagagaucgacgggguuaaacuugagagcacacggaucuaucaaauucuggccaucuacucuacgguggcguccagccucguccuggugguuucccugggcgcuauuucuuuuuggaugugcagcaauggaucccuccagugccgcaucuguauuuga

SEQ ID NO: 189968 - RNA, 1701 nt, Artificial Sequence; identical to SEQ ID NO: 189905
  derived and/or modified sequence opt5 from hemagglutinin__InfluenzaA__AEK21466

SEQ ID NO: 189969 - RNA, 1701 nt, Artificial Sequence; identical to SEQ ID NO: 189905
  derived and/or modified sequence opt5 from hemagglutinin__InfluenzaA__AEK21476

SEQ ID NO: 189970 - RNA, 1701 nt, Artificial Sequence; identical to SEQ ID NO: 186857
  derived and/or modified sequence opt5 from hemagglutinin__InfluenzaA__AEK21486

SEQ ID NO: 189971 - RNA, 1701 nt, Artificial Sequence
  derived and/or modified sequence opt5 from hemagglutinin__InfluenzaA__AEK28774
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauccgcagaucuaagaacuccuuuuucagccggcugaauuggcucacacaucugaacuuuaaauauccugcccuuaaugucaccaugcccaacaacgagcaguucgacaagcuguacauuuggggcgugcaccauccugggacggauaaagaccagaucuuucucuaugcgcaagccucuggacgcauuacaguuuccaccaagagaagccagcagacagcuaucccgaauauuggcucccggccccgcgugagaaacaucccuucucggaucagcauuuacuggaccaucgucaaacccggggauauucugcugaucaauuccaccggaaaccucauugccccucgcggcuacuucaagaucagaagcgggaagucuuccaucaugcggagcgacgcucccauuggaaaauguaauucugagugcaucacaccgaacggcagcauuccuaaugacaagcccuuucagaacgugaaucgcaucacguauggcgccuguccuagauacgugaaacaaaacacccugaaacuugcgacagggaugcggaauguccccgaaaaacagacccgcggaauuuucggcgccaucgcuggguuuaucgagaacggaugggaaggcaugguugaugggugguauggauucagacaccaaaauuccgagggccggggccaggccgcugaccugaagucuacacaggccgccauugaucagaucaacgggaaacucaauagacugauuggaaagaccaacgagaaguuccaccagaucgaaaaagaguuuagcgaaguggagggccgcauucaagaccuugaaaaguacguggaggauacgaaaaucgaccugugguccuauaacgcugagcuccuggucgcgcuggaaaaucagcauacaauucaccucaccgauagcgagaugaacaagcuguucgaaaagaccaagaagcagcuucgggagaaugccgaagacauggggaacggaugcuuuaaaaucuaccauaagugugauaaugcuugcaucggcucuauuagaaacgggacauaugaccacgauguguaccgcgacgaggcccugaauaaccgguuccagaucaaaggcguugagcucaaguccggauacaaagacuggauucuguggaucagcuuugccauuucuugcuuccuucuguguguggcucuccugggcuuuaucaugugggccugccaaaaggggaauaucagauguaacauuugcaucuga

SEQ ID NO: 189972 - RNA, 1701 nt, Artificial Sequence
  derived and/or modified sequence opt5 from hemagglutinin__InfluenzaA__AEK28785
augaagaccaucauugcccugagcuacauccucugccugguguucgcucagaaccuucccggcaaugacaacuccgccgcgacacugugucucgggcaccaugcugucccuaauggaacgauuguuaaaaccaucacaaacgaucaaguggaggugaccaaugccacagaacugguccagaacucuagcaccggcgagauuugcgacuccccgcaccagauccuugauggggaaaauuguacacugaucgacgcccuccugggagauccccagugcgacggcuuucaaaacaagaaaugggaucuguucguggagagaucuaaggcuuauagcaauuguuacccuuaugacguucccgauuacgccucccuccggucucugguggcuagcuccgggacccuugaauuuaacaaugagagcuucaacuggacgggagucacccagaauggcacaucuuccgccugcauucgcagaagcaacaauuccuuuuucucucggcugaacuggcucacccaucugaacuuuaaauauccugcgcuuaaugugacaaugcccaacaaugagcaguucgacaagcuguacaucuggggcguucaccauccugggaccgauaaggaccagauuuuucucuaugcccaagcuagcggacgcaucacggugucuacaaaaagaucccagcaggccgucauuccgaacaucggcagccggccccgcgugagaaauauuccuucccggaucucuaucuacuggaccauugugaagcccggggauauccugcugauuaacagcacaggaaaucucaucgcuccucgcggcuacuucaaaauuagauccgggaaaagcucuaucaugcgguccgacgcccccaucggaaaauguaacagcgaaugcauuaccccgaauggcucuaucccuaacgacaagcccuuucagaaugucaaccgcauuaccuauggcgcguguccuagauacguuaagcaaaauacacugaaacuugccacggggaugcggaacgugcccgagaagcagacccgcggaaucuucggcgcuauugccggguuuaucgaaaauggaugggagggcaugguggaugggugguauggauucagacaccagaacagcgagggccggggccaagcugccgaccugaaauccacacaggccgcuaucgaucagauuaacgggaagcucaauagacugaucggaaaaaccaacgaaaaguuccaccagauugagaaagaauuuucugaggucgaaggccgcauccaagaccuugagaaguacguggaggauacaaagauugaccuguggagcuauaaugcggaacuccugguugcccuggagaaccagcauaccauccaccucacggauuccgaaaugaauaaacuguucgagaagacaaagaagcagcuucgggaaaacgcugaggacauggggaauggaugcuuuaaaauuuaccauaagugugauaacgccugcaucggcagcaucagaaaugggaccuaugaccacgauguguaccgcgacgaggcccugaacaaucgguuccagauuaagggcgucgaacucaaaucuggauacaaggacuggauccuguggauuuccuuugcuaucagcugcuuccuucuguguguggcccuccugggcuuuauuaugugggcgugccaaaaagggaacaucagauguaauaucugcauuuga

SEQ ID NO: 189973 - RNA, 1701 nt, Artificial Sequence
  derived and/or modified sequence opt5 from hemagglutinin__InfluenzaA__AEK28796
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauaaaauugaggugacaaacgcuaccgaacuggugcaaucuagcuccacaggcgagaucugcgacucuccgcaccagauccuugaugggaagaauuguacccugauugacgcccuccugggagauccccagugcgacggcuuucagaacaaaaagugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacaagacggcaccuccagcgcuugcauccgcggcucuaaaaauuccuuuuucagcagacugaacuggcucacacaucugaauuuuaaguauccugcccuuaacgucaccaugcccaauaacgagcaguucgauaaacuguacauuuggggagugcaccauccugggacggacaaggaucagaucuuucucuaugcgcaggccucuggccggauuacaguuuccaccaaacgcagccaacaggcugccaucccgaacauuggguccagaccccgggugcgcaauaucccuucuagaaucagcauuuacuggacaaucgucaagcccggagacauucugcugaucaacuccaccggcaaucucauugcuccucggggguacuucaagauccgcagcggaaaaucuuccaucaugagaagcgacgcccccauuggcaaguguaacucugagugcaucaccccgaauggcagcauuccuaacgauaaacccuuucagaaugugaaccggaucacauauggggcguguccucgcuacgugaagcagaauacgcugaaacuugccaccggaaugagaaacguccccgaaaagcaaacacggggcauuuucggggcuaucgccggauuuaucgagaauggcugggaagggaugguugacggaugguauggcuuccgccaccagaacuccgagggcagagggcaggcugccgaucugaaaucuacccaagccgcuauugaccagaucaauggaaagcucaaccggcugauuggcaagacaaaugagaaauuccaccagaucgaaaaggaguuuagcgaaguggaggggcgcauucaggaucuugaaaaauacguggaggacaccaagaucgaucugugguccuauaacgcggagcuccuggucgcccuggaaaaccaacauacgauucaccucacagacagcgagaugaauaaacuguucgaaaagaccaagaaacagcuuagagagaacgcugaagauaugggaaauggcugcuuuaagaucuaccauaaaugugacaacgccugcaucgggucuauucggaauggcaccuaugaucacgacguguacagagacgaggcccugaacaaucgcuuccagaucaagggaguugagcucaaauccggcuacaaggauuggauucuguggaucagcuuugcuauuucuugcuuccuucuguguguggcccuccugggguuuaucaugugggcgugccagaagggaaacauccgguguaauauuugcaucuga

SEQ ID NO: 189974 - RNA, 1701 nt, Artificial Sequence
  derived and/or modified sequence opt5 from hemagglutinin__InfluenzaA__AEK28807
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuaugggaauuguuacccuuaugacgugcccgauuacgcuucccuccggucucugguugccagcuccggaacgcuugaauuuaacaaugagagcuucaacuggaccggcgugacacagaauggcaccucuuccgcuugcauccgcaagagcaacaauuccuuuuucucuagacugaacuggcucacacaucugaaguuuaaauauccugcccuuaaugucaccaugcccaacaacgagcaguucgacaagcuguacauuuggggagugcaccauccugggacggauaaugaccagaucuuucucuaugcgcaagccagcggccggauuacaguuucuaccaaacgcucccagcagacagugaucccgaacauugggagcagaccccggguccgcaauaucccuuccagaaucucuauuuacuggaccaucgugaagcccggagauauucugcugaucaacagcaccggcaaucucauugcuccucggggguacuucaaaauccgcuccggaaagagcucuaucaugagauccgacgcccccauuggcaaguguaacagcgaaugcaucacaccgaauggcucuauuccuaacgacaaacccuuucagaaugugaaccggaucacguauggggcuuguccucgcuacgucaagcaaaauacccugaaacuugccacaggaaugagaaacguucccgagaagcagacccggggcauuuucggggcgaucgccggauuuaucgaaaauggcugggaggggaugguggauggaugguauggcuuccgccaccagaacagcgagggcagagggcaagcugccgaccugaaauccacacaggcugccauugaucagaucaauggaaagcucaaccggcugauuggcaaaaccaacgaaaaguuccaccagaucgagaaggaauuuucugagguggaagggcgcauucaagaccuugagaaauacgucgaggauacgaagaucgaccuguggagcuauaaugccgaacuccugguggcucuggagaaccagcauacaauucaccucaccgauuccgaaaugaauaaacuguucgagaagaccaaaaagcagcuuagagaaaacgcggaggacaugggaaauggcugcuuuaagaucuaccauaaaugugauaacgccugcaucgggagcauucggaauggcacauaugaccacgauguuuacagagacgaggcucugaacaaucgcuuccagaucaagggaguggaacucaaaucuggcuacaaggacuggauucuguggaucuccuuugccauuagcugcuuccuucugugugucgcccuccugggguuuaucaugugggcuugccaaaaaggaaacauccgguguaauauuugcaucuga

SEQ ID NO: 189975 - RNA, 1701 nt, Artificial Sequence
  derived and/or modified sequence opt5 from hemagglutinin__InfluenzaA__AEK28818
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauccgcagaucuaagaacuccuuuuucagccggcugaauuggcucacacaucugaacuuuaaauauccugcccuuaaugucaccaugcccaacaacgagcaguucgacaagcuguacauuuggggcgugcaccauccugggacggauaaagaccagaucuuucucuaugcgcaagccucuggacgcauuacaguuuccaccaagagaagccagcagacagugaucccgaauauuggcucccggccccgcgucagaaacaucccuucucggaucagcauuuacuggaccaucgugaaacccggggauauucugcugaucaauaacaccggaaaucucauugcuccucgcggcuacuucaagaucagauccggaaagagcucuaucaugcgguccgacgcccccauugggaaauguaacagcgagugcaucacaccgaauggcucuauuccuaacgacaagcccuuucagaaugugaaccgcaucacguauggcgcuuguccuagauacgucaaacaaaauacccugaaacuugccacagggaugcggaacguucccgaaaaacagacccgcggaauuuucggcgcgaucgccggguuuaucgagaauggaugggaaggcaugguggaugggugguauggauucagacaccagaacagcgagggccggggccaagcugccgaccugaaguccacacaggcugccauugaucagaucaaugggaaacucaacagacugauuggaaagaccaacgagaaguuccaccagaucgaaaaagaguuuucugaaguggagggccgcauucaagaccuugaaaaguacgucgaggauacgaaaaucgaccuguggagcuauaaugccgagcuccugguggcucuggaaaaccagcauacaauucaccucaccgauuccgagaugaauaagcuguucgaaaagaccaagaagcagcuucgggagaacgcggaagacauggggaauggaugcuuuaaaaucuaccauaagugugauaacgccugcaucggcagcauuagaaaugggacauaugaccacgauguuuaccgcgacgaggcucugaacaaucgguuccagaucaaaggcguggagcucaagucuggauacaaagacuggauucuguggaucuccuuugccauuagcugcuuccuucugugugucgcccuccugggcuuuaucaugugggcuugccaaaaggggaacaucagauguaauauuugcaucuga

SEQ ID NO: 189976 - RNA, 1701 nt, Artificial Sequence
  derived and/or modified sequence opt5 from hemagglutinin__InfluenzaA__AEK28828
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauccgcagaucuaagaacuccuuuuucagccggcugaauuggcucacacaucugaacuuuaaauauccugcccuuaaugucaccaugcccaacaacgagcaguucgacaagcuguacauuuggggcgugcaccauccugggacggauaaagaccagaucuuucucuaugcgcaagccucuggacgcauuacaguuuccaccaagagaagccagcagacagugaucccgaauauuggcucccggccccgcgucagagauaucccuucucggaucagcauuuacuggaccaucgugaaacccggggacauucugcugaucaacuccaccggaaaucucauugcuccucgcggcuacuucaagaucagaagcgggaagucuuccaucaugcggagcgacgcccccauuggaaaauguaacucugagugcaucacaccgaauggcagcauuccuaacgauaagcccuuucagaaugugaaccgcaucacguauggcgcuuguccuagauacgucaaacaaaauacccugaaacuugccacagggaugcggaacguucccgaaaaacagacccgcggaauuuucggcgcgaucgccggguuuaucgagaauggaugggaaggcaugguggacgggugguauggauucagacaccagaacuccgagggccggggccaagcugccgaucugaagucuacacaggcugccauugaccagaucaaugggaaacucaacagacugauuggaaagaccaaugagaaguuccaccagaucgaaaaagaguuuagcgaaguggagggccgcauucaagaucuugaaaaguacgucgaggacacgaaaaucgaucugugguccuauaacgccgagcuccugguggcucuggaaaaccagcauacaauucaccucaccgacagcgagaugaauaagcuguucgaaaagaccaagaagcagcuucgggagaacgcggaagauauggggaauggaugcuuuaaaaucuaccauaagugugacaacgccugcaucggcucuauuagaaaugggacauaugaucacgacguuuaccgcgacgaggcucugaacaaucgguuccagaucaaaggcguggagcucaaguccggauacaaagauuggauucuguggaucagcuuugccauuucuugcuuccuucugugugucgcccuccugggcuuuaucaugugggugugccaaaaggggaacaucagauguaauauuugcaucuga

SEQ ID NO: 189977 - RNA, 1701 nt, Artificial Sequence; identical to SEQ ID NO: 185458
  derived and/or modified sequence opt5 from hemagglutinin__InfluenzaA__AEK28839

SEQ ID NO: 189978 - RNA, 1701 nt, Artificial Sequence
  derived and/or modified sequence opt5 from hemagglutinin__InfluenzaA__AEK28850
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccucuggacgcauuacaguuuccaccaagagaagccagcagacagugaucccgaacauuggcucccggcugcgcgucagaaauauccccucucggaucagcauuuacuggaccaucgugaaaccuggggauauucugcucaucaacuccaccggaaaucugauugcuccccgcggcuacuucaagaucagaagcgggaaaucuuccaucaugcggagcgacgccccuauuggaaaguguaacucugaaugcaucacacccaauggcagcauuccgaacgacaagccuuuucagaaugugaaccgcaucacguauggcgcuugucccagauacgucaaacaaaauacccuuaagcuggccacagggaugcggaacguuccugagaaacagacccgcggaauuuucggcgcgaucgccggguuuaucgaaaauggaugggagggcaugguggaugggugguauggauucagacaccagaacuccgagggccggggccaagcugccgaccucaagucuacacaggcugccauugaucagaucaaugggaaacugaacagacuuauuggaaagaccaacgaaaaauuccaccagaucgagaaggaauuuagcgagguggaaggccgcauucaagaccuggagaaguacgucgaggauacgaaaaucgaccucugguccuauaaugccgaacugcugguggcucucgagaaccagcauacaauugaucugaccgacagcgaaaugaauaaacuuuucgagaagaccaagaaacagcugcgggaaaacgcggaggauauggggaauggaugcuuuaagaucuaccacaagugugacaacgccugcaucggcucuauuagaaaugggacauaugaucaugacguuuaccgcgacgaggcucucaacaaucgguuccagaucaaaggcguggaacugaaguccggauacaaagauuggauucuuuggaucagcuuugccauuucuugcuuccugcucugugucgcccugcugggcuuuaucaugugggcuugccaaaaggggaacaucagauguaauauuugcaucuga

SEQ ID NO: 189979 - RNA, 1701 nt, Artificial Sequence
  derived and/or modified sequence opt5 from hemagglutinin__InfluenzaA__AEK28861
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccucuggacgcauuacaguuuccaccaagagaagccagcagacagugaucccgaacauuggcucccggccccgcgucagaaauaucccuucucggaucagcauuuacuggaccaucgugaaacccggggauauucugcugaucaacuccaccggaaaucucauugcuccucgcggcuacuucaagaucagaagcgggaaaucuuccaucaugcggagcgacgcccccauuggaaaguguaacucugaaugcaucacaccgaauggcagcauuccuaacgacaagcccuuucagaaugugaaccgcaucacguauggcgcuuguccuagauacgucaaacaaaauacccugaaacuugccacagggaugcggaacguucccgagaagcagacccgcggaauuuucggcgcgaucgccggguuuaucgaaaauggaugggagggcaugguggaugggugguauggauucagacaccagaacuccgagggccggggccaagcugccgaccugaagucuacacaggcugccauugaucagaucaaugggaaacucaacagacugauuggaaagaccaacgaaaaauuccaccagaucgagaaggaauuuagcgagguggaaggccgcauucaagaccuugagaaguacgucgaggauacgaaaaucgaccugugguccuauaaugccgaacuccugguggcucuggagaaccagcauacaauugaucucaccgacagcgaaaugaauaagcuguucgagaaaaccaagaaacagcuuaaggaaaacgcggaggauauggggaauggaugcuuuaagaucuaccacaaaugugacaacgccugcaucggcucuauucggaaugggacauaugaucaugacguuuacagagacgaggcucugaacaaucgcuuccacaucaagggcguggaacucaaauccggauacaaggauuggauucuguggaucagcuuugccaccucuugcuuccuucugugugucgcccuccugggcuuuauuaugugggcuugccagaaagggaacauccgguguaauaucugcauuuga

SEQ ID NO: 189980 - RNA, 1701 nt, Artificial Sequence
  derived and/or modified sequence opt5 from hemagglutinin__InfluenzaA__AEK28872
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccucuggacgcauuacaguuuccaccaagagaagccagcagacagugaucccgaacauuggcucccggccccgcgucagagauaucccuucucggaucagcauuuacuggaccaucgugaaacccggggacauucugcugaucaauuccaccggaaaccucauugcuccucgcggcuacuucaagaucagaagcgggaaaucuuccaucaugcggagcgacgcccccauuggaaaguguaauucugaaugcaucacaccgaacggcagcauuccuaaugauaagcccuuucagaacgugaaucgcaucacguauggcgcuuguccuagauacgucaaacaaaacacccugaaacuugccacagggaugcggaauguucccgagaagcagacccgcggaauuuucggcgcgaucgccggguuuaucgaaaacggaugggagggcaugguggacgggugguauggauucagacaccaaaauuccgagggccggggccaggcugccgaucugaagucuacacaggcugccauugaccagaucaacgggaaacucaauagacugauuggaaagaccaacgaaaaauuccaccagaucgagaaggaauuuagcgagguggaaggccgcauucaagaucuugagaaguacgucgaggacacgaaaaucgaucugugguccuauaacgccgaacuccugguggcucuggagaaucagcauacaauucaccucaccgacagcgaaaugaacaagcuguucgagaaaaccaagaaacagcuucgggaaaaugcggaggauauggggaacggaugcuuuaagaucuaccauaagugugacaaugccugcaucggcucuauuagaaacgggacauaugaucacgacguuuaccgcgacgaggcucugaauaaccgguuccagaucaaaggcguggaacucaaguccggauacaaagauuggauucuguggaucagcuuugccauuucuugcuuccuucugugugucgcccuccugggcuuuaucaugugggcuugccaaaaggggaauaucagauguaacauuugcaucuga

SEQ ID NO: 189981 - RNA, 1701 nt, Artificial Sequence
  derived and/or modified sequence opt5 from hemagglutinin__InfluenzaA__AEK28883
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugaucgccuccagcgggacgcuugaauuuaacaaugagucuuucaacuggaccggaguuacacagaauggcaccuccagcgcuugcauucgcagaucuuccaacagcuuuuucucucggcugaauuggcucacacaucugaaguuuaaguauccugcccuuaacgugaccaugcccaauaacgagcaguucgacaaacuguacaucuggggcguccaccauccugggacggauaacgaccagauuuuucucuaugcgcaagccuccggacgcaucacagugagcaccaagagaucccagcagacaguuauuccgaauaucggcucucggccccgcgugagaaacaucccuagccggauuuccaucuacuggaccauugucaaacccggggauauccugcugauuaauagcaccggaaaccucaucgcuccucgcggcuacuucaagaucagaucugggaaauccagcauuaugcggucugacgcccccaucggaaaguguaauagcgaaugcauuacaccgaacggcuccaucccuaaugacaagcccuuucagaacgugaaucgcauuacguauggcgcuuguccuagauacgugaaacaaaacacccugaagcuggccacagggaugcggaauguccccgagaaacagacccgcggaaucuucggcgcgaucgccggguuuauugaaaacggaugggagggcaugguugaugggugguauggauucagacaccaaaauucugagggccggggccaggcugccgaccuuaagagcacacaggcugccaucgaucagauuaacgggaaacucaauagacugaucggaaagaccaacgaaaaauuccaccagauugagaaggaauuuuccgagguggaaggccgcauccaagaccuugagaaguacguggaggauacgaaaauugaccuguggagcuauaacgccgaacuccuggucgcucuggagaaucagcauacaauccaccucaccgauucugaaaugaacaagcuguucgagaaaaccaagaaacagcuucgggaaaaugcggaggacauggggaacggaugcuuuaagaucuaccauaagugugauaaugccugcauuggcuccaucagaaacgggacauaugaccacgauguguaccgcgacgaggcucugaauaaccgguuccagauuaaaggcguugaacucaagagcggauacaaagacuggauccuguggauuucuuuugccaucuccugcuuccuucuguguguggcccuccugggcuuuaucaugugggcuugccaaaaggggaauauuagauguaacaucugcauuuga

SEQ ID NO: 189982 - RNA, 1701 nt, Artificial Sequence
  derived and/or modified sequence opt5 from hemagglutinin__InfluenzaA__AEK28894
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccucuggacgcauuacaguuuccaccaagagaagccagcagacagugaucccgaacauuggcucccggccccgcgucagaaauaucccuucucggaucagcauuuacuggaccaucgugaaacccggggauauucugcugaucaacuccaccggaaaucucauugcuccucgcggcuacuucaagaucagaagcgggaaaucuuccaucaugcggagcgacgcccccauuggaaaguguaacucugaaugcaucacaccgaauggcagcauuccuaacgacaagcccuuucagaaugugaaccgcaucacguauggcgcuuguccuagauacgucaaacaaaauacccugaaacuugccacagggaugcggaacguucccgagaagcagacccgcggaauuuucggcgcgaucgccggguuuaucgaaaauggaugggagggcaugguggaugggugguauggauucagacaccagaacuccgagggccggggccaagcugccgaccugaagucuacacaggcugccauugaucagaucaaugggaaacucaacagacugauuggaaagaccaacgaaaaauuccaccagaucgagaaggaauuuagcgagguggaaggccgcauucaagaccuugagaaguacgucgaggauacgaaaaucgaccugugguccuauaaugccgaacuccugguggcucuggagaaccagcauacaauucaccucaccgauagcgaaaugaauaagcuguucgagaaaaccaagaaacagcuucgggaaaacgcggaggacauggggaauggaugcuuuaagaucuaccauaagugugauaacgccugcaucggcucuauuagaaaugggacauaugaccacgauguuuaccgcgacgaggcucugaacaaucgguuccagaucaaaggcguggaacucaaguccggauacaaagacuggauucuguggaucagcuuugccauuucuugcuuccuucugugugucgcccuccugggcuuuaucaugugggcuugccaaaaggggaacaucagauguaauauuugcaucuga

SEQ ID NO: 189983 - RNA, 1701 nt, Artificial Sequence
  derived and/or modified sequence opt5 from hemagglutinin__InfluenzaA__AEK28905
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugcgcuuuaaguauccugcccuuaaugucaccaugcccaacaacgagcaguucgacaagcuguacauuuggggcgugcaccauccugggacggauaaugaccagaucuuuccguaugcgcaagccucuggaagaauuacaguuuccaccaaacggagccagcagacagugauccccaacauuggcucccgcccuagaguccggaauauccccucucgcaucagcauuuacuggaccaucgugaagccuggggauauucuccugaucaacuccaccggaaaucugauugcucccagaggcuacuucaaaauccggagcgggaagucuuccaucaugcgcagcgacgccccgauuggaaaauguaacucugaaugcaucacaccuaauggcagcauucccaacgacaagccuuuucagaaugugaacagaaucacguauggcgcuuguccccgguacgucaagcaaaauacccucaaacuggccacagggaugcgcaacguucccgagaagcagaccagaggaauuuucggcgcgaucgccggguuuaucgaaaauggaugggagggcaugguggaugggugguauggauuccggcaccagaacuccgagggcagaggccaagcugccgaccuuaaaucuacacaggcugccauugaucagaucaaugggaagcugaaccgccucauuggaaaaaccaacgaaaaguuccaccagaucgagaaagaauuuagcgagguggaaggccggauucaagaccuggagaaguacgucgaggauacgaagaucgaccuuugguccuauaaugccgaacugcucguggcucuggagaaccagcauacaauugaucugaccgacagcgaaaugaauaaacucuucgagaagaccaaaaagcagcugagagaaaacgcggaggauauggggaauggaugcuuuaaaaucuaccacaagugugacaacgccugcaucggcucuauucgcaaugggacauaugaucaugacguuuaccgggacgaggcucuuaacaauagauuccagaucaagggcguggaacugaaauccggauacaaggauuggauucucuggaucagcuuugccauuucuugcuuccugcuuugugucgcccugcucggcuuuaucaugugggcuugccaaaaagggaacauccgcuguaauauuugcaucuga

SEQ ID NO: 189984 - RNA, 1701 nt, Artificial Sequence
  derived and/or modified sequence opt5 from hemagglutinin__InfluenzaA__AEK28916
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccucuggacgcauuacaguuuccaccaagagaagccagcagacagugaucccgaacauuggcucccggccccgcaucagaaauaucccuucucggauuagcaucuacuggaccauugucaaacccggggauauccugcugauuaacuccaccggaaaucucaucgcuccucgcggcuacuucaagaucagaagcgggaaaucuuccgugaugcggagcgacgcccccauuggaaaguguaacucugaaugcaucacaccgaauggcagcauuccuaacgacaagcccuuucagaaugugaaccgcaucacguauggcgcuuguccuagauacgucaaacaaaauacccugaaacuugccacagggaugcggaacguucccgagaagcagacccgcggaauuuucggcgcgaucgccggguuuaucgaaaauggaugggagggcaugguggaugggugguauggauucagacaccagaacuccgagggccggggccaagcugccgaccugaagucuacacaggcugccauugaucagaucaaugggaaacucaacagacugauuggaaagaccaacgaaaaauuccaccagaucgagaaggaauuuagcgagguggaaggccgcauucaagaccuugagaaguacgucgaggauacgaaaaucgaccugugguccuauaaugccgaacuccugguggcucuggagaaccagcauacaauugaucucaccgacagcgaaaugaauaagcuguucgagaaaaccaagaaacagcuucgggaaaacgcggaggauauggggaauggaugcuuuaagaucuaccacaagugugacaacgccugcaucggcucuauuagaaaugggacauaugaucaugacguuuaccgcgacgaggcucugaacaaucgguuccagaucaaaggcguggaacucaaguccggauacaaagauuggauucuguggaucagcuuugccauuucuugcuuccuucugugugucgcccuccugggcuuuaucaugugggcuugccaaaaggggaacaucagauguaauauuugcaucuga

SEQ ID NO: 189985 - RNA, 1701 nt, Artificial Sequence
  derived and/or modified sequence opt5 from hemagglutinin__InfluenzaA__AEK28927
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugaucgccuccagcgggacgcuugaauuuaacaaugagucuuucaacuggaccggaguuacacagaauggcaccuccagcgcuugcauucgcagaucuaacaauuccuuuuucagccggcugaacuggcucacacaucugaaguuuaaguauccugcccuuaaugugaccaugcccaacaacgagcaguucgacaaacuguacaucuggggcguccaccauccugggacggauaaugaccagauuuuucucuaugcgcaagccucuggacgcaucacaguguccaccaagagaagccagcagacaguuauuccgaacaucggcucccggccccgcgugagaaauaucccuucucggauuagcaucuacuggaccauugucaaacccggggauauccugcugauuaacuccaccggaaaucucaucgcuccucgcggcuacuucaagaucagaagcgggaaaucuuccauuaugcggagcgacgcccccaucggaaaguguaacucugaaugcauuacaccgaauggcagcaucccuaacgacaagcccuuucagaaugugaaccgcauuacguauggcgcuuguccuagauacgugaaacaaaauacccugaaacuugccacagggaugcggaacguccccgagaagcagacccgcggaaucuucggcgcgaucgccggguuuauugaaaauggaugggagggcaugguugaugggugguauggauucagacaccagaacuccgagggccggggccaagcugccgaccugaagucuacacaggcugccaucgaucagauuaaugggaaacucaacagacugaucggaaagaccaacgaaaaauuccaccagauugagaaggaauuuagcgagguggaaggccgcauccaagaccuugagaaguacguggaggauacgaaaauugaccugugguccuauaaugccgaacuccuggucgcucuggagaaccagcauacaauccaccucaccgauagcgaaaugaauaagcuguucgagaaaaccaagaaacagcuucgggaaaacgcggaggacauggggaauggaugcuuuaagaucuaccauaagugugauaacgccugcauuggcucuaucagaaaugggacauaugaccacgauguguaccgcgacgaggcucugaacaaucgguuccagauuaaaggcguugaacucaaguccggauacaaagacuggauccuguggauuagcuuugccaucucuugcuuccuucuguguguggcccuccugggcuuuaucaugugggcuugccaaaaggggaacauuagauguaauaucugcauuuga

SEQ ID NO: 189986 - RNA, 1701 nt, Artificial Sequence
  derived and/or modified sequence opt5 from hemagglutinin__InfluenzaA__AEK28949
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccucuggacgcauuacaguuuccaccaagagaagccagcagacagugaucccgaacauuggcucccggccccgcgucagaaauaucccuucucggaucagcauuuacuggaccaucgugaaacccggggauauucugcugaucaacuccaccggaaaucucauugcuccucgcggcuacuucaagaucagaagcgggaaaucuuccaucaugcggagcgacgcccccauuggaaaguguaacucugaaugcaucacaccgaauggcagcauuccuaacgacaagcccuuucagaaugugaaccgcaucacguauggcgcuuguccuagauacgucaaacaaaauacccugaaacuugccacagggaugcggaacguucccgagaagcagacccgcggaauuuucggcgcgaucgccggguuuaucgaaaauggaugggagggcaugguggaugggugguauggauucagacaccagaacuccgagggccggggccaagcugccgaccugaagucuacacaggcugccauugaucagaucaaugggaaacucaacagacugauuggaaagaccaacgaaaaauuccaccagaucgagaaggaauuuagcgagguggaaggccgcauucaagaccuugagaaguacgucgaggauacgaaaaucgaccugugguccuauaaugccgaacuccugguggcucuggagaaccagcauacaauugaucucaccgacagcgaaaugaauaagcuguucgagaaaaccaagaaacagcuucgggaaaacgcggaggauauggggaauggaugccugaagaucuaccacaagugugacaacgccugcaucggcucuauuagaaaugggacauaugaucaugacguuuaccgcgacgaggcucucaacaaucgguuucagaucaaaggcguggaacugaaguccggauacaaagauuggauucuuuggaucagcuucgccauuucuugcuuucugcucugugucgcccugcugggcuucaucaugugggcuugccaaaaggggaacaucagauguaauauuugcaucuga

SEQ ID NO: 189987 - RNA, 1701 nt, Artificial Sequence; identical to SEQ ID NO: 185458
  derived and/or modified sequence opt5 from hemagglutinin__InfluenzaA__AEK28960

SEQ ID NO: 189988 - RNA, 1701 nt, Artificial Sequence; identical to SEQ ID NO: 185458
  derived and/or modified sequence opt5 from hemagglutinin__InfluenzaA__AEK28971

SEQ ID NO: 189989 - RNA, 1701 nt, Artificial Sequence
  derived and/or modified sequence opt5 from hemagglutinin__InfluenzaA__AEK28982
augaagaccaucauugcccugagcuacauccucugccugguguucgcucagaaacuucccggcaacuauaauuccacagccacgcugugucucgggcaccaugcggucccuaacggaaccauuguuaagacaaucaccaaugaccaaauugaggugacaaacgcuaccgaacuggugcagucuagcuccacaggcgagaucugcgauucuccgcaccagauccuugacggggaaaauuguacccugauugaugcccuccugggagacccccagugcgauggcuuucaaaacaaaaagugggaccuguucgucgagagaagcaaagccuacuccaauuguuauccuuacgaugugcccgacuaugcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguacccugcccuuaaugucaccaugcccaacaacgagcaguucgauaaacuguauauuuggggcgugcaccauccugggacggacaaugaucagaucuuucucuacgcgcaagccucuggacgcauuacaguuuccaccaagagaagccagcagacagugaucccgaacauuggcucccggccccgcgucagaaauaucccuucucggaucagcauuuacuggaccaucgugaaacccggggacauucugcugaucaacuccaccggaaaucucauugcuccucgcggcuauuucaagaucagaagcgggaaaucuuccaucaugcggagcgaugcccccauuggaaaguguaacucugaaugcaucacaccgaauggcagcauuccuaacgacaagcccuuucagaaugugaaccgcaucacguacggcgcuuguccuagauaugucaaacaaaauacccugaaacuugccacagggaugcggaacguucccgagaagcagacccgcggaauuuucggcgcgaucgccggguuuaucgaaaauggaugggagggcaugguggacgggugguacggauucagacaccagaacuccgagggccggggccaagcugccgaucugaagucuacacaggcugccauugaccagaucaaugggaaacucaacagacugauuggaaagaccaacgaaaaauuccaccagaucgagaaggaauuuagcgagguggaaggccgcauucaagaucuugagaaguaugucgaggacacgaaaaucgaucugugguccuacaaugccgaacuccugguggcucuggagaaccagcauacaauucaccucaccgacagcgaaaugaauaagcuguucgagaaaaccaagaaacagcuucgggaaaacgcggaggauauggggaauggaugcuuuaagaucuaucauaagugugacaacgccugcaucggcucuauuagaaaugggacauacgaucacgacguuuaccgcgaugaggcucugaacaaucgguuccagaucaaaggcguggaacucaaguccggauauaaagacuggauucuguggaucagcuuugccauuucuugcuuccuucugugugucgcccuccugggcuuuaucaugugggcuugccaaaaggggaacaucagauguaauauuugcaucuga

SEQ ID NO: 189990 - RNA, 1701 nt, Artificial Sequence
  derived and/or modified sequence opt5 from hemagglutinin__InfluenzaA__AEK28993
augaagaccaucauugcccugagcuacauccucugccugguguucgcucagaaacuucccggcaacuauaauuccacagccacgcugugucucgggcaccaugcggucccuaacggaaccauuguuaagacaaucaccaaugaccaaauugaggugacaaacgcuaccgaacuggugcagucuagcuccacaggcgagaucugcgauucuccgcaccagauccuugacggggaaaauuguacccugauugaugcccuccugggagacccccagugcgauggcuuucaaaacaaaaagugggaccuguucgucgagagaagcaaagccuacuccaauuguuauccuuacgaugugcccgacuaugcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguacccugcccuuaaugucaccaugcccaacaacgagcaguucgauaaacuguauauuuggggcgugcaccauccugggacggacaaugaucagaucuuucucuacgcgcaagccucuggacgcauuacaguuuccaccaagagaagccagcagacagugaucccgaacauuggcucccggccccgcgucagaaauaucccuucucggaucagcauuuacuggaccaucgugaaacccggggacauucugcugaucaacuccaccggaaaucucauugcuccucgcggcuauuucaagaucagaagcgggaaaucuuccaucaugcggagcgaugcccccauuggaaaguguaacucugaaugcaucacaccgaauggcagcauuccuaacgacaagcccuuucagaaugugaaccgcaucacguacggcgcuuguccuagauaugucaaacaaaauacccugaaacuugccacagggaugcggaacguucccgagaagcagacccgcggaauuuucggcgcgaucgccggguuuaucgaaaauggaugggagggcaugguggacgggugguacggauucagacaccagaacuccgagggccggggccaagcugccgaucugaagucuacacaggcugccauugaccagaucaaugggaaacucaacagacugauuggaaagaccaacgaaaaauuccaccagaucgagaaggaauuuagcgagguggaaggccgcauucaagaucuugagaaguaugucgaggacacgaaaaucgaucugugguccuacaaugccgaacuccugguggcucuggagaaccagcauacaauugaccucaccgauagcgaaaugaauaagcuguucgagaaaaccaagaaacagcuucgggaaaacgcggaggacauggggaauggaugcuuuaagaucuaucacaagugugauaacgccugcaucggcucuauuagaaaugggacauacgaccaugauguuuaccgcgacgaggcucugaacaaucgguuccagaucaaaggcguggaacucaaguccggauauaaagacuggauucuguggaucagcuuugccauuucuugcuuccuucugugugucgcccuccugggcuuuaucaugugggcuugccaaaaggggaacaucagauguaauauuugcaucuga

SEQ ID NO: 189991 - RNA, 1701 nt, Artificial Sequence
  derived and/or modified sequence opt5 from hemagglutinin__InfluenzaA__AEK29004
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuauguuucucuccggagccugguggcuuccagcgggacgcuugaauuuaauaacgagucuuucaauuggaccggagucacacagaacggcaccuccagcgccugcauccgcagaucuaauaacuccuuuuucagccggcugaauuggcucacacaccugaacuuuaaguacccugcucuuaacgugaccaugcccaauaacgagcaguucgauaagcuguauauuuggggcguucaucacccugggacggacaaagaucagaucuuucucuacgcccaagcgucuggacgcauuacaguguccaccaagagaagccagcaggccgucaucccgaauauuggcucccggccccgcgugagaaacaucccuucucgggugagcaucuauuggacaauugucaaacccggggacauccugcugauuaauuccaccggaaaccucaucgcuccucgcggcuacuucaagauuagaagcgggaaaucuuccaucaugcggagcgaugcccccaucggaaaguguaauucugcuugcauuaccccgaacggcagcaucccuaaugacaagcccuuucagaacguuaaucgcauuacauacggcgccuguccuagauaugugaaacaaaacacgcugaaacuugcgaccgggaugcggaaugugcccgaaaaacagacacgcggaaucuucggcgccauugcuggguuuaucgagaacggaugggaaggcauggucgacgggugguacggauucagacaccaaaauuccgagggccggggccaggccgcugaucugaagucuacccaggccgccaucgaccagauuaacgggaaacucaacagacugaucggaaagacaaaugagaaauuccaucagauugaaaaggaguuuagcgaaguggagggccgcauccaagaucuugaaaaguauguugaggacaccaaaauugaucugugguccuacaacgcugagcuccugguggcgcuggaaaaucagcacacgaucgaccucacagauagcgagaugaacaagcuguucgaaaagaccaagaaacagcuucgggagaaugccgaagacauggggaacggaugcuuuaagauuuaucauaagugugauaaugcuugcaucggcucuaucagaaacgggaccuacgaccacgaugucuaucgcgacgaggcccugaauaaccgguuccagauuaaaggcguggagcucaaguccggauacaaagacuggauccuguggauuagcuuugccaucucuugcuuccuucuguguguugcucuccugggcuuuauuaugugggccugccaaaaggggaauaucagauguaacaucugcauuuga

SEQ ID NO: 189992 - RNA, 1701 nt, Artificial Sequence
  derived and/or modified sequence opt5 from hemagglutinin__InfluenzaA__AEK29026
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaagauaagaaaugggaccuguucgucgaaagaagcaaggccuauuccaacuguuacccuuaugaugugcccgacuacgcuucucuccggagccugguugccuccagcgggacgcuugaguuuaauaacgaaucuuucaauuggaccggagugacacagaacggcaccuccagcgcuugcauccgcagaucuaaaaauuccuuuuucagccggcugaacuggcucacacaucugaauuuuaaauauucugcccuuaacgucaccaugccuaauaacgagcaguucgauaagcuguacauuuggggcgugcaccaucccgggacggacaaagaucagaucuuucucuaugcgcaagccuccggacgcauuacaguuagcaccaagagaucccagcagacagugaucccuaacauuggcucucggccgcgcgucagaaauauccccagccggaucuccauuuacuggaccaucgugaaaccuggggacauucugcugaucaacagcaccggaaaucucauugcuccccgcggcuacuucaagaugcagucugggaaguccagcaucaugagaucugacgccccuaucggaaaauguaacagcgagugcauuacacccaauggcuccaucccgaacgauaagccuuuucaaaaugugaaccggauuacguauggcgcuuguccccgcuacgucaaacagaauacccugaagcuggccacagggaugagaaacguuccugaaaaacagacccggggaaucuucggcgcgauugccggguuuaucgagaauggaugggaaggcaugguggacgggugguauggauuccgccaccaaaacucugagggcagaggccaggcugccgaucuuaagagcacacaggcugccaucgaccagauuaaugggaaacucaaccggcugaucggaaagaccaaugagaaguuccaccaaauugaaaaagaguuuuccgaaguggagggcagaauccaggaucuugaaaaguacgucgaggacacgaaaauugaucuguggagcuauaacgccgagcuccugguggcucuggaaaaccagcauacaaucgaccucaccgauucugagaugaauaagcuguucgaaaagaccaagaagcagcuucgcgagaacgcggaagacauggggaauggaugcuuuaaaauuuaccacaagugugauaacgccugcaucggcuccauccggaaugggacauaugaccaugacguuuacagagaugaggcucugaacaaucgcuuccaaauuaaaggcguggagcucaagagcggauacaaagacuggauccuguggauuucuuuugccaucuccugcuuccuucugugugucgcccuccugggcuuuauuaugugggcuugccagaaggggaacauccgguguaauaucugcauuuga

SEQ ID NO: 189993 - RNA, 1701 nt, Artificial Sequence
  derived and/or modified sequence opt5 from hemagglutinin__InfluenzaA__AEK29048
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggaguggcucagaacggcacauccagcgccugcauccgcagaucuaauaacuccuuuuucagccggcugaauuggcucacccaccugaacuuuaaguacccugcgcuuaacgucacaaugcccaauaacgagcaguucgauaagcuguauauuuggggcgugcaucacccugggaccgacaaagaucagaucuuucucuacgcccaagcugccggacgcauuacgguuucuacaaagagaucccagcaggcugugaucccgaauauuggcagccggccccgcgucagaaacaucccuucccgggugucuaucuauuggaccauugugaaacccggggacauccugcugauuaauagcacaggaaaccucaucgccccucgcggcuacuucaagauuagauccgggaaaagcucuaucaugcgguccgaugcgcccaucggaaaguguaauagcgccugcauuaccccgaacggcucuaucccuaaugacaagcccuuucagaacgucaaucgcauuaccuacggcgcuuguccuagauauguuaaacaaaacacacugaaacuugccacggggaugcggaaugugcccgaaaaacagacccgcggaaucuucggcgcuauugccggguuuaucgagaacggaugggaaggcaugguggacgggugguacggauucagacaccagaauagcgagggccggggccaagccgcugaucugaaguccacacaggcggccaucgaccagauuaacgggaaacucaacagacugaucggaaagaccaaugagaaauuccaucagauugaaaaggaguuuucugaagucgagggccgcauccaagaucuugaaaaguauguggaggacacaaaaauugaucuguggagcuacaacgcugagcuccugguugcccuggaaaaucagcacaccaucgaccucacggauuccgagaugaacaagcuguucgaaaagacaaagaaacagcuucgggagaaugccgaagacauggggaacggaugcuuuaagauuuaucauaagugugauaaugcuugcaucggcagcaucagaaacgggaccuacgaccacgauguguaucgcgacgaggcccugaauaaccgguuccagauuaaaggcgucgagcucaagucuggauacaaagacuggauccuguggauuuccuuugcgaucagcugcuuccuucuguguguggcucuccugggcuuuauuaugugggccugccaaaaggggaauaucagauguaacaucugcauuuga

SEQ ID NO: 189994 - RNA, 1701 nt, Artificial Sequence
  derived and/or modified sequence opt5 from hemagglutinin__InfluenzaA__AEK29070
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaauuuuaaguauccugcccuuaacgucaccaugcccaacaaugagcaguucgacaagcuguacauuuggggcgugcaccauccugggacggauaaagaccagaucuuucucuaugcgcaagccucuggacgcauuacaguuuccaccaagagaagccagcaggcugugaucccgaacauuggcucccggccccgcgucagaaauaucccuucucggaucagcauuuacuggacaaucgugaaacccggggauauucugcugaucaacuccaccggaaaucucauugccccucgcggcuacuucaagaucagaagcgggaaaucuuccaucaugcggagcgacgcucccauuggaaaguguaacucugaaugcaucaccccgaauggcagcauuccuaacgacaagcccuuucagaaugugaaccgcaucacauauggcgccuguccuagauacgucaaacaaaauacgcugaaacuugcgaccgggaugcggaacguucccgagaagcagacacgcggaauuuucggcgccaucgcuggguuuaucgaaaauggaugggagggcaugguggaugggugguauggauucagacaccagaacuccgagggccggggccaagccgcugaccugaagucuacccaggccgccauugaucagaucaaugggaaacucaacagacugauuggaaagacaaacgaaaaauuccaccagaucgagaaggaauuuagcgagguggaaggccgcauucaagaccuugagaaguacgucgaggauaccaaaaucgaccugugguccuauaaugcugaacuccugguggcgcuggagaaccagcauacgauucaccucacagauagcgaaaugaauaagcuguucgagaaaaccaagaaacagcuucgggaaaacgccgaggacauggggaauggaugcuuuaagaucuaccauaagugugauaacgcuugcaucggcucuauuagaaaugggaccuaugaccacgauguuuaccgcgacgaggcccugaacaaucgguuccagaucaaaggcguggaacucaaguccggauacaaagacuggauucuguggaucagcuuugccauuucuugcuuccuucugugugucgcucuccugggcuuuaucaugugggccugccaaaaggggaacaucagauguaauauuugcaucuga

SEQ ID NO: 189995 - RNA, 1701 nt, Artificial Sequence
  derived and/or modified sequence opt5 from hemagglutinin__InfluenzaA__AEK29081
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcucuugcauccgcagauccaacaauagcuuuuucucucggcugaacuggcucacacaucugaauuuuaaguauccugcucuuaacgucaccaugcccaacaaugagcaguucgacaagcuguacauuuggggcgugcaccauccugggacggauaaagaccagaucuuucucuaugcccaagcguccggacgcauuacaguuagcaccaagagaucccagcaggccgugaucccgaacauuggcucucggccccgcgucagaaauaucccuagccggaucuccauuuacuggacaaucgugaaacccggggauauucugcugaucaacagcaccggaaaucucauugcuccucgcggcuacuucaagaucagaucugggaaauccagcaucaugcggucugacgcccccauuggaaaguguaacagcgaaugcaucaccccgaauggcuccauuccuaacgacaagcccuuucagaaugugaaccgcaucacauauggcgcuuguccuagauacgucaaacaaaauacgcugaagcuggccaccgggaugcggaacguucccgagaaacagacacgcggaauuuucggcgcgaucgccggguuuaucgaaaauggaugggagggcaugguggaugggugguauggauucagacaccagaacucugagggccggggccaagcugccgaccuuaagagcacccaggcugccauugaucagaucaaugggaaacucaacagacugauuggaaagacaaacgaaaaauuccaccagaucgagaaggaauuuuccgagguggaaggccgcauucaagaccuugagaaguacgucgaggauaccaaaaucgaccuguggagcuauaaugccgaacuccugguggcucuggagaaccagcauacgauucaccucacagauucugaaaugaauaagcuguucgagaaaaccaagaaacagcuucgggaaaacgcggaggacauggggaauggaugcuuuaagaucuaccauaagugugauaacgccugcaucggcuccauuagaaaugggaccuaugaccacgauguuuaccgcgacgaggcucugaacaaucgguuccagaucaaaggcguggaacucaagagcggauacaaagacuggauucuguggaucucuuuugccauuuccugcuuccuucugugugucgcccuccugggcuuuaucaugugggcuugccaaaaggggaacaucagauguaauauuugcaucuga

SEQ ID NO: 189996 - RNA, 1701 nt, Artificial Sequence; identical to SEQ ID NO: 188557
  derived and/or modified sequence opt5 from hemagglutinin__InfluenzaA__AEK29092

SEQ ID NO: 189997 - RNA, 1701 nt, Artificial Sequence; identical to SEQ ID NO: 189879
  derived and/or modified sequence opt5 from hemagglutinin__InfluenzaA__AEK29125

SEQ ID NO: 189998 - RNA, 1701 nt, Artificial Sequence; identical to SEQ ID NO: 189879
  derived and/or modified sequence opt5 from hemagglutinin__InfluenzaA__AEK29136

SEQ ID NO: 189999 - RNA, 1701 nt, Artificial Sequence; identical to SEQ ID NO: 189879
  derived and/or modified sequence opt5 from hemagglutinin__InfluenzaA__AEK29169

SEQ ID NO: 190000 - RNA, 1701 nt, Artificial Sequence; identical to SEQ ID NO: 189879
  derived and/or modified sequence opt5 from hemagglutinin__InfluenzaA__AEK29180

SEQ ID NO: 190001 - RNA, 1701 nt, Artificial Sequence; identical to SEQ ID NO: 189879
  derived and/or modified sequence opt5 from hemagglutinin__InfluenzaA__AEK29191

SEQ ID NO: 190002 - RNA, 1701 nt, Artificial Sequence; identical to SEQ ID NO: 189879
  derived and/or modified sequence opt5 from hemagglutinin__InfluenzaA__AEK29202

SEQ ID NO: 190003 - RNA, 1701 nt, Artificial Sequence; identical to SEQ ID NO: 189879
  derived and/or modified sequence opt5 from hemagglutinin__InfluenzaA__AEK29213

SEQ ID NO: 190004 - RNA, 1701 nt, Artificial Sequence; identical to SEQ ID NO: 189879
  derived and/or modified sequence opt5 from hemagglutinin__InfluenzaA__AEK29224

SEQ ID NO: 190005 - RNA, 1701 nt, Artificial Sequence; identical to SEQ ID NO: 189879
  derived and/or modified sequence opt5 from hemagglutinin__InfluenzaA__AEK29235

SEQ ID NO: 190006 - RNA, 1701 nt, Artificial Sequence
  derived and/or modified sequence opt5 from hemagglutinin__InfluenzaA__AEK29268
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccucuggacgcauuacaguuuccaccaagagaagccagcaggcugugaucccgaauauuggcucccggccccgcgucagaaacaucccuucucgggugagcaucuauuggacaauugugaaacccggggacauccugcugauuaauuccaccggaaaccucaucgccccucgcggcuacuucaagauuagaagcgggaaaucuuccaucaugcggagcgaugcucccaucggaaaguguaauucugccugcauuaccccgaacggcagcaucccuaaugacaagcccuuucagaacgucaaucgcauuacauacggcgcguguccuagauauguuaaacaaaacacgcugaaacuugccaccgggaugcggaaugugcccgaaaaacagacacgcggaaucuucggcgcuauugccggguuuaucgagaacggaugggaaggcaugguggacgggugguacggauucagacaccaaaauuccgagggccggggccaggcugccgaucugaagucuacccaggccgcuaucgaccagauuaacgggaaacucaacagacugaucggaaagacaaaugagaaauuccaucagauugaaaaggaguuuagcgaagucgagggccgcauccaagaucuugaaaaguauguggaggacaccaaaauugaucugugguccuacaacgcggagcuccugguugcccuggaaaaucagcacacgaucgaccucacagauagcgagaugaacaagcuguucgaaaagaccaagaaacagcuucgggagaaugcugaagacauggggaacggaugcuuuaagauuuaucauaagugugauaaugccugcaucggcucuaucagaaacgggaccuacgaccacgauguguaucgcgacgaggcccugaauaaccgguuccagauuaaaggcgucgagcucaaguccggauacaaagacuggauccuguggauuagcuuugcuaucucuugcuuccuucuguguguggcccuccugggcuuuauuaugugggcgugccaaaaggggaauaucagauguaacaucugcauuuga

SEQ ID NO: 190007 - RNA, 1698 nt, Artificial Sequence
  derived and/or modified sequence opt5 from hemagglutinin__InfluenzaA__AEK59838
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaagccggaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcaaauccagcuuuuauaagaaccugcuuuggcugacaggcaaaaaugggcucuaccccaaccugucuaaguccuaugcuaauaacaaagaaaaggaggugcugguccucuggggagugcaccacccuccgaauaucggcgaccagaaggcccuguaccauaccgaaaacgcuuacgugagcgucguuuccucucacuauagcaaaaaguucacacccgagauugccaaacgcccuaaggugagagaucaggaagggcggaucaacuacuauuggacccuucuggagcccggaaauacgauuaucuuugaggcgaacggcaaucucauugccccucgcuacgcuuucgcccuguccagaggguuuggaagcggcaucauuaacucuaaugcucccauggacaaaugugaugccaagugccagacaccgcaaggcgcgaucaacuccagccuuccuuuccagaaugugcaucccgucaccaucggggaauguccuaaauaugugcggucugccaagcugcgcaugguuacaggacucagaaacauucccagcauccagucccggggccuguuuggggcuauugccggauucaucgagggcggguggaccggaaugguggacggcugguacggcuaucaccaccagaaugaacaagggucuggauacgcugccgaucaaaagagcacccagaacgccauuaauggcaucacaaacaaagucaauuccgugaucgagaagaugaacacgcaguuuaccgcuguugggaaagaguucaauaagcuggaacgcagaauggagaaccucaacaaaaagguggacgauggauucauugacaucuggacauacaaugcggaacugcuuguccugcucgagaacgaacggacccuggacuuucaugauagcaaugugaagaaccuuuaugagaaagucaagucucagcugaaaaauaacgccaaggaaauuggcaaugggugcuucgaguuuuaccacaaauguaacgacgagugcauggaauccgugaagaauggcacauaugauuaccccaaguauagcgaggaaucuaaacucaaccgcgagaagaucgacggaguuaaacuggaguccaugggcguguaccagauucuggcuaucuauagcaccgucgccuccucucucgugcugcuuguuagccugggggccaucuccuucuggaugugcucuaauggaagccuccaguguagaauuugcaucuga

SEQ ID NO: 190008 - RNA, 1701 nt, Artificial Sequence
  derived and/or modified sequence opt5 from hemagglutinin__InfluenzaA__AEK98378
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagaaauucgacaagcuguacauuuggggcgugcaccauccugggacggauaaugaccagaucuuuccguaugcgcaggccucuggacgcauuacaguuuccaccaaaagaagccaacagacagugauccccaacauuggcucccggccucgcgucagaaauauccccucucggaucagcauuuacuggaccaucgugaagccuggggauauucuccugaucaacuccaccggaaaucugauugcuccccgcggcuacuucaaaauccagagcgggaagucuuccaucaugagaagcgacgccccgauuggaaaguguaacucugaaugcaucacaccuaauggcagcauucccaacgacaaaccuuuucagaaugugaaccggaucacguauggcgcuuguccccgcuacgucaagcaaaauacccucaaacuggccacagggaugagaaacguucccgagaagcagacccggggaauuuucggcgcgaucgccggguuuaucgaaaauggaugggagggcaugguggaugggugguauggauuccgccaccagaacuccgagggcauuggccaagcugccgaccuuaaaucuacacaggcugccaucgaucagauuaaugggaagcugaacagacucaucggaaaaaccaacgaaaaguuccaccagauugagaaggaauuuagcgagguggaaggccggauccaagaccuggagaaauacgucgaggauacgaagauugaccuuugguccuauaaugccgaacugcucguggcucuggagaaccagcauacaaucgaucugaccgacagcgaaaugaauaaacucuucgagaagaccaaaaagcagcugagagaaaacgcggaggauauggggaauggaugcuuuaagaucuaccacaaaugugacaacgccugcauuggcucuauccgcaaugggacauaugaucaugacguuuaccgggacgaggcucuuaacaauagauuccagauuaagggcguggaacugaaauccggauacaaggauuggauccucuggauuagcuuugccaucucuugcuuccugcuuugugucgcccugcucggcuuuaucaugugggcuugccaaaaagggaacauucgcuguaauaucugcauuuga

SEQ ID NO: 190009 - RNA, 1701 nt, Artificial Sequence; identical to SEQ ID NO: 184939
  derived and/or modified sequence opt5 from hemagglutinin__InfluenzaA__AEK98380

SEQ ID NO: 190010 - RNA, 1701 nt, Artificial Sequence
  derived and/or modified sequence opt5 from hemagglutinin__InfluenzaA__AEK98382
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgagaucugcgacuccccgcaccagauccuugauggggaaaacuguacccugauugacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacgcuugaauuuaauaacgagagcuucaauuggaccggagugacacagaacggcaccucuuccgcuugcauccgcagaagcaauaacuccuuuuucucucggcugaauuggcucacacaucugaaguuuaaguauccugcccuuaacgucaccaugcccaacaaugagaaauucgacaagcuguacauuuggggcgugcaccauccugggacggauaacgaccagaucuuucucuaugcgcaggccagcggacgcauuacaguuucuaccaaaagaucccaacagacagugaucccgaauauuggcagccggccccgcaucagaaacaucccuucccggauuucuaucuacuggaccauugucaagcccggggauauccugcugauuaauagcaccggaaaccucaucgcuccucgcggcuacuucaaaauccagauugggaaguccagcaucaugagaucugacgcccccauuggaaaguguaauuccgaaugcaucacaccgaacggcagcauuccuaaugacaaacccuuucagaacgugaaucggaucacguauggcgcuuguccucgcuacgugaagcaaaacacccugaaacuugccacagggaugagaaauguccccgagaagcagacccggggaaucuucggcgcgauugccggguuuaucgaaaacggaugggagggcaugguugaugggugguauggauuccgccaccaaaauucugagggcauuggccaggcugccgaccugaaaagcacacaggcugccaucgaucagauuaacgggaagcucaacagacugaucggaaaaaccaaugaaaaguuccaccagauugagaaggaauuuuccgagguggaaggccggauccaagaccuugagaaauacguggaggauacgaagaucgaccuguggucuuauaacgccgaacuccuggucgcucuggagaaucagcauacaauugaucucaccgacagcgaaaugaacaaacuguucgagaagaccaaaaagcagcuuagagaaaaugcggaggauauggggaacggaugcuuuaagaucuaccacaaaugugacaaugccugcauuggcuccauccgcaacgggacauaugaucaugacguguaccgggacgaggcucugaauaacagauuccagauuaagggcguugaacucaaaagcggauacaaggauuggauccuguggaucucuuuugccauuuccugcuuccuucuguguguggcccuccugggcuuuaucaugugggcuugccaaaaagggaauauucgcuguaacaucugcauuuga

SEQ ID NO: 190011 - RNA, 1701 nt, Artificial Sequence
  derived and/or modified sequence opt5 from hemagglutinin__InfluenzaA__AEK98386
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccucuggacgcauuacaguuuccaccaagagaagccagcaggcugugaucccgaauauuggcucccggacacgcgucagaaacauccccucucgggugagcaucuauuggaccauugugaaaccuggggacauccugcugauuaauuccaccggaaaccucaucgcuccccgcggcuacuucaagauuagaagcgggaaaucuuccaucaugcggagcgaugccccuaucggaaaguguaauucugccugcauuacacccaacggcagcaucccgaaugacaagccuuuucagaacgucaaucgcauuacguacggcgcgugucccagauauguuaaacaaaacacccugaaacuugccacagggaugcggaaugugccugaaaaacagacccgcggaaucuucggcgcuauugccggguuuaucgagaacggaugggaaggcaugguggacgggugguacggauucagacaccaaaauuccgagggccggggccaggcugccgaucugaagucuacacaggccgcuaucgaccagauuaacgggaaacucaacagacugaucggaaagaccaaugagaaauuccaucagauugaaaaggaguuuagcgaagucgagggccgcauccaagaucuugaaaaguauguggaggacacgaaaauugaucugugguccuacaacgcggagcuccugguugcccuggaaaaucagcacacaaucgaccucaccgauagcgagaugaacaagcuguucgaaaagaccaagaaacagcuucgggagaaugcugaagacauggggaacggaugcuuuaagauuuaucauaagugugauaaugccugcaucggcucuaucagaaacgggacauacgaccacgauguguaucgcgacgaggcccugaauaaccgguuccagauuaaaggcgucgagcucaaguccggauacaaagacuggauccuguggauuagcuuugcuaucucuugcuuccuucuguguguggcccuccugggcuuuauuaugugggcgugccaaaaggggaauaucagauguaacaucugcauuuga

SEQ ID NO: 190012 - RNA, 1701 nt, Artificial Sequence
  derived and/or modified sequence opt5 from hemagglutinin__InfluenzaA__AEK98388
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggccugcaaaacaagaaaugggaucucuuugucgaaagaagcaaggccuauuccaauuguuacccuuaugacgugcccgauuacgcuucucugcggagccuuguugccuccagcgggacgcuggaguucaacaaugaaucuuuuaacuggaccggagugacacagaauggcaccuccagcgcuugcauccgcagaucuaagaacuccuucuuuagccggcucaauuggcugacacaucuuaacuucaaauauccugcccugaaugucaccaugcccaacaacgagcaguuugacaagcucuacauuuggggcgugcaccauccugggacggauaaagaccagaucuuccuguaugcgcaagccucuggacgcauuacaguuuccaccaagagaagccagcagacagcuaucccgaauauuggcucccggccccgcgugagaaacaucccuucucggaucagcauuuacuggaccaucgucaaacccggggauauucugcucaucaauuccaccggaaaccugauugccccucgcggcuacuuuaagaucagaagcgggaagucuuccaucaugcggagcgacgcucccauuggaaaauguaauucugagugcaucacaccgaacggcagcauuccuaaugacaagcccuuccagaacgugaaucgcaucacguauggcgccuguccuagauacgugaaacaaaacacccuuaagcuggcgacagggaugcggaauguccccgaaaaacagacccgcggaauuuuuggcgccaucgcuggguucaucgagaacggaugggaaggcaugguugaugggugguauggauuuagacaccaaaauuccgagggccggggccaggccgcugaccucaagucuacacaggccgccauugaucagaucaacgggaaacugaauagacuuauuggaaagaccaacgagaaguuccaccagaucgaaaaagaguucagcgaaguggagggccgcauucaagaccuggaaaaguacguggaggauacgaaaaucgaccucugguccuauaacgcugagcugcuggucgcgcucgaaaaucagcauacaauugaucugaccgacagcgagaugaacaaacuuuuugaaaagaccaagaagcagcugcgggagaaugccgaagauauggggaacggaugcuucaaaaucuaccacaagugugacaaugcuugcaucggcucuauuagaaacgggacauaugaucaugacguguaccgcgacgaggcccucaauaaccgguuucagaucaaaggcguugagcugaaguccggauacaaagauuggauucuuuggaucagcuucgccauuucuugcuuucugcucuguguggcucugcugggcuucaucaugugggccugccaaaaggggaauaucagauguaacauuugcaucuga

SEQ ID NO: 190013 - RNA, 1701 nt, Artificial Sequence
  derived and/or modified sequence opt5 from hemagglutinin__InfluenzaA__AEK98390
augaagaccaucauugcccugagcuacauccucugccugguguucgcucaggagcuucccggcaacgacaauuccacagccacgcugugucucgggcaccaugcggucccuaacggaaccauuguuaaaacaaucaccaaugaucaaauugaagugacaaacgcuaccgagcuggugcagucuagcuccacaggcgaaaucugcaauucuccgcaccagauccuugacggggagaacuguacccugauugaugcccuccugggagacccccagugcgauggcuuucaaaauaagaaaugggaccuguucgucgaaagaagcaaggcccauuccaacuguuauccuuacgaugugcccgacuaugcuucucuccggagccugguugccuccagcgggacgcuugaguuuaauaacgagucuuucaauuggaccggagugacacagaacggcaccuccagcgcuugcauccgcagaucuaauaacuccuuuuucagccggcugaauuggcucacacaccugaacuuuaaauacccugcccuuaacgucaccaugcccaauaacgaacaguucgauaagcuguauauuuggggcgugcaucacccugggacggacaaggaucagaucuuucucuacgcgcaagccucuggacgcauuacaguuuccaccaaaagaagccagcaggcugugaucccgaauauuggcucccggccccgcgucagaaacaucccuucucgggugagcaucuauuggacaauugugaagcccggggacauccugcugauuaauuccaccggaaaccucaucgccccucgcggcuacuucaaaauuagaagcgggaagucuuccaucaugcggagcgaugcucccaucggaaaauguaagucugccugcauuaccccgaauggcagcaucccuaacgacaagacauuucagaaugucaaccgcauuacguacggcgcgugucccagauauguuaaacaaaauacccugaaacuugccacagggaugcggaacgugccugagaagcagacccgcggaaucuucggcgcuauugccggguuuaucgaaaauggaugggagggcaugguggacgggugguacggauucagacaccagaacuccgagggccggggccaagcugccgaucugaagucuacacaggccgcuaucgaccagauuaaugggaaacucaacagacugaucggaaagaccaacgaaaaauuccaucagauugagaaggaauuuagcgaggucgaaggccgcauccaagaucuugagaaguauguggaggacacgaaaauugaucugugguccuacaaugcggaacuccugguugcccuggagaaccagcacacaaucgaccucaccgauagcgaaaugaauaagcuguucgagaaaaccaagaaacagcuucgggaaaacgcugaggacauggggaauggaugcuuuaagauuuaucauaagugugauaacgccugcaucggcucuaucagaaaugggacauacgaccacgauguguaucgcgacgaggcccugaacaaucgguuccagauuaaaggcgucgaacucaaguccggauacaaagacuggauccuguggauuagcuuugcuaucucuugcuuccuucuguguguggcccuccugggcuuuauuaugugggcgugccaaaaggggaacaucagauguaauaucugcauuuga

SEQ ID NO: 190014 - RNA, 1701 nt, Artificial Sequence
  derived and/or modified sequence opt5 from hemagglutinin__InfluenzaA__AEK98392
augaagaccaucauugcccugagcuacauccucugccugguguucgcucagaaacuucccggcaacgacaauuccacagccacgcugugucucgggcaccaugcggucccuaacggaaccauuguuaagacaaucaccgaugaccaaauugaggugacaaaugcuaccgaacuggugcagucuagcuccacaggcgagaucugcaacucuccgcaccagauccuugauggggaaaauuguacccugauugacgcccuccugggagauccccagugcgacggcuuucaaaacaaaaagugggaucuguucgucgagagaagcaaagcccauuccaauuguuauccuuacgacgugcccgauuaugcuucucuccggagccugguugccuccagcgggacgcuugaauuuaacaaugagaacuucaauuggaccggagugacacagaacggcaccucuuccgcuugcauccgcagaagcaauaacuccuuuuucucucggcugaauuggcucacacaccugaacuuuaaguacccugcccuuaacgucaccaugcccaauaacgagcaguucgacaagcuguauauuuggggcgugcaucacccugggacggauaaagaccagaucuuucucuacgcgcaagccagcggacgcauuacaguuucuaccaagagaucccagcaggcugugaucccgaauauuggcagccggcugcgcgucagaaacauccccucccgggugucuaucuauuggacaauugugaaaccuggggauauccugcucauuaauagcaccggaaaccugaucgcuccccgcggcuacuucaagauuagauccgggaaaagcucuaucaugcgguccgacgccccuaucggaaaguguaauagcgccugcauuacccccaacggcucuaucccgaaugacaagccuuuucagaacgucaaucgcauuacauacggcgcgugucccagauauguuaaacaaaacacgcuuaagcuggccaccgggaugcggaaugugccugaaaaacagacacgcggaaucuucggcgcuauugccggguuuaucgagaacggaugggaaggcaugguggaugggugguacggauucagacaccagaauagcgagggccggggccaagcugccgaccucaaguccacccaggccgcuaucgaucagauuaacgggaaacugaacagacuuaucggaaagacaaaugagaaauuccaucagauugaaaaggaguuuucugaagucgagggccgcauccaagaccuggaaaaguauguggaggauaccaaaauugaccucuggagcuacaacgcggagcugcugguugcccucgaaaaucagcacacgaucgaucugacagacuccgagaugaacaaacuuuucgaaaagaccaagaaacagcugcgggagaaugcugaagauauggggaacggaugcuuuaagauuuaucauaagugugacaaugccugcaucggcagcaucagaaacgggaccuacgaucacgacguguaucgcgacgaggcccucaauaaccgguuccagauuaaaggcgucgagcugaagucuggauacaaagauuggauccuuuggauuuccuuugcuaucagcugcuuccugcucuguguggcccugcugggcuuuauuaugugggcgugccaaaaggggaauaucagauguaacaucugcauuuga

SEQ ID NO: 190015 - RNA, 1701 nt, Artificial Sequence
  derived and/or modified sequence opt5 from hemagglutinin__InfluenzaA__AEK98394
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccucuggacgcauuacaguuuccaccaagagaagccagcaggcugugaucccgaauauuggcucccggcugcgcgucagaaacauccccucucgggugagcaucuauuggacaauugugaaaccuggggacauccugcucauuaauuccaccggaaaccugaucgcuccccgcggcuacuucaagauuagaagcgggaaaucuuccaucaugcggagcgaugccccuaucggaaaguguaauucugccugcauuacccccaacggcagcaucccgaaugacaagccuuuucagaacgucaaucgcauuacauacggcgcgugucccagauauguuaaacaaaacacgcuuaagcuggccaccgggaugcggaaugugccugaaaaacagacacgcggaaucuucggcgcuauugccggguuuaucgagaacggaugggaaggcaugguggacgggugguacggauucagacaccaaaauuccgagggccggggccaggcugccgaucucaagucuacccaggccgcuaucgaccagauuaacgggaaacugaacagacuuaucggaaagacaaaugagaaauuccaucagauugaaaaggaguuuagcgaagucgagggccgcauccaagaucuggaaaaguauguggaggacaccaaaauugaucucugguccuacaacgcggagcugcugguugcccucgaaaaucagcacacgaucgaccugacagauagcgagaugaacaaacuuuucgaaaagaccaagaaacagcugcgggagaaugcugaagacauggggaacggaugcuuuaagauuuaucauaagugugauaaugccugcaucggcucuaucagaaacgggaccuacgaccacgauguguaucgcgacgaggcccucaauaaccgguuccagauuaaaggcgucgagcugaaguccggauacaaagacuggauccuuuggauuagcuuugcuaucucuugcuuccugcucuguguggcccugcugggcuuuauuaugugggcgugccaaaaggggaauaucagauguaacaucugcauuuga

SEQ ID NO: 190016 - RNA, 1701 nt, Artificial Sequence
  derived and/or modified sequence opt5 from hemagglutinin__InfluenzaA__AEK98396
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaaguccuuuuucagccggcugaauuggcucacacaucugaaguuuaaauauccugcccuuaacgucaccaugcccaauaacgagcaguucgacaagcuguacauuuggggcgugcaccauccugggacggauaacgaccagaucucucucuaugcgcaagccuccggacgcauuacaguuagcaccaaaagaucccagcagacagugaucccgaauauuggcucucggccccgcgucagaaacaucccuagccggaucuccauuuacuggaccaucgugaagcccggggauauucugcugaucaauagcaccggaaaccucauugcuccucgcggcuacuuuaaaaucagaucugggaaguccagcaucaugcggucugacgcccccauuggaaaguguaauagcgaaugcaucacaccgaacggcuccauuccuaaugacaaacccuuccagaacgugaaucgcaucacguauggcgcuuguccuagauacgucaagcaaaacacccugaaacuugccacagggaugcggaauguucccgagaagcagacccgcggaauuuuuggcgcgaucgccggguucaucgaaaacggaugggagggcaugguggaugggugguauggauuuagacaccaaaauucugagggccggggccaggcugccgaccugaaaagcacacaggcugccauugaucagaucaacgggaagcucaauagacugauuggaaaaaccaacgaaaaguuccaccagaucgagaaggaguucuccgaaguggaaggccgcauucaagaccuugagaaauacgucgaggauacgaagaucgaccuguggagcuauaacgccgaacuccugguggcucuggagaaucagcauacaauugaucucaccgacucugaaaugaacaaacuguuugagaagaccaaaaagcagcuucgggaaaaugcggaggauauggggaacggaugcuucaagaucuaccacaaaugugacaaugccugcaucggcuccauuagaaacgggacauaugaucaugacguuuaccgcgacgaggcucugaauaaccgguuucagaucaagggcguggaacucaaaagcggauacaaggauuggauucuguggaucucuuucgccauuuccugcuuucuucuguguaucgcccuccugggcuucaucaugugggcuugccaaaaagggaauauuagauguaacaucugcauuuga

SEQ ID NO: 190017 - RNA, 1701 nt, Artificial Sequence
  derived and/or modified sequence opt5 from hemagglutinin__InfluenzaA__AEK98398
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggccugcaaaacaagaaaugggaucucuuugucgaaagaagcaaggccuauuccaauuguuacccuuaugacgugcccgauuacgcuucucugcggagccuuguugccuccagcgggacgcuggaguucaacaaugaaucuuuuaacuggaccggagugacacagaauggcaccuccagcgcuugcauccgcagaucuaagaacuccuucuuuagccggcucaauuggcugacacaucuuaacuucaaauauccugcccugaaugucaccaugcccaacaacgagcaguuugacaagcucuacauuuggggcgugcaccauccugggacggauaaagaccagaucuuccuguaugcgcaagccucuggacgcauuacaguuuccaccaagagaagccagcagacagcuaucccgaauauuggcucccggccccgcgugagaaacaucccuucucggaucagcauuuacuggaccaucgucaaacccggggauauucugcucaucaauuccaccggaaaccugauugccccucgcggcuacuuuaagaucagaagcgggaagucuuccaucaugcggagcgacgcucccauuggaaaauguaauucugagugcaucacaccgaacggcagcauuccuaaugacaagcccuuccagaacgugaaucgcaucacguauggcgccuguccuagauacgugaaacaaaacacccuuaagcuggcgacagggaugcggaauauucccgaaaaacagacccgcggaaucuuuggcgccaucgcuggguucauugagaacggaugggaaggcauggucgaugggugguauggauuuagacaccaaaauuccgagggccggggccaggccgcugaccucaagucuacacaggccgccaucgaucagauuaacgggaaacugaauagacuuaucggaaagaccaacgagaaguuccaccagauugaaaaagaguucagcgaaguugagggccgcauccaagaccuggaaaaguacguggaggauacgaaaauugaccucugguccuauaacgcugagcugcugguggcgcucgaaaaucagcauacaaucgaucugaccgacagcgagaugaacaaacuuuuugaaaagaccaagaagcagcugcgggagaaugccgaagauauggggaacggaugcuucaaaaucuaccacaagugugacaaugcuugcauuggcucuaucagaaacgggacauaugaucaugacgucuaccgcgacgaggcccucaauaaccgguuucagauuaaaggcguggagcugaaguccggauacaaagauuggaucauuuggaucagcuucgccaucucuugcuuucuucuguguguugcucuccugggcuucauuaugugggccugccaaaaggggaauaucagauguaacauuugcaucuga

SEQ ID NO: 190018 - RNA, 1701 nt, Artificial Sequence
  derived and/or modified sequence opt5 from hemagglutinin__InfluenzaA__AEK98400
auggagaccaucauugcccugagcuacauccucucccugguguucgcucagaagcugcccggcaacgacaauucuacagccacgcugugccucgggcaccaugcggucccuaacggaaccauuguuaaaacaaucaccaaugaucaaauugaagugacaaacgcuaccgagcuggugcagagcuccucuacaggcgaaaucugugacagcccgcaccagauccuugauggggagaauugcacccugauugacgcccuccugggagauccccagugugacggcuuucaaaacaagaaaugggaucuguucgucgaaagauccaaggccuauucuaauugcuacccuuaugacgugcccgauuacgcuagccuccggucccugguugccagcucugggacgcuugaguuuaacaaugagaacuucaauuggaccggagugacacagaacggcaccuccagcgcuuguauccgcagaucuaauaacuccuuuuucagccggcugaauuggcucacacaucugcgcuuuaaauauccugcccuuaacgucaccaugcccaacaaugaagaguucgacaagcuguacauuuggggcgugcaccauccugggacggauaacgaccagaucuuucucuaugcgcaggccucuggaagaauuacaguuuccaccaagcggagccaacagacagugaucccgaauauuggcucccgccccagaguccggaacaucccuucucgcaucagcauuuacuggaccaucgugaaacccggggauauucugcugaucaauuccaccggaaaccucauugcuccuagaggcuacuucaagauccggagcgggaaaucuuccaucaugcgcagcgacgcccccauuggaaagugcucuagcgaauguaucacaccgaauggcuccauuccuaacgacaaacccuuucagaaugugaacagaaucacguauggcgcuugcccucgguacgucaagcagaauacccugaaacuugccacagggaugcgcaacguucccgagaagcaaaccagaggaauuuucggcgcgaucgccggguuuaucgagaauggaugggaaggcaugguggaugggugguauggauuccggcaccagaacucugagggcauuggccaggcugccgaccuuaagagcacacaagcugccaucgaucagauuaaugggaaacucaacagacugaucggaaagaccaacgaaaaauuccaccagauugagaaggaauuuuccgagaucgagggccgcauucaggaccuugaaaaauacguggaggauacgaagaucgaccuguggagcuauaaugccgaacuccuggucgcucuggagaaccaacauacaaucgaucucaccgacucugaaaugaauaagcuguucgagaaaaccaagaaacagcuucgggagaacgcggaagauauggggaauggauguuuuaagauuuaccacaaaugcgacaacgccuguaucggcuccauuagaaaugggacauaugaucaugacguguaccgcgacgaggcucugaacaaucgguuccagaucaagggcguugaacucaagagcggauacaaagauuggauucuguggaucucuuuugccaucuccugcuuccuucugugcguggcccuccugggcuuuauuaugugggcuugucagaaggggaacaucagaugcaauauuuguaucuga

SEQ ID NO: 190019 - RNA, 1701 nt, Artificial Sequence
  derived and/or modified sequence opt5 from hemagglutinin__InfluenzaA__AEK98402
augaagaccaucauugcccugagcuacauccucugccugggcuucgcucagaaacuucccgggaacgacaauuccacagccacgcugugucucggacaccaugcggugccuaacggcaccauugucaagacaaucaccaaugaucaaauugagguuacaaacgcuaccgaacuggugcagucuagcuccacaggggagaucugcgacucuccgcaccagauccuugaugggaaaaauuguacccugauugacgcccuccugggcgauccccagugcgacggguuucaaaacaagaaaugggaucuguucguggaaagaagcaaggccuauuccaauuguuacccuuaugacguccccgauuacgcuucucuccggagccugguggccuccagcggaacgcuugaguuuaacaaugaaucuuucaacuggaccggcguuacacagaauggcaccuccagcgcuugcauccgcagaucuaagaacuccuuuuucagccggcugaauuggcucacacaucugaacuuuaaauauccugcccuuaaugugaccaugcccaacaacgagcaguucgacaagcuguacauuuggggaguccaccauccuggaacggauaaagaccagaucuuucucuaugcgcaagccucuggccgcauuacaguguccaccaagagaagccagcagacagcuaucccgaauauugggucccggccccgcguuagaaacaucccuucucggaucagcauuuacuggaccaucgugaaacccggagauauucugcugaucaauuccaccggcaaccucauugccccucgcggguacuucaagaucagaagcggaaagucuuccaucaugcggagcgacgcucccauuggcaaauguaauucugagugcaucacaccgaacggcagcauuccuaaugacaagcccuuucagaacgucaaucgcaucacguauggggccuguccuagauacgugaaacaaaacacccugaaacuugcgacaggaaugcggaaugugcccgaaaaacagacccgcggcauuuucggggccaucgcuggauuuaucgagaacggcugggaagggauggucgauggaugguauggcuucagacaccaaaauuccgagggccgggggcaggccgcugaccugaagucuacacaggccgccauuaaccagaucaauggaaaacucaacagacugauuggcaagaccaacgagaaguuccaccagaucgaaaaagaguuuagcgaaguugaggggcgcauucaagaucuugaaaaguacguggaggacacgaaaaucgaucugugguccuauaaugcugagcuccugguggcgcuggaaaaccagcauacaauugaccucaccgauagcgagaugaauaagcuguucgaaaagaccaagaagcagcuucgggagaacgccgaagacaugggaaauggcugcuuuaaaaucuaccacaagugugauaacgcuugcaucgggucuauuagaaauggcacauaugaccaugaugucuaccgcgacgaggcccugaacaaucgguuccagaucaaaggaguggagcucaaguccggcuacaaagacuggauucuguggaucagcuuugccauuucuugcuuccuucuguguguugcucuccugggguuuaucaugugggccugccaaaagggaaacaucagauguaauauuugcaucuga

SEQ ID NO: 190020 - RNA, 1701 nt, Artificial Sequence
  derived and/or modified sequence opt5 from hemagglutinin__InfluenzaA__AEK98404
augaagaccaucauugcccugagcuacauccucucccugguguucgcucagaaacuucccggcaacgacaauucuacagccacgcugugccucgggcaccaugcggucccuaacggaaccauuguuaagacaaucaccaaugaucaaauugaggugacaaacgcuaccgaacuggugcagagcuccucuacaggcgagaucugugacagcccgcaccagauccuugauggggaaaauugcacccugauugacgcccuccugggagauccccagugugacggcuuucaaaacaaaaagugggaucuguucgucgagagauccaaagccuauucuaauugcuacccuuaugacgugcccgauuacgcuagccuccggucccugguugccagcucugggacgcuugaauuuaacaaugagaacuucaauuggaccggagugacacagaacggcaccuccagcgcuuguauccgcagaucuaauaacuccuuuuucagccggcugaauuggcucacacaucugcgcuuuaaguauccugcccuuaacgucaccaugcccaacaaugaggaguucgacaagcuguacauuuggggcgugcaccauccugggacggauaacgaccagaucuuucucuaugcgcaggccucuggaagaauuacaguuuccaccaaacggagccaacagacagugaucccgaauauuggcucccgccccagaguccggaacaucccuucucgcaucagcauuuacuggaccaucgugaagcccggggauauucugcugaucaauuccaccggaaaccucauugcuccuagaggcuacuucaaaaugcggagcgggaagucuuccaucaugcgcagcgacgcccccaucggaaaaugcaauucugaauguauuacaccgaacggcagcaucccuaaugacaagcccuuucagaacgugaauagaauuacguauggcgcuugcccucgguacgucaagcagaacacccugaaacuugccacagggaugcgcaauguucccgaaaagcaaaccagaggaaucuucggcgcgauugccggguuuaucgagaacggaugggagggcaugguggaugggugguauggauuccggcaccaaaauuccgaaggcaucggccaggcugccgaccugaaaucuacacaggcugccauugaucagaucaacgggaagcucaacagacugauuggaaaaaccaaugagaaguuccaccagaucgaaaaagaguuuagcgaaguggagggccgcauucaggaccuugagaaguacgucgaagauacgaagaucgaccugugguccuauaacgccgagcuccugguggcucuggaaaaucaacauacaauugaucucaccgacagcgagaugaacaaacuguucgaaaagaccaaaaagcagcuucgggagaaugcggaggauauggggaacggauguuuuaaaaucuaccacaagugcgacaaugccuguaucggcucuauuagaaacgggacauaugaucaugacguuuaccgcgacgaagcucugaauaaccgguuccagaucaagggcguggagcucaaauccggauacaaggauuggauucuguggaucagcuuugccauuucuugcuuccuucugugcgucgcccuccugggcuuuaucaugugggcuugucagaaagggaauaucagaugcaacauuuguaucuga

SEQ ID NO: 190021 - RNA, 1701 nt, Artificial Sequence
  derived and/or modified sequence opt5 from hemagglutinin__InfluenzaA__AEK98406
augaagaccaucauugcccugagcuacauccucucccugguguucgcucagaaacuucccggcaacgacaauucuacagccacgcugugccucgggcaccaugcggucccuaacggaaccauuguuaagacaaucaccaaugaucaaauugaggugacaaacgcuaccgaacuggugcagagcuccucuacaggcgagaucugugacagcccgcaccagauccuugauggggaaaauugcacccugauugacgcccuccugggagauccccagugugacggcuuucaaaacaaaaagugggaucuguucgucgagagauccaaagccuauucuaauugcuacccuuaugacgugcccgauuacgcuagccuccggucccugguugccagcucugggacgcuugaauuuaacaaugagaacuucaauuggaccggagugacacagaacggcaccuccagcgcuuguauccgcagaucuaauaacuccuuuuucagccggcugaauuggcucacacaucugcgcuuuaaguauccugcccuuaacgucaccaugcccaacaaugaggaacuggacaagcucuacauuuggggcgugcaccauccugggacggauaacgaccagaucuuccuguaugcgcaggccucuggaagaauuacaguuuccaccaaacggagccaacagacagugaucccgaauauuggcucccgccccagaguccggaacaucccuucucgcaucagcauuuacuggaccaucgugaagcccggggauauucugcucaucaauuccaccggaaaccugauugcuccuagaggcuacuuuaaaauccggagcgggaagucuuccaucaugcgcagcgacgcccccauuggaaaaugcaauucugaguguaucacaccgaacggcagcauuccuaaugacaagcccuuccagaacgugaauagaaucacguauggcgcuugcccucgguacgucaagcagaacacccuuaaacuggccacagggaugcgcaauguucccgaaaagcaaaccagaggaauuuuuggcgcgaucgccggguucaucgagaacggaugggagggcaugguggaugggugguauggauuucggcaccaaaauuccgaaggcauuggccaggcugccgaccucaaaucuacacaggcugccaucgaucagauuaacgggaagcugaacagacuuaucggaaaaaccaaugagaaguuccaccagauugaaaaagaguucagcgaaguggagggccgcauccaggaccuggagaaguacgucgaagauacgaagauugaccucugguccuauaacgccgagcugcugguggcucucgaaaaucaacauacaaucgaucugaccgacagcgagaugaacaaacuuuuugaaaagaccaaaaagcagcugcgggagaaugcggaggauauggggaacggauguuucaaaaucuaccacaagugcgacaaugccuguauuggcucuaucagaaacgggacauaugaucaugacguuuaccgcgacgaagcucucaauaaccgguuucagauuaagggcguggagcugaaauccggauacaaggauuggauccuuuggauuagcuucgccaucucuugcuuucugcucugcgucgcccugcugggcuucgugaugugggcuugucagaaagggaauaucagaugcaacauuuguaucuga

SEQ ID NO: 190022 - RNA, 1701 nt, Artificial Sequence
  derived and/or modified sequence opt5 from hemagglutinin__InfluenzaA__AEL11687
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcucuugcaagcgcagauccaacaauagcuuuuucucucggcugaacuggcucacacaucugaaguuuaaauauccugcucuuaaugucaccaugcccaacaacgagaaguucgacaaacuguacaucuggggagugcaccauccuguuacggauaaugaccagauucgccucuaugcccaggcguccgggagaaucacagugagcaccaagcggucccaacagacagucauuccgaacaucggcuaccgccccagagugcgggauauuccuucucgcaucagcaucuacuggaccauugugaaacccggggacauccugcugauuaauuccaccggaaaccucaucgccccuagaggcuauuuuaagauucggagcgggaagucuuccaucaugcgcagcgacgcucccaucggaaaauguaauucugagugcauuacaccgaacggcagcaucccuaaugauaagcccuuccagaacgucaauagaauuacguacggcgccuguccucgguauguuaaacagaacacccugaaacuugcuacagggaugcgcaaugugcccgaaaagcaaaccagaggaaucuuuggcgccauugcgggguucaucgagaacggaugggaaggcaugguggacgggugguacggauuucggcaccaaaauuccgagggcaucggccaggccgcugaucugaagucuacacaggccgcuauuaaccagaucaaugggaaacucaacagacugauuggaaagaccaacgagaaguuccaccagaucgaaaaagaguucagcgaagucgagggccgcauucaggaccuugaaaaguauguggaggauacgaaaaucgaccugugguccuacaaugccgagcuccugguugcccuggaaaaccaacauacaauugaucucaccgacagcgagaugaauaagcuguuugaacggaccaaaaagcagcuuagagagaacgcugaagauauggggaauggaugcuucaagaucuaucacaaaugugacaacgcgugcaucggcucuauucgcaaugggacauacgaucaugacguguaccgggacgaggcccugaacaauagauuucagaucaagggcgucgagcucaaauccggauauaaggauuggauucuguggaucagcuucgcuauuucuugcuuucuucugugugugguucuccugggcuucaucaugugggccugccagaaagggaacauccgcuguaauauuugcaucuga

SEQ ID NO: 190023 - RNA, 1692 nt, Artificial Sequence
  derived and/or modified sequence opt5 from hemagglutinin__InfluenzaA__AEL31632
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucuguaaccuggauggagugaaaccccuuauccugagagacugcagcguugcgggcuggcuccuggggaauccuaugugugaugaguuccugaacgugccggaaugguccuauaucgucgagaagauuaaucccgcuaacgaccucugcuacccuggaaauuuuaacgauuaugaggaacugaagcaucuucugucucggaucaaucacuucgagaaaauucagaucauucccaagagcuccuggucugaccaugaagccagcggcguguccagcguuuguccuuaccaggggagaucuuccuuuuuccgcaacguggucuggcucaccaaaaaggauaaugccuaucccacaaucaaacggagcuacaacaauaccaaccaagaggaccugcuugugcuguggggcauucaccacccuaacgaugcugccgagcagacacgccucuaucagaauccgaccacguacaucucugugggaaccuccacacugaaccagagacugguccccaagaucgcuacccggagcaagguuaauggccaaucugggcgcauggaauuuuucuggacaauucucaaauccaacgacgccaucaauuuugagagcaacggaaauuucauugcgccugaaaacgccuacaagaucgugaaaaagggcgauuccaccauuaugaaaucugagcuggaauaugggaauugcaacacgaagugucagacacccaucggagcuaucaauagcuccaugccuuuucauaacauucacccccuuaccaucggcgagugcccgaaauacgugaaaagcaauagacugguccucgccacagggcugcggaacucuccucagggagagacccgcggccuuuucggcgcuauugccggguuuaucgaaggaggcuggcaggggaugguggacggaugguauggcuaccaucacuccaaugagcaagggagcggauaugcggccgacaaggaaucuacccagaaagcuauugauggcguuacaaacaaggugaacagcaucaucgacaaaaugaauacgcaguucgaggccgucggcagagaauuuaacaaucuggagcggcgcauugagaaccucaauaagaaaauggaagauggguuccuggacguguggaccuacaacgcugagcugcucguucugauggaaaaugagagaacacuugauuuccacgacuccaacgugaagaaucuguaugauaagguccggcuccaacugcgcgacaacgccaaagaacuuggaaauggcuguuuugaguucuaccauagaugcgauaacgaguguauggaaucugugcggaaugggaccuacgacuauccccaguacagcgaggaagccagacugaagcgcgaggagaucuccggagucaaacucgaaagcauuggcacauaucagauccugucuauuuacuccaccguggcuagcucucuggcgcucgccaucaugguugcugggcuguuucuuuggaugugcuccaacggcagccugcagugccggauuuguaucuga

SEQ ID NO: 190024 - RNA, 1701 nt, Artificial Sequence; identical to SEQ ID NO: 189944
  derived and/or modified sequence opt5 from hemagglutinin__InfluenzaA__AEL89297

SEQ ID NO: 190025 - RNA, 1701 nt, Artificial Sequence; identical to SEQ ID NO: 189944
  derived and/or modified sequence opt5 from hemagglutinin__InfluenzaA__AEL89307

SEQ ID NO: 190026 - RNA, 1701 nt, Artificial Sequence; identical to SEQ ID NO: 189944
  derived and/or modified sequence opt5 from hemagglutinin__InfluenzaA__AEL89317

SEQ ID NO: 190027 - RNA, 1701 nt, Artificial Sequence; identical to SEQ ID NO: 189944
  derived and/or modified sequence opt5 from hemagglutinin__InfluenzaA__AEL89327

SEQ ID NO: 190028 - RNA, 1701 nt, Artificial Sequence; identical to SEQ ID NO: 189944
  derived and/or modified sequence opt5 from hemagglutinin__InfluenzaA__AEL89337

SEQ ID NO: 190029 - RNA, 1701 nt, Artificial Sequence; identical to SEQ ID NO: 189944
  derived and/or modified sequence opt5 from hemagglutinin__InfluenzaA__AEL89347

SEQ ID NO: 190030 - RNA, 1701 nt, Artificial Sequence; identical to SEQ ID NO: 189944
  derived and/or modified sequence opt5 from hemagglutinin__InfluenzaA__AEL89357

SEQ ID NO: 190031 - RNA, 1701 nt, Artificial Sequence; identical to SEQ ID NO: 189944
  derived and/or modified sequence opt5 from hemagglutinin__InfluenzaA__AEL89367

SEQ ID NO: 190032 - RNA, 1701 nt, Artificial Sequence; identical to SEQ ID NO: 189944
  derived and/or modified sequence opt5 from hemagglutinin__InfluenzaA__AEL89391

SEQ ID NO: 190033 - RNA, 1701 nt, Artificial Sequence; identical to SEQ ID NO: 189944
  derived and/or modified sequence opt5 from hemagglutinin__InfluenzaA__AEL89401

SEQ ID NO: 190034 - RNA, 1701 nt, Artificial Sequence; identical to SEQ ID NO: 189944
  derived and/or modified sequence opt5 from hemagglutinin__InfluenzaA__AEL89411

SEQ ID NO: 190035 - RNA, 1701 nt, Artificial Sequence; identical to SEQ ID NO: 189944
  derived and/or modified sequence opt5 from hemagglutinin__InfluenzaA__AEL89421

SEQ ID NO: 190036 - RNA, 1701 nt, Artificial Sequence; identical to SEQ ID NO: 189944
  derived and/or modified sequence opt5 from hemagglutinin__InfluenzaA__AEL89441

SEQ ID NO: 190037 - RNA, 1701 nt, Artificial Sequence; identical to SEQ ID NO: 189944
  derived and/or modified sequence opt5 from hemagglutinin__InfluenzaA__AEL89451

SEQ ID NO: 190038 - RNA, 1701 nt, Artificial Sequence; identical to SEQ ID NO: 189944
  derived and/or modified sequence opt5 from hemagglutinin__InfluenzaA__AEL89461

SEQ ID NO: 190039 - RNA, 1701 nt, Artificial Sequence; identical to SEQ ID NO: 189944
  derived and/or modified sequence opt5 from hemagglutinin__InfluenzaA__AEL89471

SEQ ID NO: 190040 - RNA, 1701 nt, Artificial Sequence
  derived and/or modified sequence opt5 from hemagglutinin__InfluenzaA__AEL89481
augaaggugauccuggucguucuccuguacaccuucgccacagcuaacgccgacacgcuuugcauuggcuaucacgcgaauaacagcaccgauacaguggacaccgugcuggagaaaaaugucacagugacccauuccguuaaccuccuggaagauaagcacaaugggaaacuuuguaagcugagaggaguggcuccccuccaucugggcaaaugcaacaucgccggguggauucugggaaauccugagugugaaucucucagcacagccuccucuuggagcuacaucgucgagaccuccucuagcgacaacggcacgugcuauccgggggauuuuauugacuacgaagaacugcgggagcagcuuuccagcgugucuuccuucgaacgcuuugagaucuuccccaagaccagcucuuggccuaaucacgauuccaacaagggaguuacagcugccuguccccaugcuggcgccaagagcuuuuauaaaaaucugaucuggcucgugaaaaagggcaacucuuacccuaaacuguccaagagcuauauuaaugacaaggggaaagaaguccuugugcuguggggaauccaccaccccuccaccucugcggaucaacagagccucuaccagaacgccgacgcuuacguguucgucggcacauccagauauagcaagaaauuuaagccugagauugccauccggccgaaaguucgcgaucaggaggggagaaugaauuacuauuggacccugguggaacccggagacaagauuacguucgaggcuacaggcaaccugguggucccucgguacgccuuugcgauggaacgcaacgccgggucuggaaucauuaucuccgauacccccgugcaugacugcaauacaaccugucaaaccccuaaaggcgcuaucaacacaagccuccccuuccagaauauucacccgaucacgauuggcaagugcccuaaguauguuaaaucuaccaagcugagacuugccacagggcugcggaacgugcccagcauccagucccgcggacucuuuggcgcuauugccggguucaucgagggaggcuggaccgggauggucgacggaugguacggcuaucaucaccagaaugaacaaggcucuggguacgccgcugaucugaaaagcacacagaacgcgaucgacaagauuaccaauaaagugaacuccguuaucgagaagaugaauacgcaguuuacagccgugggaaaggaguucaaccaccuugagaaaagaauugagaaucugaacaagaaagucgaugacggcuuccucgauaucuggaccuacaaugcugaacugcuggugcuccuggagaacgaacggacccuugacuaucaugauagcaaugucaagaaccuguacgagaaagugcgcucucagcucaagaacaaugccaaggagauugggaacggauguuuugaguucuaucacaaaugcgacaauacauguauggaauccguuaagaacggcaccuacgauuauccuaaauacagcgaagaggccaagcugaauagagaagagaucgacggggugaaacuugagucuacacggaucuaucaaauucuggcuaucuacuccacggucgccagcucccucgugcugguugugucucugggcgcgauuagcuuuuggaugugcuccaacggaucucuccagugccgcaucuguauuuga

SEQ ID NO: 190041 - RNA, 1701 nt, Artificial Sequence; identical to SEQ ID NO: 188608
  derived and/or modified sequence opt5 from hemagglutinin__InfluenzaA__AEL89491

SEQ ID NO: 190042 - RNA, 1701 nt, Artificial Sequence
  derived and/or modified sequence opt5 from hemagglutinin__InfluenzaA__AEL89501
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccugaucacgacuccaauaagggagugacagccgcuuguccccaugccggcgcgaaaucuuuuuauaagaaccugaucuggcucguuaaaaagggcaauagcuacccuaaacuguccaagagcuauauuaacgaugaagggaaggaggugcuuguccuguggggaauccaccaccccuccaccucugccgaccaacagagccucuaccagaaugcugaugccuacguguucgugggcacauccagauauagcaaaaaguuuaaaccugagauugcuauccggccgaagguccgcgaccaggaagggagaaugaacuacuauuggacccugguugagcccggagauaaaauuacguucgaagccacaggcaaucugguggugccucgguacgcguuugccauggagcgcaacgcugggucuggaaucauuaucuccgacacccccguccaugacugcaacacaaccugucaaaccccuaagggcgccaucaauacaagccuccccuuccagaacauucacccgaucacgauuggcaaaugcccuaaguaugugaagucuaccaaacugagacuugcuacagggcugcggaauguucccagcauccagucccgcggacucuuuggcgccauugccggguucaucgaaggaggcuggaccgggaugguggauggaugguacggcuaucaucaccagaacgagcaaggcucuggguacgcugcggaccuuaagagcacacagaaugccaucgauaaaauuaccaacaaggucaauuccgugaucgagaaaaugaacacgcaguuuacagcuguuggaaaggaguucaaucaccuugagaagagaauugaaaaccugaauaaaaagguggacgauggcuuccucgacaucuggaccuacaacgccgagcugcugguccuccuggaaaaugagcggacccuugauuaucaugacagcaacgugaaaaaucuguacgagaagguccgcucucagcucaaaaacaacgccaaggaaauugggaauggauguuuugaguucuaucacaagugcgauaacacauguauggaauccgugaaaaauggcaccuacgacuauccuaaguacagcgaggaagcuaaacugaacagagaggagaucgaugggguuaagcuggaaucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 190043 - RNA, 1701 nt, Artificial Sequence; identical to SEQ ID NO: 186857
  derived and/or modified sequence opt5 from hemagglutinin__InfluenzaA__AEL89511

SEQ ID NO: 190044 - RNA, 1701 nt, Artificial Sequence; identical to SEQ ID NO: 188608
  derived and/or modified sequence opt5 from hemagglutinin__InfluenzaA__AEL89521

SEQ ID NO: 190045 - RNA, 1701 nt, Artificial Sequence
  derived and/or modified sequence opt5 from hemagglutinin__InfluenzaA__AEL89531
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaagauaagcacaaugggaaacuuugucagcugagaggaguugcuccccuccaucugggcaagugcaacaucgccggguggauucugggaaauccugagugugaaucucucagcaccgccuccucuuggagcuacaucguggagacguccucuagcgacaacggaaccugcuauccgggggauuuuauugacuacgaagaacugcgggagcaacuuuccagcgucucuuccuucgaacgcuuugagauguuccccaaaacaagcucuuggccuaaucacgauuccaacaagggagugaccgcugccuguccccaugcuggcgccaagagcuuuuauaaaaaucugaucuggcucguuaagaaaggcaacucuuacccuaagcuguccaaaagcuauaucaaugacaaggggaaggaagugcuuguccuguggggcauucaccaccccuccacaucugcggaucagcagagccucuaccagaacgccgacgcuuacguguucgugggcaccuccagauauagcaaaaaguuuaaaccugagaucgccauucggccgaagguccgcgaucaagaggggagaaugaauuacuauuggacgcugguugaacccggagacaaaaucacauucgaggcuaccggcaaccugguggugccucgguacgccuuugcgauggaacgcaacgccgggucuggaauuaucauuuccgauacacccguccaugacugcaauaccaccugucagacaccuaagggcgcuaucaacacgagccuccccuuccagaauauccacccgauuaccaucggcaaaugcccuaaguaugugaagucuacaaaacugagacuugccaccgggcugcggaacguucccagcauucagucccgcggacucuuuggcgcuaucgccggguucauugagggaggcuggacagggaugguggacggaugguacggcuaucaucaccaaaaugaacagggcucuggguacgccgcugaucuuaagagcacccagaacgcgaucgacaaaaucacgaauaaggucaacuccgugauugagaaaaugaauacacaguuuaccgccguuggaaaggaguucaaccaccuugaaaagagaaucgagaaucugaacaaaaagguggaugacggcuuccucgauauuuggaccuacaaugcugaacugcugguccuccuggagaacgaacggacacuugacuaucaugauagcaaugugaaaaaccuguacgagaagguccgcucucaacucaaaaacaaugccaaggagaucgggaacggauguuuugaguucuaucacaagugcgacaauaccuguauggaguccgugaaaaacggcacauacgauuauccuaaguacagcgaagaggccaaacugaauagagaagagauugacgggguuaagcuggagucuacgcggaucuaucagauccuggcuauuuacuccaccguggccagcucccucguccuggugguuucucugggcgcgaucagcuuuuggaugugcuccaacggaucucuccagugccgcauuuguaucuga

SEQ ID NO: 190046 - RNA, 1701 nt, Artificial Sequence; identical to SEQ ID NO: 188608
  derived and/or modified sequence opt5 from hemagglutinin__InfluenzaA__AEL89541

SEQ ID NO: 190047 - RNA, 1701 nt, Artificial Sequence
  derived and/or modified sequence opt5 from hemagglutinin__InfluenzaA__AEL89551
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccugaucacgacuccaauaagggagugacagccgcuuguccccaugccggcgcgaaauccuuuuauaagaaccugaucuggcucguuaaaaagggcaauucuuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaucugguggugccucgguacgcguuugccauggaacgcaacgcugggucuggaaucauuaucuccgacacccccgcccaugacugcaacacaaccugucaaaccccuaaaggcgcuaucaauacaagccuccccuuccagaacauucacccgaucacgauuggcaagugcccuaaguaugucaaaucuaccaagcugagacuugccacagggcugcggaaugugcccagcauccagucccgcggacucuuuggcgccauugcuggguucaucgagggaggcuggaccgggaugguugauggaugguacggcuaucaucaccagaacgaacaaggcucuggguacgcggccgaccugaaaagcacacagaaugcuaucgauaagauuaccaacaaagugaauagcgucaucgagaagaugaacacgcaguuuacagccgugggaaaggaguucaaucaccuugagaaaagaauugagaaccugaauaagaaaguugacgauggcuuccucgacaucuggaccuacaacgccgaacugcuggugcuccuggagaaugaacggacccuugauuaucaugacagcaacgucaagaaucuguacgagaaagugcgcucucagcucaagaacaacgcuaaggagauugggaauggauguuuugaguucuaucacaaaugcgauaacacauguauggaauccgucaagaauggcaccuacgacuauccuaaauacagcgaagaggccaagcugaacagagaagagaucgauggggugaaacuugagucuacacggaucuaucaaauucuggcgaucuacuccacgguugcuagcucccucgugcuggucgugucucugggcgccauuagcuuuuggaugugcuccaauggaucucuccagugccgcaucuguauuuga

SEQ ID NO: 190048 - RNA, 1701 nt, Artificial Sequence
  derived and/or modified sequence opt5 from hemagglutinin__InfluenzaA__AEL89561
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcggcaacgggacgugcuauccgggagacuuuauugauuacgaagaacugcgggagcagcuuuccagcgucucuuccuucgaacgcuuugagaucuuccccaagaccagcucuuggccugaccacgauuccaauaagggcgugacagccgcuuguccccaugccggcgcgaaaucuuuuuauaagaaccugaucuggcucguuaaaaaggggaauagcuacccuaaacuguccaagagcuauauuaacgacaagggaaaagaagugcuuguccuguggggcauccaccaccccuccaccucugccgaucaacagagccucuaccagaaugcugacgccuacguguucguggggacauccagauauagcaagaaauuuaagccugagauugcuauccggccgaaaguccgcgaucaggagggaagaaugaacuacuauuggacccugguugaacccggcgacaagauuacguucgaggccacagggaaucugguggugccucgguacgcguuugccauggaacgcaacgcuggaucuggcaucauuaucuccgauacccccguccaugacugcaacacaaccugucaaaccccuaaaggcgccaucaauacaagccuccccuuccagaacauucacccgaucacgauugggaagugcccuaaguaugugaaaucuaccaagcugagacuugcuacaggacugcggaauguucccagcauccagucccgcggccucuuuggggccauugccggauucaucgagggcggguggaccggaaugguggacggcugguacggcuaucaucaccagaacgaacaagggucuggauacgcugcggaucugaaaagcacacagaaugccaucgacaagauuaccaacaaagucaauuccgugaucgagaagaugaacacgcaguuuacagcuguuggcaaggaguucaaucaccuugagaaaagaauugagaaccugaauaagaaaguggaugacggguuccucgauaucuggaccuacaacgccgaacugcugguccuccuggagaaugaacggacccuugacuaucaugauagcaacgugaagaaucuguacgagaaaguccgcucucagcucaagaacaacgccaaggagauuggaaauggcuguuuugaguucuaucacaaaugcgacaacacauguauggaauccgugaagaaugggaccuacgauuauccuaaauacagcgaagaggcuaagcugaacagagaagagaucgacggcguuaaacuugagucuacagaaaucuaucaaauucuggccaucuacuccacgguggcgagcucccucguccuggugguuucucugggagcuauuagcuuuuggaugugcuccaauggcucucuccagugccggaucuguauuuga

SEQ ID NO: 190049 - RNA, 1701 nt, Artificial Sequence; identical to SEQ ID NO: 188608
  derived and/or modified sequence opt5 from hemagglutinin__InfluenzaA__AEL89571

SEQ ID NO: 190050 - RNA, 1701 nt, Artificial Sequence
  derived and/or modified sequence opt5 from hemagglutinin__InfluenzaA__AEL89581
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagauguuccccaagaccagcucuuggccugaucacgacuccaauaagggagugacagccgcuuguccccaugccggcgcgaaaucuuuuuauaagaaccugaucuggcucguuaaaaagggcaauagcuacccuaaacuguccaagagcuauaucaacgauaaggggaaagaagugcuuguccuguggggcauucaccaccccuccaccucugccgaccaacagagccucuaccagaaugcugaugccuacguguucgugggaacauccagauauagcaagaaauuuaagccugagaucgcuauucggccgaaaguccgcgaccaggaggggagaaugaacuacuauuggacccugguugaacccggagauaagaucacguucgaggccacaggcaaucugguggugccucgguacgcguuugccauggaacgcaacgcugggucuggaauuaucauuuccgacacccccguccaugacugcaacacaaccugucaaaccccuaaaggcgccaucaauacaagccuccccuuccagaacauccacccgauuacgaucggcaagugcccuaaguaugugaaaucuaccaagcugagacuugcuacagggcugcggaauguucccagcauucagucccgcggacucuuuggcgccaucgccggguucauugagggaggcuggaccgggaugguggauggaugguacggcuaucaucaccagaacgaacaaggcucuggguacgcugcggaccugaaaagcacacagaaugccaucgauaagaucaccaacaaagucaauuccgugauugagaagaugaacacgcaguuuacagcuguuggaaaggaguucaaucaccuugagaaaagaaucgagaaccugaauaagaaaguggacgauggcuuccucgacauuuggaccuacaacgccgaacugcugguccuccuggagaaugaacggacccuugauuaucaugacagcaacgugaagaaucuguacgagaaaguccgcucucagcucaagaacaacgccaaggagaucgggaauggauguuuugaguucuaucacaaaugcgauaacacauguauggaauccgugaagaauggcaccuacgacuauccuaaauacagcgaagaggcuaagcugaacagagaagagauugaugggguuaaacuugagucuacacggaucuaucaaauccuggccauuuacuccacgguggcgagcucccucguccuggugguuucucugggcgcuaucagcuuuuggaugugcuccaauggaucucuccagugccgcauuuguaucuga

SEQ ID NO: 190051 - RNA, 1701 nt, Artificial Sequence; identical to SEQ ID NO: 189478
  derived and/or modified sequence opt5 from hemagglutinin__InfluenzaA__AEL89591

SEQ ID NO: 190052 - RNA, 1701 nt, Artificial Sequence
  derived and/or modified sequence opt5 from hemagglutinin__InfluenzaA__AEL89601
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacaaccgccuguccccaugcuggcgccaagagcuuuuauaaaaaucugaucuggcucguuaaaaagggcaacucuuacccuaaacuguccaagagcuauauuaaugacaaggggaaagaagugcuuguccuguggggaauccaccaucccccuacauccgcggaucaacagucucucuaccagaacgccgacgcuuacguguucgugggcaccagcagauauuccaagaaauuuaagccggagauugccauccggcccaaaguccgcgaucaggaggggagaaugaauuacuauuggacgcugguugaaccuggagacaagauuacauucgaggcuaccggcaaccugguggugccccgguacgccuuugcgauggaacgcaacgccgggagcggaaucauuaucucugauacaccuguccacgacugcaauaccaccugucaaacacccaaaggcgcuaucaacacgucccucccguuccagaauauucacccuaucaccauuggcaagugccccaaguaugugaaaagcacaaagcugagacuugccaccgggcugcggaacguuccuucuauccagagccgcggacucuuuggcgcuauugccggguucaucgagggaggcuggacagggaugguggacggaugguacggcuaucaucaccagaaugaacaaggcuccggguacgccgcugaucugaaaucuacccagaacgcgaucgacgagauuacgaauaaggucaacagcgugaucgagaaaaugaauacacaguuuaccgccguuggaaaggaguucaaccaccuugagaagagaauugaaaaucugaacaaaaagguggaugacggcuuccucgauaucuggaccuacaaugcugagcugcugguccuccuggaaaacgagcggacacuugacuaucaugauuccaaagugaagaaucuguacgagaaaguccgcagccagcucaagaacaacgccaaggaaauugggaauggauguuuugaguucuaucacaaaugcgacaacaccuguauggaaucugugaagaauggcacauacgauuaucccaaauacuccgaggaagccaagcugaacagagaggagaucgacgggguuaaacuugaaagcacgcggaucuaucaaauucuggcuaucuacucuaccguggccuccagccucguccuggugguuucccugggcgcgauuucuuuuuggaugugcagcaauggaucccuccagugccgcaucuguauuuga

SEQ ID NO: 190053 - RNA, 1701 nt, Artificial Sequence; identical to SEQ ID NO: 189478
  derived and/or modified sequence opt5 from hemagglutinin__InfluenzaA__AEL89611

SEQ ID NO: 190054 - RNA, 1701 nt, Artificial Sequence; identical to SEQ ID NO: 189920
  derived and/or modified sequence opt5 from hemagglutinin__InfluenzaA__AEL89621

SEQ ID NO: 190055 - RNA, 1701 nt, Artificial Sequence; identical to SEQ ID NO: 188608
  derived and/or modified sequence opt5 from hemagglutinin__InfluenzaA__AEL89631

SEQ ID NO: 190056 - RNA, 1701 nt, Artificial Sequence; identical to SEQ ID NO: 189944
  derived and/or modified sequence opt5 from hemagglutinin__InfluenzaA__AEL89641

SEQ ID NO: 190057 - RNA, 1701 nt, Artificial Sequence
  derived and/or modified sequence opt5 from hemagglutinin__InfluenzaA__AEL89651
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggucuuuauugauuacgaagaacugcgggagcagcuuuccagcgugucuuccuucgaacgcuuugagaucuuccccaagaccagcucuuggccuaaucacgacuccaacaagggaguuacagccgcuuguccccaugccggcgcgaaaucuuuuuauaagaaucugaucuggcucgugaaaaagggcaacagcuacccuaaacuguccaagagcuauauuaaugauaaggggaaagaaguccuugugcuguggggaauccaccaccccuccaccacagccgaccaacagucucucuaccagaacgcugaugccuacguguucgucggcaccagcagauauuccaagaaauuuaagccugagauugcuauccggccgaaaguucgcgaccaggaggggagaaugaauuacuauuggacgcugguggaacccggagauaagauuacauucgaggccaccggcaaccugguggucccucgguacgcguuugccauggaacgcaacgcugggagcggaaucauuaucucugacacacccgugcaugauugcaauaccaccugucaaacaccuaaaggcgccaucaacacgucccuccccuuccagaauauucacccgaucaccauuggcaagugcccuaaguuuguuaaaagcacaaagcugagacuugcuaccgggcugcggaacgugcccucuauccagagccgcggacucuucggcgccauugccggguuuaucgagggaggcuggacagggauggucgacggaugguauggcuaccaucaccagaaugaacaaggcuccggguaugcugcggaccugaaaucuacccagaacgccaucgauaagauuacgaauaaagugaacagcguuaucgagaagaugaauacacaguucaccgcugugggaaaggaguucaaccaccuugagaaaagaauugagaaucugaacaagaaagucgacgauggcuuucucgacaucuggaccuacaaugccgaacugcuggugcuccuggagaacgaacggacacuugauuaccaugacuccaaugucaagaaccuguaugagaaagugcgcaaccagcucaagaauaacgccaaggagauugggaauggauguuucgaauuuuaccacaaaugcgauaacaccuguauggagagcguuaagaauggcacauaugacuacccuaaauauucugaagaggcuaagcugaacagagaagagaucgauggggugaaacuugaguccacgcggaucuaccaaauucuggccaucuauagcaccgucgcgucuucccucgugcugguugugagccugggcgcuauuuccuucuggaugugcucuaauggaagccuccagugccgcaucuguauuuga

SEQ ID NO: 190058 - RNA, 1701 nt, Artificial Sequence; identical to SEQ ID NO: 189459
  derived and/or modified sequence opt5 from hemagglutinin__InfluenzaA__AEL89661

SEQ ID NO: 190059 - RNA, 1701 nt, Artificial Sequence
  derived and/or modified sequence opt5 from hemagglutinin__InfluenzaA__AEL89671
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccacagccgaucaacagucucucuaccagagcgcugacaccuacguguucgugggcacguccagauauagcaagaaauuuaagccugagauugccauccggccgaaaguccgcgaucaggaggggagaaugaacuacuauuggacacugguugaacccggagacaagauuaccuucgaggcuacaggcaaucugguggugccucgguacgccuuugcgauggaacgcaacgccgggucuggaaucauuaucuccgauacccccguccaugacugcaacaccacaugucaaacgccuaaaggcgcuaucaauaccagccuccccuuccagaacauucacccgaucacaauuggcaagugcccuaaguaugugaaaucuaccaagcugagacuugccacagggcugcggaauguucccagcauccagucccgcggacucuuuggcgcuauugccggguucaucgagggaggcuggaccgggaugguggacggaugguacggcuaucaucaccagaacgaacaaggcucuggguacgccgcugaucugaaaagcacgcagaaugcgaucgacaagauuacaaacaaagucaauuccgugaucgagaagaugaacacccaguuuaccgccguuggaaaggaguucaaucaccuugagaaaagaauugagaaccugaauaagaaaguggaugacggcuuccucgauaucuggacauacaacgcugaacugcugguccuccuggagaaugaacggacccuugacuaucaugauagcaacgugaagaaucuguacgagaaaguccgcaaccagcucaagaacaaugccaaggagauugggaacggauguuuugaguucuaucacaaaugcgacaauacauguauggaaucugugaagaacggcacguacgauuauccuaaauacuccgaagaggccaagcugaauagagaagagaucgacgggguuaaacuugagagcacccggaucuaucaaauucuggcuaucuacucuacaguggccuccagccucguccuggugguuucccugggcgcgauuucuuuuuggaugugcagcaacggaucccuccagugccgcaucuguauuuga

SEQ ID NO: 190060 - RNA, 1701 nt, Artificial Sequence; identical to SEQ ID NO: 189459
  derived and/or modified sequence opt5 from hemagglutinin__InfluenzaA__AEL89691

SEQ ID NO: 190061 - RNA, 1701 nt, Artificial Sequence
  derived and/or modified sequence opt5 from hemagglutinin__InfluenzaA__AEL89701
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacaaccgccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaucccccuacauccgcggaucaacagaaccucuaccagaaugccgacgcuuacguguucgugggcaccucuagauauagcaagaaauuuaagccggagauugccauccggcccaaaguccgcgaucaggaggggagaaugaacuacuauuggacgcugguugaaccuggagacaagauuacauucgaggcuaccggcaaccugguggugccccgguacgccuuugcgauggaacgcaaugccggguccggaaucauuaucagcgauacaccuguccacgacugcaacaccaccugucaaacacccaaaggcgcuaucaauacgucucucccguuccagaacauucacccuaucaccauuggcaagugccccaaguaugugaaauccacaaagcugagacuugccaccgggcugcggaauguuccuagcauccagucucgcggacucuuuggcgcuauugccggguucaucgagggaggcuggacagggaugguggacggaugguacggcuaucaucaccagaacgaacaaggcagcggguacgccgcugaucugaaauccacccagaaugcgaucgacggaauuacgaacaaggucaauucugugaucgagaaaaugaacacacaguuuaccgccguuggcaaggaguucaaucaccuugaaaagagaauugagaaccugaauaaaaagguggaugacggguuccucgauaucuggaccuacaacgcugaacugcugguccuccuggagaaugaacggacacuugacuaucaugauagcaacgugaaaaaccuguacgagaagguccgcucccagcucaaaaauaacgccaaggagauuggaaauggcuguuuugaguucuaucacaagugcgacaacaccuguauggagagcgugaaaaaugggacauacgauuaucccaaguacucugaagaggccaaacugaacagagaagagaucgacggcguuaaacuugaguccacgaugaucuaucaaauucuggcuaucuacagcaccguggccucuucccucguccuggugguuagccugggagcgauuuccuuuuggaugugcucuaauggcagccuccagugccggaucuguauuuga

SEQ ID NO: 190062 - RNA, 1701 nt, Artificial Sequence; identical to SEQ ID NO: 190061
  derived and/or modified sequence opt5 from hemagglutinin__InfluenzaA__AEL89711

SEQ ID NO: 190063 - RNA, 1701 nt, Artificial Sequence; identical to SEQ ID NO: 189459
  derived and/or modified sequence opt5 from hemagglutinin__InfluenzaA__AEL89721

SEQ ID NO: 190064 - RNA, 1701 nt, Artificial Sequence
  derived and/or modified sequence opt5 from hemagglutinin__InfluenzaA__AEL89741
augaaggccauccuggugguccuccuguacaccuucgcuacaacgaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaaaaaucugaucuggcucguuaaaaagggcaacucuuacccuaaacuguccaagagcuauauuaaugacaaggggaaagaagugcuuguccuguggggaauccaccaccccuccacaaccgcggaucaacagucucucuaccagaacgccgacacguacguguucgugggcacaagcagauauuccaagaaauuuaagccugagauugcuauccggccgaaaguccgcgaucaggaggggagaaugaauuacuauuggacccugguugaacccggagacaagauuacauucgaggccaccggcaaccugguggugccucgguacgcuuuugccauggaacgcaacgcggggagcggaaucauuaucucugauacccccguccaugacugcaauacaacgugucaaaccccuaaaggcgccaucaacacaucccuccccuuccagaauauucacccgaucaccauuggcaagugcccuaaguaugugaaaagcacaaagcugagacuugcuaccgggcugcggaacguucccucuauccagagccgcggacucuuuggcgccauugcuggguucaucgagggaggcuggacggggaugguggacggaugguacggcuaucaucaccagaaugaacaaggcuccggguacgccgccgaucugaaaucuacacagaacgcuaucgacaagauuaccaauaaagucaacagcgugaucgagaagaugaauacccaguuuacagcgguuggaaaggaguucaaccaccuugagaaaagaauugagaaucugaacaagaaaguggaugacggcuuccucgauaucuggaccuacaaugccgaacugcugguccuccuggagaacgaacggacacuugacuaucaugauuccaaugugaagaaccuguacgagaaaguccgcaaccagcucaagaauaacgcuaaggagauugggaauggauguuuugaguucuaucacaaaugcgacaacacguguauggaaagcgugaagaauggcaccuacgauuauccuaaauacucugaagaggccaagcugaacagagaagagaucgacgggguuaaacuugaguccacacggaucuaucaaauucuggccaucuacagcaccguggcuucuucccucguccuggugguuagccugggcgccauuuccuuuuggaugugcucuaauggaagccuccagugccgcaucuguauuuga

SEQ ID NO: 190065 - RNA, 1701 nt, Artificial Sequence; identical to SEQ ID NO: 188608
  derived and/or modified sequence opt5 from hemagglutinin__InfluenzaA__AEL89751

SEQ ID NO: 190066 - RNA, 1701 nt, Artificial Sequence
  derived and/or modified sequence opt5 from hemagglutinin__InfluenzaA__AEL89761
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacaaccgccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaucccccuacauccgcggaucaacagucucucuaccagaacgccgacgcuuacguguucgugggcaccagcagauauuccaagaaauuuaagccggagauugccauccggcccaaaguccgcgaucaggaggggagaaugaauuacuauuggacgcugguugaaccuggagacaagauuacauucgaggcuaccggcaaccugguggugccccgguacgccuuugcgauggaacgcaacgccgggagcggaaucauuaucucugauacaccuguccacgacugcaauaccaccugucaaacacccaaaggcgcuaucaacacgucccucccguuccagaauauucacccuaucaccauuggcaagugccccaaguaugugaaaagcacaaagcugagacuugccaccgggcugcggaacguuccuucuauccagagccgcggacucuuuggcgcuauugccggguucaucgagggaggcuggacagggaugguggacggaugguacggcuaucaucaccagaaugaacaaggcuccggguacgccgcugaucugaaaucuacccagaacgcgaucgacggaauuacgaauaaggucaacagcgugaucgagaaaaugaauacacaguuuaccgccguuggcaaggaguucaaccaccuugaaaagagaauugagaaucugaacaaaaagguggaugacggguuccucgauaucuggaccuacaaugcugaacugcugguccuccuggagaacgaacggacacuugacuaucaugauuccaaugugaaaaaccuguacgagaagguccgcagccagcucaaaaacaaugccaaggagauuggaaacggcuguuuugaguucuaucacaagugcgacaauaccuguauggagucugugaaaaacgggacauacgauuaucccaaguacuccgaagaggccaaacugaauagagaagagaucgacggcguuaaacuugagagcacgaugaucuaucaaauucuggcuaucuacucuaccguggccuccagccucguccuggugguuucccugggagcgauuucuuuuuggaugugcagcaacggcucccuccagugccggaucuguauuuga

SEQ ID NO: 190067 - RNA, 1701 nt, Artificial Sequence; identical to SEQ ID NO: 189944
  derived and/or modified sequence opt5 from hemagglutinin__InfluenzaA__AEL89771

SEQ ID NO: 190068 - RNA, 1701 nt, Artificial Sequence; identical to SEQ ID NO: 190066
  derived and/or modified sequence opt5 from hemagglutinin__InfluenzaA__AEL89781

SEQ ID NO: 190069 - RNA, 1701 nt, Artificial Sequence; identical to SEQ ID NO: 189459
  derived and/or modified sequence opt5 from hemagglutinin__InfluenzaA__AEL89791

SEQ ID NO: 190070 - RNA, 1701 nt, Artificial Sequence
  derived and/or modified sequence opt5 from hemagglutinin__InfluenzaA__AEL89801
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggucuuuauugauuacgaagaacugcgggagcagcuuuccagcgugucuuccuucgaacgcuuugagaucuuccccaagaccagcucuuggccuaaucacgacuccaacaagggaguuacagccgcuuguccccaugccggcgcgaaaucuuuuuauaagaaucugaucuggcucgugaaaaagggcaacagcuacccuaaacuguccaagagcuauauuaaugauaaggggaaagaaguccuugugcuguggggaauccaccaccccuccaccacagccgaccaacagucucucuaccagaacgcugaugccuacguguucgucggcaccagcagauauuccaagaaauuuaagccugagauugcuguucggccgaaagugcgcgaccaggaggggagaaugaauuacuauuggacgcugguggaacccggagauaagaucacauucgaggccaccggcaaccuggucgugccucgguacgcguuugccauggaacgcaacgcugggagcggaauuaucauuucugacacacccguucaugauugcaauaccaccugucaaacaccuaaaggcgccaucaacacgucccuccccuuccagaauauccacccgauuaccaucggcaagugcccuaaguaugugaaaagcacaaagcugagacuugcuaccgggcugcggaacguccccucuauucagagccgcggacucuuuggcgccaucgccggguucauugagggaggcuggacagggaugguggacggaugguacggcuaucaucaccagaaugaacaaggcuccggguacgcugcggaccugaaaucuacccagaacgccaucgauaagaucacgaauaaaguuaacagcgugauugagaagaugaauacacaguuuaccgcugucggaaaggaguucaaccaccuugagaaaagaaucgagaaucugaacaagaaaguggacgauggcuuccucgacauuuggaccuacaaugccgaacugcugguccuccuggagaacgaacggacacuugauuaucaugacuccaaugugaagaaccuguacgagaaaguucgcaaccagcucaagaauaacgccaaggagaucgggaauggauguuuugaguucuaucacaaaugcgauaacaccuguauggaaagcgugaagaauggcacauacgacuauccuaaauacucugaagaggcuaagcugaacagagaagagauugauggggucaaacuugaguccacgcggaucuaucaaauccuggccauuuacagcaccguggcgucuucccucauccugguugugagccugggcgcuauuuccuuuuggaugugcucuaauggaagccuccagugccgcaucuguauuuga

SEQ ID NO: 190071 - RNA, 1701 nt, Artificial Sequence
  derived and/or modified sequence opt5 from hemagglutinin__InfluenzaA__AEL89812
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacaaccgccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaucccccuacauccgcggaucaacagucucucuaccagaacgccgacgcuuacguguucgugggcaccagcagauauuccaagaaauuuaagccggagauugccauccggcccaaaguccgcgaucaggaggggagaaugaauuacuauuggacgcugguugaaccuggagacaagauuacauucgaggcuaccggcaaccugguggugccccgguacgccuuugcgauggaacgcaacgccgggagcggaaucauuaucucugauacaccuguccacgacugcaaugcuaccugucaaacccccaaaggcgugaucaacacaucccucccguuccagaauauucacccuaucacgauuggcaagugccccaaguauguuaaaagcaccaagcugagacuugccacagggcugcggaacgugccuucuauccagagccgcggacucuuuggcgcuauugccggguucaucgagggaggcuggaccgggauggucgacggaugguacggcuaucaucaccagaaugaacaaggcuccggguacgccgcugaucugaaaucuacacagaacgcgaucgacggaauuaccaauaaggugaacagcguuaucgagaaaaugaauacgcaguuuacagccgugggcaaggaguucaaccaccuugaaaagagaauugagaaucugaacaaaaaggucgaugacggguuccucgauaucuggaccuacaaugcugaacugcuggugcuccuggagaacgaacggacccuugacuaucaugauuccaaugucaaaaaccuguacgagaaggugcgcagccagcucaaaaacaaugccaaggagauuggaaacggcuguuuugaguucuaucacaagugcgacaauacauguauggagucuguuaaaaacgggaccuacgauuaucccaaguacuccgaagaggccaaacugaauagagaagagaucgacggcgugaaacuugagagcacaaugaucuaucaaauucuggcuaucuacucuacggucgccuccagccucgugcugguugugucccugggagcgauuucuuuuuggaugugcagcaacggcucccuccagugccggaucuguauuuga

SEQ ID NO: 190072 - RNA, 1701 nt, Artificial Sequence; identical to SEQ ID NO: 189459
  derived and/or modified sequence opt5 from hemagglutinin__InfluenzaA__AEL89832

SEQ ID NO: 190073 - RNA, 1701 nt, Artificial Sequence
  derived and/or modified sequence opt5 from hemagglutinin__InfluenzaA__AEL89842
augaaggccauccuggugguccuccuguacacccuugcuacagccaacgcggacacgcugugcauuggcuaucacgcuaauaacagcaccgauacaguugacaccgugcucgagaaaaaugugacagucacccauuccgugaaccugcuugaagauaagcacgacgggaaacuguguaagcucagaggaguugcuccccugcaucugggcaaaugcaauaucgccggguggauucucggaaacccugagugugaaucucugagcacagccuccucuuggagcuacaucguggagaccuccucuagcgauaauggcacgugcuauccgggggacuucauugauuacgaggaacuucgggagcagcuguccagcgucucuuccuuugaacgcuucgagaucuuucccaagaccagcucuuggccuaaccacgacuccaauaagggagugacagccgcuuguccccaugccggcgcgaaauccuucuauaagaaccucaucuggcugguuaaaaagggcaauucuuacccuaaacuuuccaagagcuauauuaacgauaaggggaaagaagugcugguccucuggggaauccaccaccccuccaccucugccgaccaacagagccuguaccagaaugcugaugccuacguguuugugggcacauccagauauagcaagaaauucaagccugagauugcuauccggccgaaaguccgcgaccaggaggggagaaugaacuacuauuggacccugguugaacccggagauaagauuacguuugaggccacaggcaaucucguggugccucgguacgcguucgccauggaacgcaacgcugggucuggaaucauuaucuccgacacccccguccaugacugcaacgccacaugucaaaccccuaaaggcgcuaucaauaccagccugcccuuucagaacgugcacccgauuacaaucggcaagugcccuaaguauguuaaaucuacgaaacuuagacuggccaccgggcuccggaaugugcccagcauucagucccgcggacuguucggcgccaucgcuggguuuauugagggaggcuggacagggauggucgauggaugguacggcuaucaucaccagaacgaacaaggcucuggguacgcggccgaccuuaaaagcacccagaaugcuaucgauaagaucacaaacaaagugaauagcguuauugagaagaugaacacccaguucacggccgugggaaaggaguuuaaucaccuggaaaagagaaucgagaaccucaauaagaaagucgacgauggcuuccuggacauuuggacauacaacgccgaacugcucgugcugcuugagaaugaacggacccuggauuaucaugacagcaacgucaagaaucucuacgagaaagugcgcucucagcugaagaacaacgcuaaggagaucgggaauggauguuucgaauuuuaucacaaaugcgauaacaccuguauggaguccguuaagaauggcacauacgacuauccuaaauacagcgaagaggccaaacuuaacagagaagagauugauggggugaagcuggagucuacccggaucuaucaaauccucgcgauuuacuccacagucgcuagcucccuggugcugguugugucucucggcgccaucagcuucuggaugugcuccaauggaucucugcagugccgcauuuguaucuga

SEQ ID NO: 190074 - RNA, 1701 nt, Artificial Sequence
  derived and/or modified sequence opt5 from hemagglutinin__InfluenzaA__AEL89852
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccaaguauagcaaaaaguuuaaaccugagauugcugucagaccgaagguucgggaccaggaggggcgcaugaacuacuauuggacccugguggaacccggagauaaaaucacguucgaggccacaggcaaccugcucgugccuagauacgcguuugccauggaacggaaugcugggucuggaauuaucauuuccgacacccccguccaugauugcaacacaaccugucaaaccccuaagggcgccaucaauacaagccugcccuuccagaacauccacccgauuacgaucggcaagugcccuaaauaugugaagucuaccaaacuucgccuggcuacagggcucagaaauguucccagcauucagucccggggacuguuuggcgccaucgccggguucauugagggaggcuggaccgggaugguggacggaugguacggcuaucaucaccagaacgaacaaggcucuggguacgcugcggaccuuaagagcacacagaaugccaucgauaaaaucaccaacaaggucaauuccgugauugagaagaugaacacgcaguuuacagcuguuggaaaagaguucaaucaccuggaaaagcgcaucgagaaccucaauaaaaagguggacgauggcuuccuggacauuuggaccuacaacgccgaacugcucguccugcuugagaaugaaagaacccuggauuaucaugacagcaacgugaaaaaccucuacgagaagguccggucucagcugaagaauaacgccaaagagaucgggaauggauguuuugaguucuaucacaagugcgauaacacauguauggaguccgugaaaaauggcaccuacgacuauccuaaguacagcgaagaggcuaaacuuaaccgcgaagagauugaugggguuaagcuggagucuacaagaaucuaucaaauccucgccauuuacuccacgguggcgagcucccugguccuggugguuucucucggcgcuaucagcuuuuggaugugcuccaauggaucucugcagugccggauuuguaucuga

SEQ ID NO: 190075 - RNA, 1701 nt, Artificial Sequence; identical to SEQ ID NO: 189478
  derived and/or modified sequence opt5 from hemagglutinin__InfluenzaA__AEL93568

SEQ ID NO: 190076 - RNA, 1701 nt, Artificial Sequence; identical to SEQ ID NO: 189459
  derived and/or modified sequence opt5 from hemagglutinin__InfluenzaA__AEL93578

SEQ ID NO: 190077 - RNA, 1701 nt, Artificial Sequence
  derived and/or modified sequence opt5 from hemagglutinin__InfluenzaA__AEL93598
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggucuuuauugauuacgaagaacugcgggagcagcuuuccagcgugucuuccuucgaacgcuuugagaucuuccccaagaccagcucuuggccuaaucacgacuccaacaagggaguuacagccgcuuguccccaugccggcgcgaaaucuuuuuauaagaaucugaucuggcucgugaaaaagggcaacagcuacccuaaacuguccaagagcuauauuaaugauaaggggaaagaaguccuugugcuguggggaauccaccaccccuccaccacagccgaccaacagucucucuaccagaacgcugaugccuacguguucgucggcaccagcagauauuccaagaaauuuaagccugagauugcuauccggccgaaaguucgcgaccaggaggggagaaugaauuacuauuggacgcugguggaacccggagauaagauuacauucgaggccaccggcaaccugguggucccucgguacgcguuugccauggaacgcaacgcugggagcggaaucauuaucucugacacacccgugcaugauugcaauaccaccugucaaacaccuaaaggcgccaucaacacgucccuccccuuccagaauauucacccgaucaccauuggcaagugcccuaaguauguuaaaagcacaaagcugagacuugcuaccgggcugcggaacgugcccucuauccagagccgcggacucuuuggcgccauugccggguucaucgagggaggcuggacagggauggucgacggaugguacggcuaucaucaccagaaugaacaaggcuccggguacgcugcggaccugaaaucuacccagaacgccaucgauaagauuacgaauaaagugaacagcguuaucgagaagaugaauacacaguuuaccgcugugggaaaggaguucaaccaccuugagaaaagaauugagaaucugaacaagaaagucgacgauggcuuccucgacaucuggaccuacaaugccgaacugcuggugcuccuggagaacgaacggacacuugauuaucaugacuccaaugucaagaaccuguacgagaaagugcgcaaccagcucaagaauaacgccaaggagauugggaauggauguuuugaguucuaucacaaaugcgauaacaccuguauggaaagcguuaagaauggcacauacgacuauccuaaauacucugaagaggcuaagcugaacagagaagagaucgauggggugaaacuugaguccacgcggaucuaucaaauucuggccaucuacagcaccgucgcgucuucccucgugcugguugugagccugggcgcuauuuccuuuuggaugugcucuaauggaagccuccagugccgcaucuguauuuga

SEQ ID NO: 190078 - RNA, 1701 nt, Artificial Sequence
  derived and/or modified sequence opt5 from hemagglutinin__InfluenzaA__AEL93618
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaaaugcaacaucgccggguggauucugggaaauccugagugugaaucucugagcacagccuccucuuggagcuacaucguggagaccuccucuagcgacaacggcacgugcuauccgggggauuuuauugacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuaucuggcugguuaaaaagggcaacagcuacccuaaacucuccaagagcuauauuaaugacaaggggaaagaagugcugguccuuuggggaauccaccaccccuccaccacagccgaucaacagucucuguaccagaacgcugacaccuacguguucgugggcacgagcagauauuccaagaaauuuaagccugagauugccauccggccgaaaguccgcgaucaggaggggagaaugaauuacuauuggacacucguugaacccggagacaagauuaccuucgaggcuacaggcaaccugguggugccucgguacgccuuugcgauggaacgcaacgccgggagcggaaucauuaucucugauacccccguccaugacugcaauaccacaugucaaacgccuaaaggcgcuaucaacaccucccugcccuuccagaauauucacccgaucacaauuggcaagugcccuaaguaugugaaaagcaccaagcucagacuggccacagggcuucggaacguucccucuauccagagccgcggacuguuuggcgcuauugccggguucaucgagggaggcuggaccgggaugguggacggaugguacggcuaucaucaccagaaugaacaaggcuccggguacgccgcugaucucaaaucuacgcagaacgcgaucgacaagauuacaaauaaagucaacagcgugaucgagaagaugaauacccaguuuaccgccguuggaaaggaguucaaccaccuggaaaagagaauugagaaucuuaacaagaaaguggaugacggcuuccuggauaucuggacauacaaugcugaacuccugguccugcucgagaacgaacggacccuggacuaucaugauuccaaugugaagaaccuuuacgagaaaguccgcaaccagcugaagaauaacgccaaggagauugggaauggauguuuugaguucuaucacaaaugcgacaacacauguauggagagcgugaagaauggcacguacgauuauccuaaauacucugaagaggccaagcucaacagagaagagaucgacgggguuaaacuggaguccacccggaucuaucaaauucuugcuaucuacagcacaguggccucuucccugguccucgugguuagccugggcgcgauuuccuuuuggaugugcucuaauggaagccugcagugccgcaucuguauuuga

SEQ ID NO: 190079 - RNA, 1701 nt, Artificial Sequence; identical to SEQ ID NO: 189459
  derived and/or modified sequence opt5 from hemagglutinin__InfluenzaA__AEL93628

SEQ ID NO: 190080 - RNA, 1701 nt, Artificial Sequence; identical to SEQ ID NO: 189894
  derived and/or modified sequence opt5 from hemagglutinin__InfluenzaA__AEL93638

SEQ ID NO: 190081 - RNA, 1701 nt, Artificial Sequence
  derived and/or modified sequence opt5 from hemagglutinin__InfluenzaA__AEL94870
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaggaacugcgggagcagcuuuccagcgucucuuccuucgaacgcuuugagaucuuccccaagaccagcucuuggccugaucacgacuccaauaagggagugacagccgcuuguccccaugccggcgcgaaauccuuuuauaagaaccugaucuggcucguuaaaaagggcaauucuuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaucugguggugccucgguacgcguuugccauggaacgcaacgcugggucuggaaucauuaucuccgacacccccgcccaugacugcaacacaaccugucaaaccccuaaaggcgcuaucaauacaagccuccccuuccagaacauucacccgaucacgauuggcaagugcccuaaguaugucaaaucuaccaagcugagacuugccacagggcugcggaaugugcccagcauccagucccgcggacucuuuggcgccauugcuggguucaucgagggaggcuggaccgggaugguugauggaugguacggcuaucaucaccagaacgaacaaggcucuggguacgcggccgaccugaaaagcacacagaaugcuaucgauaagauuaccaacaaagugaauagcgucaucaagaagaugaacacgcaguuuacagccgugggaaaagaguucaaucaccuugagaagagaauugaaaaccugaauaaaaagguugacgauggcuuccucgacaucuggaccuacaacgccgagcugcuggugcuccuggaaaaugagcggacccuugauuaucaugacagcaacgucaaaaaucuguacgaaaaggugcgcucucagcucaagaacaacgcuaaagagauugggaauggauguuuugaguucuaucacaagugcgauaacacauguauggaauccgucaaaaauggcaccuacgacuauccuaaguacagcgaggaagccaaacugaacagagaggaaaucgauggggugaaacuugagucuacacggaucuaucaaauucuggcgaucuacuccacgguugcuagcucccucgugcuggucgugucucugggcgccauuagcuuuuggaugugcuccaauggaucucuccagugccgcaucuguauuuga

SEQ ID NO: 190082 - RNA, 1701 nt, Artificial Sequence
  derived and/or modified sequence opt5 from hemagglutinin__InfluenzaA__AEL95426
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccacagccgaucaacagucucucuaccagaacgcugacaccuacguguucgugggcacgagcagauauuccaagaaauuuaagccugagauugccacacggccgaaaguccgcgaucaggaggggagaaugaauuacuauuggacccugguugaacccggagacaagaucacauucgaggcuaccggcaaccugguggugccucgguacgccuuugcgauggaacgcaacgccgggagcggaauuaucauuucugauacccccguccaugacugcaauacaacgugucaaaccccuaaaggcgcuaucaacacaucccuccccuuccagaauauccacccgauuaccaucggcaagugcccuaaguaugugaaaagcacaaagcugagacuugccaccgggcugcggaacguucccucuauucagagccgcggacucuuuggcgcuaucgccggguucauugagggaggcuggacggggaugguggacggaugguacggcuaucaucaccagaaugaacaaggcuccggguacgccgcugaucugaaaucuacacagaacgcgaucgacaagaucaccaauaaagucaacagcgugauugagaagaugaauacccaguuuacagccguuggaaaggaguucaaccaccuugagaaaagaaucgagaaucugaacaagaaaguggaugacggcuuccucgauauuuggaccuacaaugcugaacugcugguccuccuggagaacgaacggacacuugacuaucaugauuccaaugugaagaaccuguacgagaaaguccgcaaccagcucaagaauaacgccaaggagaucgggaauggauguuuugaguucuaucacaaaugcgacaacacguguauggaaagcgugaagaauggcaccuacgauuauccuaaauacucugaagaggccaagcugaacagagaagagauugacgggguuaaacuugaguccacacggaucuaucaaauccuggcuauuuacagcaccguggccucuucccucguccuggugguuagccugggcgcgaucuccuuuuggaugugcucuaauggaagccuccagugccgcauuuguaucuga

SEQ ID NO: 190083 - RNA, 1701 nt, Artificial Sequence
  derived and/or modified sequence opt5 from hemagglutinin__InfluenzaA__AEL97631
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcgccccugcaucucggcaaaugcaacauugccggguggauccugggaaauccugagugugaaucucugagcacagcuuccucuuggagcuacauuguggagaccuccucuagcgacaacggcacgugcuauccgggggauuuuaucgacuacgaagaacuccgggagcagcuguccagcgucucuuccuucaagcgcuuugaaaucuuccccaagaccagcucuuggccuaaucacgauuccaacaaaggagugacagccgcuuguccccaugccggcgccaagagcuuuuauaaaaaucuuauuuggcugguuaagaaaggcaacucuuacccuaagcucuccaagagcuauaucaaugacaaagggaaggaggugcugguccuuuggggcauucaccaccccuccaccucugccgaucaacagagccuguaccagaacgcugacgccuacguguucgugggaacauccagauauagcaaaaaguuuaaaccugaaaucgcuauucggccgaagguccgcgaucaggaggggagaaugaauuacuauuggacccucguugagcccggagacaaaaucacguucgaagccacaggcaaccugguggugccucgguacgcguuugccauggagcgcaacgcugggucuggaauuaucaucuccgauacccccguccaugacugcaauacaaccugucaaaccccuaagggcgccauuaacacaagccugcccuuccagaauauccacccgacgaccauuggcaagugcccuaaauaugugaagucuacaaaacucagacuggcuaccgggcuucggaacguucccagcauccagucccgcggacuguuuggcgccauugccggguucaucgaaggaggcuggacagggaugguggacggaugguacggcuaucaucaccagaaugagcaaggcucuggguacgcugcggaucucaagagcacccagaacgccaucgacgaaauuacgaauaaagucaacuccgugaucgagaagaugaauacacaguuuaccgcuguuggaaaggaguucaaccaccuggaaaagagaauugagaaucuuaacaagaaaguggaugacggcuuccuggauaucuggaccuacaaugccgaacuccugguccugcucgagaacgaacggacacuggacuaucaugauagcaaugugaagaaccuuuacgagaaaguccgcucucagcugaagaacaaugccaaggagauugggaacggauguuuugaguucuaucacaaaugcgacaauaccuguauggaguccgugaagaacggcacauacgauuauccuaaauacagcgaagaggcuaagcucaauagagaagagaucgacgggguuaaacuggagucuacgcggaucuaucaaauucuugccaucuacuccaccguggcgagcucccugguccucgugguuucucugggcgcuauuagcuuuuggaugugcuccaacggaucucugcagugccgcaucuguauuuga

SEQ ID NO: 190084 - RNA, 1701 nt, Artificial Sequence
  derived and/or modified sequence opt5 from hemagglutinin__InfluenzaA__AEL99664
augaaggccauccuggugguccuccuguacaccuucgcuacagccaacgcggacacgcuuugcauuggcuaucacgcuaauaacagcaccgauacaguugacaccauccuggagaaaaaugugacagugacccauuccgucaaccuccuggaagauaagcacaaugggaaacuuuguaagcugagaggaguggcgccccuccaucugggcaaaugcaacauugccggguggauccugggaaauccugagugugaaucucucagcacagcuuccucuuggagcuacauuguugagaccuccucuagcgacaacggcacgugcuauccgggggauuuuaucgacuacgaagaacugcgggagcagcuuuccagcgugucuuccuucaagcgcuuugaaaucuuccccaagaccagcucuuggccuaaucacgauuccaacaaaggagucacagccgcuuguccccaugccggcgccaagagcuuuuauaaaaaucugauuuggcucgugaagaaaggcaacucuuacccuaagcuguccaagagcuauaucaaugacaaagggaaggagguucuugugcuguggggcauucaccaccccuccaccucugccgaucaacagagccucuaccagaacgcugacgccuacgucuucgugggaacauccagauauagcaaaaaguuuaaaccugaaaucgcuauucggccgaaggugcgcgaucaggaggggagaaugaauuacuauuggacccuggucgagcccggagacaaaaucacguucgaagccacaggcaaccugguugugccucgguacgcguuugccauggagcgcaacgcugggucuggaauuaucaucuccgauaccagcgugcaugacugcaauacaaccugucaaacccccaagggcgccauuaacacaucucucccuuuccagaauauccaccccauuacgaucggcaagugcccgaaauaugucaagagcaccaaacugagacuugcuacagggcugcggaacgugccuuccauucagucucgcggacucuuuggcgccaucgccggguucaucgaaggaggcuggaccgggaugguugacggaugguacggcuaucaucaccagaaugagcaaggcagcggguacgcugcggaucugaaguccacacagaacgccauugacgaaaucaccaauaaagugaacagcgucauugagaagaugaauacgcaguuuacagcugugggaaaggaguucaaccaccuugagaaaagaaucgagaaucugaacaagaaaguugaugacggcuuccucgauauuuggaccuacaaugccgaacugcuggugcuccuggagaacgaacggacccuugacuaucaugauucuaaugucaagaaccuguacgagaaagugcgcucccagcucaagaacaaugccaaggagaucgggaacggauguuuugaguucuaucacaaaugcgacaauacauguauggaaagcgucaagaacggcaccuacgauuaucccaaauacucugaagaggcuaagcugaauagagaagagaucgacggggugaaacuugaguccacacggauuuaucaaauccuggccauuuacagcacgguugcguccucucucgugcuggucgugagccugggcgcuaucuccuuuuggaugugcucuaacggaagccuccagugccgcauuuguaucuga

SEQ ID NO: 190085 - RNA, 1701 nt, Artificial Sequence
  derived and/or modified sequence opt5 from hemagglutinin__InfluenzaA__AEL99674
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuaucuucgaggccacgggcaaccugguggugccucgguacgcguuugccauggaacgcaacgcugggucuggaauuaucaucuccgauacacccguccaugacugcaauaccacaugucaaaccccuaaaggcgccauuaacaccagccuccccuuccagaauauccacccgauuacaaucggcaagugcccuaaguaugugaaaucuacgaagcugagacuugcuaccgggcugcggaacguucccagcauucagucccgcggacucuuuggcgccaucgccggguucaucgagggaggcuggacagggaugguggacggaugguacggcuaucaucaccagaaugaacaaggcucuggguacgcugcggaucugaaaagcacccagaacgccauugacgagaucacaaauaaggucaacuccgugauugagaaaaugaauacccaguuuacggcuguuggaaaggaguucaaccaccuugagaagagaaucgaaaaucugaacaaaaagguggaugacggcuuccucgauauuuggacauacaaugccgagcugcugguccuccuggaaaacgagcggacccuugacuaucaugauagcaaugugaaaaaccuguacgagaagguccgcucucagcucaaaaacaaugccaaggaaaucgggaacggauguuuugaguucuaucacaagugcgacaauaccuguauggaauccgugaaaaacggcacauacgauuauccuaaguacagcgaggaagcuaaacugaauagagaggagaucgacgggguuaaacuugaaucuacccggauuuaucaaauccuggccauuuacuccacaguggcgagcucccucguccuggugguuucucugggcgcuaucagcuuuuggaugugcuccaacggaucucuccagugccgcauuuguaucuga

SEQ ID NO: 190086 - RNA, 1689 nt, Artificial Sequence; identical to SEQ ID NO: 189295
  derived and/or modified sequence opt5 from hemagglutinin__InfluenzaA__AEM53455

SEQ ID NO: 190087 - RNA, 1689 nt, Artificial Sequence; identical to SEQ ID NO: 184644
  derived and/or modified sequence opt5 from hemagglutinin__InfluenzaA__AEM53468

SEQ ID NO: 190088 - RNA, 1698 nt, Artificial Sequence; identical to SEQ ID NO: 185139
  derived and/or modified sequence opt5 from hemagglutinin__InfluenzaA__AEM60037

SEQ ID NO: 190089 - RNA, 1698 nt, Artificial Sequence
  derived and/or modified sequence opt5 from hemagglutinin__InfluenzaA__AEM60058
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagagucucacaacgggaaacuuugccugcucaagggaaucgcgccccugcagcugggcaauuguagcguugcuggguggauucucggaaacccugaaugcgagcugcuuaucuccaaagaaucuuggagcuacauuguggagaccccgaaucccgagaacggcacguguuauccuggguacuuugccgauuaugaagaacugagagaacaacucuccucugucagcuccuucgagcgguuugagaucuuccccaaggaaagcucuuggccuaaucauaccgugacaggaguuuccgccagcugcucucacaacggcgaguccagcuuuuaccgcaaucugcuuuggcugaccggcaagaacgggcucuaucccaaucugucuaaauccuacgcuaacaauaaggaaaaagacgugcugguccucuggggagugcaucacccuccgaacaucggcgaucagagagcccuguaccacacagagaacgcuuaugugagcgucguuuccucucauuacagccggcgcuucacccccgaaauugccaagagaccuaaagugcgggaccaggaggggcgcaucaauuauuacuggacgcuucuggagcccggagauacaauuaucuuugaagcgaacggcaaucucauugccccuagauucgcuuuugcccuggggcggggauucggcuccggcaucauuaccagcaacgcucccauggacaagugugaugccaagugccagacaccgcaaggggcgaucaauucuucccuuccuuuucagaacgugcaccccgucaccaucggagaguguccuaaauaugugcgcagcaccaagcugagaaugguuacaggccuccggaauauucccucuauccagagccgcgggcuguucggagccauugcuggcuuuaucgaagggggauggacgggcaugguggacggcugguacggguaucaucaccagaacgagcaaggauccggcuacgccgcugaucagaaaucuacccagaaugccauuaacgggaucacaaauaaggucaacagcgugaucgagaaaaugaauacccaguucacagccguuggaaaggaguucaacaaacuggagagacggauggaaaaucucaacaagaagguggacgauggcuuucuggacauuuggaccuacaacgcugagcuucugguccuccuggaaaaugagcgcacgcuugacuuccacgauuccaacgugaaaaaucuguaugaaaaggucaaaagccaacucaagaacaaugcgaaagagaucgggaacggcugcuuugaguucuaccauaaguguaaugacgaaugcauggagucugugaagaacggaacauaugauuaccccaaauauuccgaagagagcaagcugaauagagagaaaauugacggcguuaagcuggaaucuauggggguguaccagauccucgccauuuauuccaccgucgcuagcucccuggugcuucugguuucucucggagccaucagcuuuuggaugugcuccaacggcucucugcagugucggaucugcauuuga

SEQ ID NO: 190090 - RNA, 1701 nt, Artificial Sequence
  derived and/or modified sequence opt5 from hemagglutinin__InfluenzaA__AEM60069
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacgagaagugggaucuguuugucgaacgcagcaaagccuauuccaauuguuacccuuaugacgugcccgauuacgcuucucucagaagccugguugccuccagcgggacgcuugaguucauuaacgaagacuuuaauuggaccggagugacacagucuggcggcuccuaugcuugcaagcgggggagcgucaagucuuucuuuucccgccugaacuggcuccacgagagcgaguacaaauauccugcccugaaugugaccaugcccaacaauggaaaguucgauaaacuuuacaucuggggcguucaucacccuucuacagacagagaacaaaccaaccuguacgugcgggcguccgggcgcgucacggugagcacaaagagaucccagcagaccgugauuccgaauaucggaucucggcccuggguccgcggccucagcuccagaauuagcaucuauuggacaauuguuaaaccuggggauauccugcugaucaacucuaccggaaaccucauugcuccccggggcuacuuuaagauccgcaccggcaaguccagcauuaugagaucugacgccccuaucgggacauguagcuccgagugcauuacgcccaauggaucuaucccgaacgacaaaccuuuccagaaugugaacaagaucaccuauggcgccuguccccgguacgugaaacaaaauacacugaaacuugcuaccgggaugcgcaacgucccugaaaagcagacaagaggaauuuuuggcgccaucgcgggguucauugagaauggaugggagggcaugguggauggcugguauggguuucggcaccagaacagcgaaggaaccggccaggccgcugaccugaaguccacgcaagccgcuaucgaucagauuaaugggaaacucaacagacugaucgagaagacaaaugaaaaguuccaucagaucgagaaagaguucagcgaaguugagggacgcauucaagaccuugaaaaguacguggaggauaccaaaaucgaccuguggucuuauaacgccgaacuccuggucgcccuggagaaucagcacaccauugaucucacagacuccgaaaugaacaagcuguuugagaaaacccggaagcagcuuagagagaaugcugaagauaugggcaacgggugcuucaagaucuaccauaaaugugacaacgcgugcauuggcagcauccgcaauggaacauacgaucacgacguguaucgggacgaggcccugaacaauagauuucagauuaagggcguugaacucaaaucuggguacaaggauuggauccuguggaucuccuucgcuauuagcugcuuucuucugugugugguccuccugggauucaucaugugggccugccaaaaaggcaacauucgcuguaauaucugcauuuga

SEQ ID NO: 190091 - RNA, 1701 nt, Artificial Sequence
  derived and/or modified sequence opt5 from hemagglutinin__InfluenzaA__AEM92308
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagagaaacagcuacccuaaacuguccaagagcuauauuaaugacaagggcaaagaagugcuuguccugugggggauccaccaccccuccaccucugccgaucaacagagccucuaccagaacgcugacgccuacguguucgugggauccagccgguauucuaagaaauuuaagccugagauugcuauccgcccgaaagucagagaucaggagggccggaugaauuacuauuggacacugguugaacccggggacaagauuaccuucgaggccacggaaaaccugguggugccucgcuacgcguuugccauggagagaaacgcuggauccggcaucauuaucagcgauacacccguccaugacugcaauaccacaugucaaaccccuaaaggggccaucaacaccucucuccccuuccagaauauucacccgaucacaauuggaaagugcccuaaguaugugaaaagcacgaagcugcggcuugcuaccggccugcgcaacguucccuccauccagucuagaggccucuuuggggccauugccggauucaucgaaggcggguggacaggaaugguggacggcugguacggguaucaucaccagaaugagcaaggaagcggcuacgcugcggaucugaaauccacccagaacgccaucgacgagauuacaaauaaggucaacagcgugaucgaaaagaugaauacccaguuuacggcuguuggcaaggaguucaaccaccuugaaaagcggauugagaaucugaacaaaaagguggaugacggguuccucgauaucuggacauacaaugccgaacugcugguccuccuggagaacgagcgcacccuugacuaucaugauucuaaugugaaaaaccuguacgaaaaggucagaucccagcucaaaaacaaugccaaggaggugggaaacggcuguuuugaguucuaucacaagugcgacaauaccuguauggagagcguuaaaaacgggacauacgauuauccuaaguacucugaagaggcuaaacugaaucgggaggaaauugacggagugaaacuugaguccacccgcaucuaucaaauccuggccauuuacagcacagcggcuuccucucucguccuggugguuagccugggcgccaucuccuuuuggaugugcucuaacgggagccuccagugcagaauuuguaucuga

SEQ ID NO: 190092 - RNA, 1701 nt, Artificial Sequence
  derived and/or modified sequence opt5 from hemagglutinin__InfluenzaA__AEM92318
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccguggaucuccuggaagacaagcacaacgggaaacuuuguaagcugagaggaguugcuccccuccaucugggcaaaugcaauaucgccggguggauucugggaaacccugagugugaaucucucagcacagccuccucuuggagcuacaucguggagaccuccucuagcgauaauggcacgugcuauccgggggacuuuauugauuacgaagaacugcgggagcagcuuuccagcgucucuuccuucgaacgcuuugagaucuuccccaagaccagcucuuggccuaaccacgacuccaauaagggagugacagccgcuuguccccaugccggcgaaaagagcuuuuauaagaaccugaucuggcucguuaaaaagggcaauucuuacccuaaacugaacaaguccuauauuaaugauaaggggaaagaggugcuuguccuguggggaauccaccaccccagcaccuccgcggaccaacagucucucuaccagaacgccgaugcuuacguguucgugggcacaagcagauauuccaagaaauuuaagccugagauugccauccggccgaaaguccgcgaccaggaagggagaaugaauuacuauuggacccugguugagcccggagauaagauuacguucgaagcuacaggcaaccugguggugccucgguacgccuuugcgauggagcgcaacgccgggagcggaaucauuaucucugacacccccauccaugacugcaauacaaccugucaaaccccuaaaggcgcuauuaacacaucccuccccuuccagaauauccacccgauuacgaucggcaagugcccuaaguaugucaaaagcaccaagcugagacuugccacagggcugcggaacgugcccucuauucagagccgcggacucuuuggcgcuaucgccggguucaucgaaggaggcuggaccgggaugguugauggaugguacggcuaucaucaccagaaugagcaaggcuccggguacgccgcugaccugaaaucuacacagaacgcgauugaugagaucaccaauaaggugaacagcgucauugagaaaaugaauacgcaguuuacagccgugggaaaggaguucaaccaccuugaaaagagaaucgagaaucugaacaaaaagguugacgauggcuuccucgacauuuggaccuacaaugcugaacugcuggugcuccuggagaacgagcggacccuugauuaucaugacuccaaugucaaaaaccuguacgaaaaggugcgcaaccagcucaaaaauaacgccaaggagaucgggaauggauguuuugaguucuaucacaagugcgauaacacauguauggaaagcgucaaaaauggcaccuacgacuauccuaaguacucugaagaggccaaacugaacagagaggaaaucgauggggugaaacuugaguccacacggauuuaucaaauccuggcuauuuacagcacgguugccucuucccucgugcuggucgugagccugggcgcgaucuccuuuuggaugugcucuaauggaagccuccagugccgcauuuguaucuga

SEQ ID NO: 190093 - RNA, 1701 nt, Artificial Sequence
  derived and/or modified sequence opt5 from hemagglutinin__InfluenzaA__AEM92328
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacugaauauuuccuauaucaacgacaaggggaaggaagugcuuguccuguggggcauucaccaccccagcaccacagccgaucaacagucccucuaccagaaugcugacgccuacguguucgugggaaccucuagauauagcaaaaaguuuaaaccugagaucgcuauucggccgaagguccgcgaucaggaggggagaaugaacuacuauuggacgcugguugaacccggagacaaaaucacauucgaggccaccggcaaccugguggugccucgguacgcguuugccauggaacgcaaugcuggguccggaauuaucaucagcgauacacccguccaugacugcaacaccaccugucaaacaccuaagggcgccauuaauacgucucuccccuuccagaacauccacccgauuaccaucggcaaaugcccuaaguaugugaaguccacaaaacugagacuugcuaccgggcugcggaauguucccagcauucagucucgcggacucuuuggcgccaucgccggguucaucgagggaggcuggacagggaugguggacggaugguacggcuaucaucaccagaacgaacaaggcagcggguacgcugcggaucugaaguccacccagaaugccauugacaaaaucacgaacaaggucaauucugugauugagaaaaugaacacacaguuuaccgcuguuggaaaggaguucaaucaccuugaaaagagaaucgagaaccugaauaaaaagguggaugacggcuuccucgauauuuggaccuacaacgccgaacugcugguccuccuggagaaugaacggacacuugacuaucaugauagcaacgugaaaaaccuguacgagaagguccgcaaucagcucaaaaacaaugccaaggagaucgggaacggauguuuugaguucuaucacaagugcgacaauaccuguauggaguccgugaaaaacggcacauacgauuauccuaaguacagcgaagaggcuaaacugaauagagaagagaucgacgggguuaaacuugagucuacgcggauuuaucaaauccuggccauuuacuccaccguggcgagcucucucguccuggugguuucccugggcgcuaucagcuuuuggaugugcuccaacggaucucuccagugccgcauuuguaucuga

SEQ ID NO: 190094 - RNA, 1701 nt, Artificial Sequence
  derived and/or modified sequence opt5 from hemagglutinin__InfluenzaA__AEM92348
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccguggaucuccuggaagacaagcacaacgggaaacuuuguaagcugagaggaguugcuccccuccaucugggcaaaugcaauaucgccggguggauucugggaaacccugagugugaaucucucagcacagccuccucuuggagcuacaucguggagaccuccucuagcgauaauggcacgugcuauccgggggacuuuauugauuacgaagaacugcgggagcagcuuuccagcgucucuuccuucgaacgcuuugagaucuuccccaagaccagcucuuggccuaaccacgacuccaauaagggagugacagccgcuuguccccaugccggcgaaaagagcuuuuauaagaaccugaucuggcucguuaaaaagggcaauucuuacccuaaacugaacaaguccuauauuaaugauaaggggaaagaggugcuuguccuguggggaauccaccaccccagcaccuccgcggaccaacagucucucuaccagaacgccgaugcuuacguguucgugggcacaagcagauauuccaagaaauuuaagccugagauugccauccggccgaaaguccgcgaccaggaagggagaaugaauuacuauuggacccugguugagcccggagauaagauuacguucgaagcuacaggcaaccugguggugccucgguacgccuuugcgauggagcgcaacgccgggagcggaaucauuaucucugacacccccauccaugacugcaauacaaccugucaaaccccuaaaggcgcuauuaacacaucccuccccuuccagaauauccacccgauuacgaucggcaagugcccuaaguaugucaaaagcaccaagcugagacuugccacagggcugcggaacgugcccucuauucagagccgcggacucuuuggcgcuaucgccggguucaucgaaggaggcuggaccgggaugguugauggaugguacggcuaucaucaccagaaugagcaaggcuccggguacgccgcugaccugaaaucuacacagaacgcgauugaugagaucaccaauaaggugaacagcgucauugagaaaaugaauacgcaguuuacagccgugggaaaggaguucaaccaccuugaaaagagaaucgagaaucugaacaaaaagguugacgauggcuuccucgacauuuggaccuacaaugcugaacugcuggugcuccuggagaacgagcggacccuugauuaucaugacuccaaugucaaaaaccuguacgaaaaggugaaaagccagcucaagaacaaugccaaggagaucgggaacggauguuuugaguucuaucacaaaugcgauaauacauguauggaaucugucaagaacggcaccuacgacuauccuaaauacuccgaagaggccaagcugaaucgcgagaaaaucgauggggugaaacuugaaagcacaagaauuuaucaaauccuggcuauuuacucuacgguugccuccagccucgugcuggucgugucccugggcgcgaucucuuuuuggaugugcagcaacggaucccuccagugccggauuuguaucuga

SEQ ID NO: 190095 - RNA, 1701 nt, Artificial Sequence
  derived and/or modified sequence opt5 from hemagglutinin__InfluenzaA__AEM92358
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaagaaggcaauagcuacccuaagcuguccaaaagcuauauuaacgauaaggggaaggaggugcuuguccuguggggaauccaccaccccuccaccacaaccgaccaacagucucucuaccagaaugccgaugcuuacguguucgugggcacgagcagauauuccaaaaaguuuaaaccugagauugccauccggccgaagaugcgcgaccaggaagggagaaugaacuacuauuggacacuggucgagcccggagauaaaauuaccuucgaagcuacaggcaaccugguugugccucgguacgccuuugcgauggagcgcaaugccgggagcggaaucauuaucucugacacccccgugcaugauugcaacaccacaugucaaacgccuaagggcgcuaucaauaccucccuccccuuccagaacauucacccgaucacaauuggcaaaugcccuaaguaugucaagagcaccaaacugagacuugccacagggcugcggaaugugcccucuauccagagccgcggacucuuuggcgcuauugccggguucaucgaaggaggcuggaccgggaugguugacggaugguacggcuaucaucaccagaacgagcaaggcuccggguacgccgcugaccugaagucuacgcagaaugcgaucgauaaaauuacaaacaaggugaauagcgucaucgagaaaaugaacacccaguuuaccgccgugggaaaggaguucaaucaccuugagaagagaauugaaaaccugaauaaaaagguugacgauggcuuccucgacaucuggacauacaacgcugagcugcuggugcuccuggaaaaugagcggacccuugauuaucaugacuccaacgucaaaaaccuguacgagaaggugcgcaaucagcucaaaaacaaugccaaggaaauugggaacggauguuuugaguucuaucacaagugcgauaauacauguauggaaagcgucaaaaacggcacguacgacuauccuaaguacucugaggaagccaaacugaauagagaggagaucgauggggugaaacuugaauccacccggaucuaucaaauucuggcuaucuacagcacaguugccucuucccucgugcuggucgugagccugggcgcgauuuccuuuuggaugugcucuaacggaagccuccagugccgcaucuguauuuga

SEQ ID NO: 190096 - RNA, 1701 nt, Artificial Sequence
  derived and/or modified sequence opt5 from hemagglutinin__InfluenzaA__AEM92368
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacugaauaaguccuauauuaacgacaaggggaaagaagugcuuguccuguggggaauccaccaccccagcaccacagccgaucaacagucccucuaccagaaugcugacgccuacguguucgugggcaccucuagauauagcaagaaauuuaagccugagauugcuauccggccgaaaguccgcgaucaggaggggagaaugaacuacuauuggacgcugguugaacccggagacaagauuacauucgaggccaccggcaaccugguggugccucgguacgcguuugccauggaacgcaaugcuggguccggaaucauuaucagcgauacacccguccaugacugcaacaccaccugucaaacaccuaaaggcgccaucaauacgucucuccccuuccagaacauucacccgaucaccauuggcaagugcccuaaguaugugaaauccacaaagcugagacuugcuaccgggcugcggaauguucccagcauccagucucgcggacucuuuggcgccauugccggguucaucgagggaggcuggacagggaugguggacggaugguacggcuaucaucaccagaacgaacaaggcagcggguacgcugcggaucugaaauccacccagaaugccaucgacaagauuacgaacaaagucaauucugugaucgagaagaugaacacacaguuuaccgcuguuggaaaggaguucaaucaccuugagaaaagaauugagaaccugaauaagaaaguggaugacggcuuccucgauaucuggaccuacaacgccgaacugcugguccuccuggagaaugaacggacacuugacuaucaugauagcaacgugaagaaccuguacgagaaaguccgcaaucagcucaagaacaaugccaaggagauugggaacggauguuuugaguucuaucacaaaugcgacaauaccuguauggaauccgugaagaacggcacauacgauuauccuaaauacagcgaagaggcuaagcugaauagagaagagaucgacgggguuaaacuugagucuacgcggaucuaucaaauucuggccaucuacuccaccguggcgagcucucucguccuggugguuucccugggcgcuauuagcuuuuggaugugcuccaacggaucucuccagugccgcaucuguauuuga

SEQ ID NO: 190097 - RNA, 1701 nt, Artificial Sequence
  derived and/or modified sequence opt5 from hemagglutinin__InfluenzaA__AEM92378
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuaauuccgucagcucuuucgaacgcuuugagaucuuccccaagaccuccagcuggccuaaccacgauucuaauaagggagugacagccgcuuguccccaugccggcgcgaaauccuuuuauaagaaccugaucuggcucguuaaaaagggcaauagcuacccuaaacugaacaagucuuauauuaaugacaaggggaaagaagugcuuguccuguggggaauccaccaccccuccaccacagccgaucaacagagccucuaccagaacgcugacgccuacguguucgugggcaccuccagauauucuaagaaauuuaagccugagauugcuauccggccgaaaguccgcgaucaggaggggagaaugaacuacuauuggacgcugguugaacccggagacaagauuacauucgaggccaccggcaaucugguggugccucgguacgcguuugccauggaacgcaacgcugggagcggaaucauuaucuccgauacacccguccaugacugcaauaccaccugucaaacaccuaaaggcgccaucaacacgagccuccccuuccagaauauucacccgaucaccauuggcaagugcccuaaguaugugaaaucuacaaagcugagacuugcuaccgggcugcggaacguucccuccauccagagccgcggacucuuuggcgccauugccggguucaucgagggaggcuggacagggaugguggacggaugguacggcuaucaucaccagaaugaacaaggcucuggguacgcugcggaucugaaaagcacccagaacgccaucgacaagauuacgaauaaagucaacuccgugaucgagaagaugaauacacaguuuaccgcuguuggaaaggaguucaaccaccuugagaaaagaauugagaaucugaacaagaaaguggaugacggcuuccucgauaucuggaccuacaaugccgaacugcugguccuccuggagaacgaacggacacuugacuaucaugauucuaacgugaagaaucuguacgagaaaguccgcaaccagcucaagaauaacgccaaggagauugggaauggauguuuugaguucuaucacaaaugcgacaacaccuguauggaaagcgugaagaauggcacauacgauuauccuaaauacuccgaagaggcuaagcugaacagagaagagaucgacgggguuaaacuugagagcacgcggaucuaucaaauucuggccaucuacucuaccguggcguccagccucguccuggugguuucucugggcgcuauuuccuuuuggaugugcagcaauggaucccuccagugccgcaucuguauuuga

SEQ ID NO: 190098 - RNA, 1701 nt, Artificial Sequence
  derived and/or modified sequence opt5 from hemagglutinin__InfluenzaA__AEM92407
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccaacuccuggucuuacaucguggagaccagcuccucugacaauggcacgugcuauccgggggauuuuauugacuacgaagaacugcgggagcagcuuagcuccgucagcucuuucgaacgcuuugagaucuuccccaagaccaacuccuggccuaaucacgauagcaacaagggagugacagccgcuuguccccaugccggcgcgaaaucuuuuuauaagaaucugaucuggcucguuaaaaagggcaacuccuacccuaaacugagcaagucuuauauuaaugacaaggggaaagaagugcuuguccuguggggaauccaccaccccuccaccagcacagaucaacagucccucuaccagaacgccgacgcuuacguguucgugggcaccucuagauauagcaagaaauuuaagccugagauugccauccggccgaaaguccgcaaccaggaggggagaaugaauuacuauuggacgcugguugaacccggagauaagauuacauucgaggcuaccggcaaccugguggugccucgguacgccuuuacaaucgaacgcaaugcgggguccggaauuaucaucagcgacacccccauucaugauugcaacaccacaugucaaacgccuaaaggcgccaucaauaccucucuccccuuccagaacauucacccgaucacaauuggcaagugcccuaaguaugucaaauccaccaagcugagacuugcuacagggcugcggaaugugcccagcauccagucucgcggacucuuuggcgccaucgcuggguucauugagggaggcuggaccgggaugguugacggaugguacggcuaucaucaccagaacgaacaaggcagcggguacgccgccgaccugaaauccacgcagaaugcuaucgaugagauuacaaacaaggucaauucugugaucgagaaaaugaacacccaguuuaccgcggugggaaaggaguucaaucaccuugagaagagaauugaaaaccugaauaaaaagguugacgauggcuuccucgacaucuggacacauaacgccgagcugcuggugcuccuggaaaacgagcggacccuugauuaccacgacagcaaugucaaaaaccuguaugagaaggugcgcucccagcucaaaaauaacgcuaaggaaaucgggaauggauguuuugaguucuaccauaagugcgauaacacauguauggaaagcgucaaaaauggcacguaugacuacccuaaguauucugaggaagccaaacugaacagagaggagauugauggggugaaacuugaauccacccggaucuaccaaauucuggccaucuauagcacaguugcuucuucccucgugcuggucgugagccugggcgccauuuccuuuuggaugugcucuaugggaagccuccagugccgcaucuguauuuga

SEQ ID NO: 190099 - RNA, 1701 nt, Artificial Sequence
  derived and/or modified sequence opt5 from hemagglutinin__InfluenzaA__AEM92417
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaaaugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaaggccagcucuuggccuaaucacgauuccaacaagggagugaccgcugccuguccccaugcgggcgccaagagcuuuuauaagaaucuuauuuggcugguuaaaaaggaaaacucuuacccuaaacucuccaagagcuauaucaaugacaagggcaaagaggugcugguccuuugggggauucaccaccccuccacaucugcugaucaacagagccuguaccagaacgccgacgcuuacguguucgugggauccagcagauauucuaagaaauuuaagccugagaucgccauucggccgaaaguccgcgaucaggaaggcagaaugaauuacuauuggacccucguugagcccggggacaagaucacauucgaagcgaccggaaaccugguggugccucgguacgccuuugcuauggagcgcaacgccggcuccgggauuaucaucagcgauacgcccguccaugacugcaauacaaccugucaaacaccuaaaggagcuauuaacaccucucugcccuuccagaauauccacccgauuaccaucggcaagugcccuaaguaugugaaaagcacaaagcucagacuggccacgggccuucggaacguucccuccauucagucucgcgggcuguuuggagccaucgcuggcuucaucgaagggggauggaccggcaugguggacgggugguacggauaucaucaccagaaugagcaaggcagcggcuacgcggccgaucucaaauccacacagaacgcuauugacgagaucaccaauaaggucaacagcgugauugagaaaaugaauacacaguuuaccgccguugggaaggaguucaaccaccuggaaaagagaaucgagaaucuuaacaaaaagguggaugacggauuccuggauauuuggacguacaaugccgaacuccugguccugcucgagaacgagcggacacuggacuaucaugauucuaaugugaaaaaccuuuacgaaaagguccgcucccagcugaaaaacaaugcuaaggagaucggcaacggguguuuugaguucuaucacaagugcgacaauaccuguauggaaagcgugaaaaacggaaccuacgauuauccuaaguacucugaagaggccaaacucaauagagaggaaaucgacggcguuaagcuggaguccacacggauuuaucaaauccuugcgauuuacagcaccguggcuuccucucugguccucgugguuagccugggggccaucuccuuuuggaugugcucuaacggcagccugcagugccgcauuuguaucuga

SEQ ID NO: 190100 - RNA, 1701 nt, Artificial Sequence
  derived and/or modified sequence opt5 from hemagglutinin__InfluenzaA__AEM92428
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauauguguauggaauccgugaaaaacggcacauacgauuauccuaaguacagcgaggaagcuaaacugaauagagaggagaucgacgggguuaaacuugaaucuacccggaucuaucaaauucuggccaucuacuccacaguggcgagcucccucguccuggugguuucucugggcgcuauuagcuuuuggaugugcuccaacggaucucuccagugccgcaucuguauuuga

SEQ ID NO: 190101 - RNA, 1701 nt, Artificial Sequence
  derived and/or modified sequence opt5 from hemagglutinin__InfluenzaA__AEM92438
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuaaguccuauauuaaugacaagggaaaagaagugcuuguccuguggggcauccaccaccccagcaccacagccgaucaacagucccucuaccagaacgcugacaccuacguguucguggggacgucuagauauagcaagaaauuuaagccugagauugccauccggccgaaaguccgcgaucaggagggaagaaugaauuacuauuggacacugguugaacccggcgacaagauuaccuucgaggcuacagggaaccugguggugccucgguacgccuuugcgauggaacgcaacgccggauccggcaucauuaucagcgauacccccguccaugacugcaauaccacaugucaaacgccuaaaggcgcuaucaacaccucucuccccuuccagaauauucacccgaucacaauugggaagugcccuaaguaugugaaauccaccaagcugagacuugccacaggacugcggaacguucccagcauccagucucgcggccucuuuggggcuauugccggauucaucgagggcggguggaccggaaugguggacggcugguacggcuaucaucaccagaaugaacaagggagcggauacgccgcugaucugaaauccacgcagaacgcgaucgacaagauuacaaauaaagucaacucugugaucgagaagaugaauacccaguuuaccgccguuggcaaggaguucaaccaccuugagaaaagaauugagaaucugaacaagaaaguggaugacggguuccucgauaucuggacauacaaugcugaacugcugguccuccuggagaacgaacggacccuugacuaucaugauagcaaugugaagaaccuguacgagaaaauucgcaaccagcucaagaauaacgccaaggagaucggaaauggcuguuuugaguucuaucacaaaugcgacaacacauguauggaauccgucaagaaugggacguacgauuauccuaaauacagcgaagaggccaagcugaacagagaagagaucgacggcgugaaacuugagucuacccggauuuaucaaauccuggcuauuuacuccacaguugccagcucucucgugcuggucgugucccugggagcgaucagcuuuuggaugugcuccaauggcucucuccagugccgcauuuguaucuga

SEQ ID NO: 190102 - RNA, 1701 nt, Artificial Sequence; identical to SEQ ID NO: 189833
  derived and/or modified sequence opt5 from hemagglutinin__InfluenzaA__AEM92448

SEQ ID NO: 190103 - RNA, 1701 nt, Artificial Sequence; identical to SEQ ID NO: 189833
  derived and/or modified sequence opt5 from hemagglutinin__InfluenzaA__AEM92458

SEQ ID NO: 190104 - RNA, 1701 nt, Artificial Sequence
  derived and/or modified sequence opt5 from hemagglutinin__InfluenzaA__AEM92468
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccaaguauagcaaagaguuuaagccugagauugcugucagaccgaaaguucgggaccaggaagggcgcaugaacuacuauuggacccugguggagcccggagauaagaucacguucgaagccacaggcaaccugcucgugccuagauacgcguuugccauggagcggaaugcugggucuggaauuaucauuuccgacacccccguccaugauugcaacacaaucugucaaaccccuaaaggcgccaucaauaccagccugcccuuccagaacauucacccgaucacaauuggcaagugcccuaaguaugugaaaucuacgaaacuucgccuggcuaccgggcucagaaauguucccagcauccagucccggggacuguuuggcgccauugccggguucaucgaaggaggcuggacagggaugguggacggaugguacggcuaucaucaccagaacgagcaaggcucuggguacgcugcggaccuuaagagcacccagaaugccaucgauaagauuacaaacaaagucaauuccgugaucgagaagaugaacacccaguuuacggcuguuggaaaggaguucaaucaccuggagaaacgcauugaaaaccucaauaagaaaguggacgauggcuuccuggacaucuggacauacaacgccgagcugcucguccugcuugaaaaugagagaacccuggauuaucaugacagcaacgugaagaaccucuacgagaaaguccggucucagcugaagaauaacgccaaggaaauugggaauggauguuuugaguucuaucacaaaugcgauaacaccuguauggaauccgugaagaauggcacauacgacuauccuaaauacagcgaggaagcuaaacuuaaccgcgaggagaucgaugggguuaagcuggaaucuaccagaaucuaucaaauucucgccaucuacuccacaguggcgagcucccugguccuggugguuucucucggcgcuauuagcuuuuggaugugcuccaauggaucucugcagugccggaucuguauuuga

SEQ ID NO: 190105 - RNA, 1701 nt, Artificial Sequence
  derived and/or modified sequence opt5 from hemagglutinin__InfluenzaA__AEM92478
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccaaguauagcaaaaaguuuaaaccugagauugcugucagaccgaagguucgggaccaggaggggcgcaugaacuacuauuggacccugguggaacccggagauaaaaucacguucgaggccacaggcaaccugcucgugccuagauacgcguuugccauggaacggaaugcugggucuggaauuaucauuuccgacacccccguccaugauugcaacacaaucugucaaaccccuaagggcgccaucaauaccagccugcccuuccagaacauucacccgaucacaauuggcaagugcccuaaauaugugaagucuacgaaacuucgccuggcuaccgggcucagaaauguucccagcauccagucccggggacuguuuggcgccauugccggguucaucgagggaggcuggacagggaugguggacggaugguacggcuaucaucaccagaacgaacaaggcucuggguacgcugcggaccuuaagagcacccagaaugccaucgauaaaauuacaaacaaggucaauuccgugaucgagaagaugaacacccaguuuacggcuguuggaaaagaguucaaucaccuggaaaagcgcauugagaaccucaauaaaaagguggacgauggcuuccuggacaucuggacauacaacgccgaacugcucguccugcuugagaaugaaagaacccuggauuaucaugacagcaacgugaaaaaccucuacgagaagguccggucucagcugaagaauaacgccaaagagauugggaauggauguuuugaguucuaucacaagugcgauaacaccuguauggaguccgugaaaaauggcacauacgacuauccuaaguacagcgaagaggcuaaacuuaaccgcgaagagaucgaugggguuaagcuggagucuaccagaaucuaucaaauucucgccaucuacuccacaguggcgagcucccugguccuggugguuucucucggcgcuauuagcuuuuggaugugcuccaauggaucucugcagugccggaucuguauuuga

SEQ ID NO: 190106 - RNA, 1701 nt, Artificial Sequence
  derived and/or modified sequence opt5 from hemagglutinin__InfluenzaA__AEM92498
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccaacuccuggucuuacaucguggagaccagcuccucugacaauggcacgugcuauccgggggauuuuauugacuacgaagaacugcgggagcagcuuagcuccgucagcucuuucgaacgcuuugagaucuuccccaagaccaacuccuggccuaaucacgauagcaacaagggagugacagccgcuuguccccaugccggcgcgaaaucuuuuuauaagaaucugaucuggcucguuaaaaagggcaacuccuacccuaaacugagcaagucuuauauuaaugacaaggggaaagaagugcuuguccuguggggaauccaccaccccuccaccagcgccgaucaacagucccucuaccagaacgcugacgccuacguguucgugggcacaucuagauauagcaagaaauuuaagccugagauugcuauccggccgaaaguccgcgaucaggaggggagaaugaacuacuauuggacccugguugaacccggagacaagauuacguucgaggccacaggcaaucugguggugccucgguacgcguuugccauggaacgcaacgcuggguccggaaucauuaucagcgauacccccgcccaugacugcaauacaaccugucaaaccccuaaaggcgcuaucaacacaucucuccccuuccagaauauucacccgaucacgauuggcaagugcccuaaguaugucaaauccaccaagcugagacuugccacagggcugcggaacgugcccagcauccagucucgcggacucuuuggcgccauugcuggguucaucgagggaggcuggaccgggaugguugacggaugguacggcuaucaucaccagaaugaacaaggcagcggguacgcggccgaucugaaauccacacagaacgcuaucgacaagauuaccaauaaagugaacucugucaucgagaagaugaauacgcaguuuacagccgugggaaaggaguucaaccaccuugagaaaagaauugagaaucugaacaagaaaguugaugacggcuuccucgauaucuggaccuacaaugccgaacugcuggugcuccuggagaacgaacggacccuugacuaucaugauagcaacgucaagaaucuguacgagaaagugcgcucccagcucaagaacaaugcuaaggagauugggaacggauguuuugaguucuaucacaaaugcgacaauacauguauggaaagcgucaagaacggcaccuacgauuauccuaaauacucugaagaggccaagcugaauagagaagagaucgacggggugaaacuugaguccacacggaucuaucaaauucuggcgaucuacagcacgguugcuucuucccucgugcuggucgugagccugggcgccauuuccuuuuggaugugcucuaacggaagccuccagugccgcaucuguauuuga

SEQ ID NO: 190107 - RNA, 1701 nt, Artificial Sequence
  derived and/or modified sequence opt5 from hemagglutinin__InfluenzaA__AEM92518
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaggagcugcgggagcagcuuuccagcgucucuuccuucgaacgcuuugagaucuuccccaagaccagcucuuggccuaaucacgauuccaacaagggagugacaaccgccuguccccaugcuggcgccaagagcuuuuauaaaaaucugaucuggcucguuaaaaagggcaacucuuacccuaaacuguccaagagcuauauuaaugacaagagaaaagaagugcuuguccugugggggauccaccaucccccuacauccgcggaucaacagucucucuaccagaacgccgacgcuuacguguucgugggaaccagccgguauuccaagaaauuuaagccggagauugccauccgccccaaagucagagaucaggagggccggaugaauuacuauuggacgcugguugaaccuggggacaagauuacauucgaggcuaccggaaaccugguggugccccgcuacgccuuugcgauggaaagaaacgccggcagcgggaucauuaucucugauacaccuguccacgacugcaaugcuaccugucaaacccccaaaggagccaucaacacaucccucccguuccagaauauucacccuaucacgauuggcaagugccccaaguaugugaaaagcaccaagcugcggcuugcuacaggccugcgcaacguuccuucuauccagagcagagggcucuuuggagccauugccggcuucaucgaagggggauggaccggcaugguggacgggugguacggauaucaucaccagaaugaacaaggcuccggcuacgcugcggaucugaaaucuacacagaacgccaucgacgagauuaccaauaaggucaacagcgugaucgagaaaaugaauacgcaguuuacagcuguugggaaggaguucaaccaccuugaaaagcggauugaaaaucugaacaaaaagguggaugacggauuccucgauaucuggaccuacaaugccgagcugcugguccuccuggaaaacgagcgcacccuugacuaucaugauuccaaagugaagaaucuguacgagaaagucagaagccagcucaagaacaacgccaaggaaauuggcaauggguguuuugaguucuaucacaaaugcgacaacacauguauggaaucugugaagaauggaaccuacgauuaucccaaauacuccgaggaagcuaagcugaaccgggaggagaucgacggcguuaaacuugaaagcacacgcaucuaucaaauucuggccaucuacucuacgguggcguccagccucguccuggugguuucccugggggcuauuucuuuuuggaugugcagcaauggcucccuccagugcagaaucuguauuuga

SEQ ID NO: 190108 - RNA, 1701 nt, Artificial Sequence
  derived and/or modified sequence opt5 from hemagglutinin__InfluenzaA__AEM92528
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaggaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacugaauaaguccuauauuaacgacaaggggaaagaagugcuuguccuguggggaauccaccaccccagcaccuccgccgaucaacagucucucuaccagaaugcugacgccuacguguucgugggcacaagcagauauuccaagaaauuuaagccugagauugcuauccggccgaaaguccgcgaucaggaggggagaaugaacuacuauuggacccugguugaacccggagacaagauuacguucgaggccacaggcaaccugguggugccucgguacgcguuugccauggaacgcaaugcugggagcggaaucauuaucucugauacccccguccaugacugcaacacaaccugucaaaccccuaaaggcgccaucaauacaucccuccccuuccagaacauucacccgaucacgauuggcaagugcccuaaguaugugaaaagcaccaagcugagacuugcuacagggcugcggaauguucccucuauccagagccgcggacucuuuggcgccauugccggguucaucgagggaggcuggaccgggaugguggacggaugguacggcuaucaucaccagaacgaacaaggcuccggguacgcugcggaucugaaaucuacacagaaugccaucgacaagauuaccaacaaagucaauagcgugaucgagaagaugaacacgcaguuuacagcuguuggaaaggccuucaaucaccuugagaaaagaauugaaaaccugaauaagaaaguggaugacggcuuccucgauaucuggaccuacaacgccgagcugcugguccuccuggaaaaugagcggacccuugacuaucaugauuccaacgugaagaaccuguacgaaaaaguccgcaaucagcucaagaacaaugcuaaggagauugggaacggauguuuugaguucuaucacaaaugcgacaauacauguauggaaagcgugaagaacggcaccuacgauuauccuaaauacucugaggaagccaagcugaauagagaggaaaucgacgggguuaaacuugaguccacacggaucuaucaaauucuggcgaucuacagcacgguggcuucuucccucguccuggugguuagccugggcgccauuuccuuuuggaugugcucuaacggaagccuccagugccgcaucuguauuuga

SEQ ID NO: 190109 - RNA, 1701 nt, Artificial Sequence
  derived and/or modified sequence opt5 from hemagglutinin__InfluenzaA__AEM92548
augaaggccauccuggugguccuccuguacaccuucgcuacagccacggcggacacccuuugcauuggcuaucacgcuaacaauagcacagauaccguugacacagugcuggagaaaaacgugaccgucacacauuccgugaaucuccuggaagauaagcacaacgggaaacuuuguaagcugagaggaguugcuccccuccaucugggcaaaugcaauaucgccggguggauucugggaaacccugagugugaaucucucagcaccgccuccucuuggagcuacaucguggagacguccucuagcgacaaugggaccugcuauccgggcgauuuuauuaacuacgaagaacugcgggagcagcuuuccagcgucucuuccuucgaacgcuuugagaucuuccccaagacaagcucuuggccuaaucacgacuccaacaagggagugaccgccgcuuguccccaugccggcgcgaaaucuuuuuauaagaaucugaucuggcucguuaaaaagggcaacagcuacccuaaacuguccaagagcuauauuaaugauaaggggaaagaagugcuuguccuguggggaauccaccaccccuccacaucugccgaccaacagagccucuaccagaacgcugaugccuacguguucgugggcaccuccagauauagcaagaaauuuaagccugagauugcuauccggccgaaaguccgcgaccaggaggggagaaugaauuacuauuggacgcugguugaacccggagauaagauuacauucgaggccaccggcaaccugguggugccucgguacgcguuugccauggaacgcaacgcugggucuggaaucauuaucuccgacacacccguccaugauugcaauaccaccugucaaacaccuaaaggcgccaucaacacgagccuccccuuccagaauauucacccgaucaccauuggcaagugcccuaaguaugugaaaucuacaaagcugagacuugcuaccgggcugcggaacguucccagcauccagucccgcggacucuuuggcgccauugccggguucaucgagggaggcuggacagggaugguggacggaugguacggcuaucaucaccagaaugaacaaggcucuggguacgcugcggaccugaaaagcacccagaacgccaucgauaagauuacgaauaaagucaacuccgugaucgagaagaugaauacacaguuuaccgcuguuggaaaggaguucaaccaccuugagaaaagaauugagaaucugaacaagaaaguggacgauggcuuccucgacaucuggaccuacaaugccgaacugcugguccuccuggagaacgaacggacacuugauuaucaugacagcaaugugaagaaccuguacgagaaaguccgcaaccagcucaagaauaacgccaaggagauugggaauggauguuuugaguucuaucacaaaugcgauaacaccuguauggaaucugugaagaauggcacauacgacuauccuaaauacuccgaagaggcuaagcugaacagagaagagaucgaugggguuaaacuugagagcacgcggaucuaucaaauucuggccaucuacucuaccguggcguccagccucguccuggugguuucccugggcgcuauuucuuuuuggaugugcagcaauggaucccuccagugccgcaucuguauuuga

SEQ ID NO: 190110 - RNA, 1701 nt, Artificial Sequence
  derived and/or modified sequence opt5 from hemagglutinin__InfluenzaA__AEM92558
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcucuaucgccggguggauucugggaaacccugagugugaaagccucuccacagccucuagcugguccuacaucguggagaccucuagcuccgacaauggcacgugcuauccgggggauuuuauuaacuacgaagaacugcgggagcagcuuagcucugucuccagcuucgaacgcuuugagaucuuccccaagaccucuuccuggccuaaucacgacagcaacaagggagugacagccgcuuguccccaugccggcgcgaaaucuuuuuauaagaaucugaucuggcucguuaaaaagggcaacuccuacccuaaacugagcaaguccuauauuaaugauaaggggaaagaagugcuuguccuguggggaauccaccaccccucuaccacagccgaccaacagagccucuaccagaacgcugaugccuacguguucgugggcaccuccagauauagcaagaaauuuaagccugagauugcuauccggccgaaaguccgcgaccaggaggggagaaugaauuacuauuggacgcugguugaacccggagauaagauuacauucgaggccaccggcaaccugguggugccucgguacgcguuugccauggaacgcaacgcugggucuggaaucauuaucuccgacacacccguccaugauugcaauaccaccugucaaacaccuaaaggcgccaucaacacgagccuccccuuccagaauauucacccgaucaccauuggcaagugcccuaaguaugugaaaucuacaaagcugagacuugcuaccgggcugcggaacguucccagcauccagucccgcggacucuuuggcgccauugccggguucaucgagggaggcuggacagggaugguggacggaugguacggcuaucaucaccagaaugaacaaggcucuggguacgcugcggaccugaaaagcacccagaacgccaucgauaagauuacgaauaaagucaacuccgugaucgagaagaugaauacacaguuuaccgcuguuggaaaggaguucaaccaccuugagaaaagaauugagaaucugaacaagaaaguggacgauggcuuccucgacaucuggaccuacaaugccgaacugcugguccuccuggagaacgaacggacacuugauuaucaugacagcaaugugaagaaccuguacgagaaaguccgcaaccagcucaagaauaacgccaaggagauugggaauggauguuuugaguucuaucacaaaugcgauaacaccuguauggaaucugugaagaauggcacauacgacuauccuaaauacuccgaagaggcuaagcugaacagagaagagaucgaugggguuaaacuugagagcacgcggaucuaucaaauucuggccaucuacucuaccguggcguccagccucguccuggugguuucccugggcgcuauuucuuuuuggaugugcagcaauggaucccuccagugccgcaucuguauuuga

SEQ ID NO: 190111 - RNA, 1701 nt, Artificial Sequence; identical to SEQ ID NO: 190110
  derived and/or modified sequence opt5 from hemagglutinin__InfluenzaA__AEM92568

SEQ ID NO: 190112 - RNA, 1701 nt, Artificial Sequence
  derived and/or modified sequence opt5 from hemagglutinin__InfluenzaA__AEM92578
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccauuucugacaacggcacgugcuauccgggggauuuuaucaauuacgaagaacugcgggagcagcuuagcuccgucagcucuuucgaacgcuuugagaucuuccccaagaccuccagcuggccuaaccacgacucuaauaagggagugacagccgcuuguccccaugccggcgcgaaauccuuuuauaagaaccugauuuggcucguuaaaaagggcaauagcuacccuaaacugucuaaguccuauaucaacgauaaggggaaagaagugcuuguccuguggggcauucaccaccccagcaccuccgccgaccaacagucucucuaccagaaugcugaugccuacguguucgugggaacaagcagauauuccaagaaauuuaagccugagaucgcuauucggccgaaaguccgcgaccaggaggggagaaugaacuacuauuggacccugguugaacccggagauaagaucacguucgaggccacaggcaaccugguggugccucgguacgcguuugccauggaacgcaaugcugggagcggaauuaucaucucugacacccccguccaugauugcaacacaaccugucaaaccccuaaaggcgccauuaauacaucccuccccuuccagaacauccacccgauuacgaucggcaagugcccuaaguaugugaaaagcaccaagcugagacuugcuacagggcugcggaauguucccucuauucagagccgcggacucuuuggcgccaucgccggguucaucgagggaggcuggaccgggaugguggacggaugguacggcuaucaucaccagaacgaacaaggcuccggguacgcugcggaccugaaaucuacacagaaugccauugauaagaucaccaacaaagucaauagcgugauugagaagaugaacacgcaguuuacagcuguuggaaaggaguucaaucaccuugagaaaagaaucgagaaccugaauaagaaaguggacgauggcuuccucgacauuuggaccuacaacgccgaacugcugguccuccuggagaaugaacggacccuugauuaucaugacuccaacgugaagaaccuguacgagaaaguccgcaaucagcucaagaacaaugccaaggagaucgggaacggauguuuugaguucuaucacaaaugcgauaauacauguauggaaagcgugaagaacggcaccuacgacuauccuaaauacucugaagaggcuaagcugaauagagaagagaucgaugggguuaaacuugaguccacacggauuuaucaaauccuggccauuuacagcacgguggcgucuucccucguccuggugguuagccugggcgcuaucuccuuuuggaugugcucuaacggaagccuccagugccgcauuuguaucuga

SEQ ID NO: 190113 - RNA, 1701 nt, Artificial Sequence
  derived and/or modified sequence opt5 from hemagglutinin__InfluenzaA__AEM92608
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccacagccgaucaacagucucucuaccagaacgcugacgccuacguguucgugggcaccagcagauauuccaagaaauuuaagccugagauugcuauccggccgaaaguccgcgaucaggaggggagaaugaauuacuauuggacgcugguugaacccggagacaagauuacauucgaggccaccggcaaccugguggugccucgguacgcguuugccauggaacgcaacgcugggagcggaaucauuaucucugauacacccguccaugacugcaauaccaccugucaaacaccuaaaggcgccaucaacacgucccuccccuuccagaauauucacccgaucaccauuggcaagugcccuaaguaugugaaaagcacaaagcugagacuugcuaccgggcugcggaacguucccucuauccagagccgcggacucuuuggcgccauugccggguucaucgagggaggcuggacagggaugguggacggaugguacggcuaucaucaccagaaugaacaaggcuccggguacgcugcggaucugaaaucuacccagaacgccaucgacaagauuacgaauaaagucaacagcgugaucgagaagaugaauacacaguuuaccgcuguuggaaaggaguucaaccaccuugagaaaagaauugagaaucugaacaagaaaguggaugacggcuuccucgauaucuggaccuacaaugccgaacugcugguccuccuggagaacgaacggacacuugacuaucaugauuccaaugugaagaaccuguacgagaaaguccgcaaccagcucaagaauaacgccaaggagauugggaauggauguuuugaguucuaucacaaaugcgacaacaccuguauggaaagcgugaagaauggcacauacgauuauccuaaauacucugaagaggcuaagcugaacagagaagagaucgacgggguuaaacuugaguccacgcggaucuaucaaauucuggccaucuacagcaccguggcgucuucccucguccuggugguuagccugggcgcuauuuccuuuuggaugugcucuaauggaagccuccagugccgcaucuguauuuga

SEQ ID NO: 190114 - RNA, 1701 nt, Artificial Sequence
  derived and/or modified sequence opt5 from hemagglutinin__InfluenzaA__AEM92618
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccaacuccuggucuuacaucguggagaccagcuccucugacaauggcacgugcuauccgggggauuuuauugacuacgaagaacugcgggagcagcuuagcuccgucagcucuuucgaacgcuuugagaucuuccccaagaccaacuccuggccuaaucacgauagcaacaagggagugacagccgcuuguccccaugccggcgcgaaaucuuuuuauaagaaucugaucuggcucguuaaaaccggcaacuccuacccuaagcugagcaaaucuuauauuaaugacaaggggaaggaagugcuuguccuguggggaauccaccaccccuccacaagcgccgaucaacagucccucuaccagaacgcugacgccuacguguucgugggcaccucuagauauagccggaaauuuaagccugagauugcuauccgcccgaaagucagagaucaggaggggcggaugaacuacuauuggacgcugguugaacccggagacaagauuacauucgaggccaccggcaaucugguggugccucgcuacgcguuugccauggaaagaaacgcuggguccggaaucauuaucagcgauacacccgcccaugacugcaauaccaccugucaaacaccuaaaggcgcuaucaacacgucucuccccuuccagaauauucacccgaucaccauuggcaagugcccuaaauaugucaaguccacaaagcugcggcuugccaccgggcugcgcaacgugcccagcauccagucuagaggacucuuuggcgccauugcuggguucaucgagggaggcuggacagggaugguugacggaugguacggcuaucaucaccagaaugaacaaggcagcggguacgcggccgaucugaaauccacccagaacgcuaucgacaagauuacgaauaaagugaacucugucaucgagaagaugaauacacaguuuaccgccgugggaaaagaguucaaccaccuugaaaagcggauugagaaucugaacaagaaaguugaugacggcuuccucgauaucuggaccuacaaugccgaacugcuggugcuccuggagaacgaacgcacacuugacuaucaugauagcaacgucaagaaucuguacgagaaagugagaucccagcucaagaacaaugcuaaagagauugggaacggauguuuugaguucuaucacaagugcgacaauaccuguauggagagcgucaagaacggcacauacgauuauccuaaauacucugaagaggccaagcugaaucgggaagagaucgacggggugaaacuugaguccacgcgcaucuaucaaauucuggcgaucuacagcaccguugcuucuucccucgugcuggucgugagccugggcgccauuuccuuuuggaugugcucuaacggaagccuccagugcagaaucuguauuuga

SEQ ID NO: 190115 - RNA, 1701 nt, Artificial Sequence
  derived and/or modified sequence opt5 from hemagglutinin__InfluenzaA__AEM92638
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaaaugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauacaaacaagggagugaccgccgcuuguccccaugccggcgcgaaauccuuuuauaagaaucuuauuuggcugguuaaaaagggcaacagcuacccuaaacucucuaaguccuauaucaaugacaaggggaaagaagugcugguccuuuggggcauucaccaccccagcacauccgccgaucaacagucucuguaccagaacgcugacgccuacguguucgugggaagcuccagauauagcaagaaauuuaagccugagaucgcuauucggccgaaaguccgcgaucaggaggggagaaugaauuacuauuggacccucguugaacccggagacaagaucacguucgaggccacaggcaaccugguggugccucgguacgcguuugccauggaaaagaacgcugggucuggaauuaucaucuccgauacccccguccaugacugcaauacaaccugucaaaccccuaagggcgccauuaacacaagccugcccuuccagaauauccacccgauuacgaucggcaagugcccuaaauaugugaagucuaccaaacuccgccuggcuacagggcuuagaaacguucccagcauucagucccggggacuguuuggcgccaucgccggguucaucgagggaggcuggaccgggaugguggacggaugguacggcuaucaucaccagaaugaacaaggcucuggguacgcugcggaucucaagagcacacagaacgccauugacgagaucaccaauaaagucaacuccgugauugagaagaugaauacgcaguuuacagcuguuggaaaggaguucaaccaccuggagaaacgcaucgaaaaucuuaacaagaaaguggaugacggcuuccuggauauuuggaccuacaaugccgagcuccugguccugcucgaaaacgagagaacccuggacuaucaugauagcaaugugaagaaccuuuacgagaaaguccggucucagcugaagaacaaugccaaggaaguggggaacggauguuuugaguucuaucacaaaugcgacaauacauguauggaauccguuaagaacggcaccuacgauuauccuaaauacagcgaggaagcuaagcucaaucgcgaggagaucgacggggugaaacuggaaucuacaagaaucuaucaaauucuugccaucuacuccacggcggcuagcucccugguccucgugguuucucugggcgccauuagcuuuuggaugugcuccaacggaucucugcagugccggaucuguauuuga

SEQ ID NO: 190116 - RNA, 1701 nt, Artificial Sequence
  derived and/or modified sequence opt5 from hemagglutinin__InfluenzaA__AEM92648
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaaaugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauacaaacaagggagugaccgccgcuuguccccaugccggcgcgaaauccuuuuauaagaaucuuauuuggcugguuaaagaaggcaacagcuacccuaagcucucuaaauccuauaucaaugacaaggggaaggaggugcugguccuuuggggcauucaccaccccagcacauccgccgaucaacagucucuguaccagaacgcugacgccuacguguucgugggaagcuccagauauagcaaaaaguuuaaaccugagaucgcuauucggccgaagguccgcgaucaggaagggagaaugaauuacuauuggacccucguugagcccggagacaaaaucacguucgaagccacaggcaaccugguggugccucgguacgcguuugccauggagaagaacgcugggucuggaauuaucaucuccgauacccccguccaugacugcaauacaaccugucaaaccccuaaaggcgccauuaacacaagccugcccuuccagaauauccacccgauuacgaucggcaagugcccuaaguaugugaaaucuaccaagcuccgccuggcuacagggcuuagaaacguucccagcauucagucccggggacuguuuggcgccaucgccggguucaucgaaggaggcuggaccgggaugguggacggaugguacggcuaucaucaccagaaugagcaaggcucuggguacgcugcggaucucaaaagcacacagaacgccauugacgagaucaccaauaaggucaacuccgugauugaaaagaugaauacgcaguuuacagcuguuggaaaggaguucaaccaccuggaaaagcgcaucgagaaucuuaacaaaaagguggaugacggcuuccuggauauuuggaccuacaaugccgaacuccugguccugcucgagaacgagagaacccuggacuaucaugauagcaaugugaaaaaccuuuacgaaaagguccggucucagcugaaaaacaaugccaaggagguggggaacggauguuuugaguucuaucacaagugcgacaauacauguauggaguccguuaaaaacggcaccuacgauuauccuaaguacagcgaagaggcuaaacucaaucgcgaggaaaucgacggggugaagcuggagucuacaagaaucuaucaaauucuugccaucuacuccacggcggcuagcucccugguccucgugguuucucugggcgccauuagcuuuuggaugugcuccaacggaucucugcagugccggaucuguauuuga

SEQ ID NO: 190117 - RNA, 1701 nt, Artificial Sequence; identical to SEQ ID NO: 188557
  derived and/or modified sequence opt5 from hemagglutinin__InfluenzaA__AEM98407

SEQ ID NO: 190118 - RNA, 1701 nt, Artificial Sequence; identical to SEQ ID NO: 188557
  derived and/or modified sequence opt5 from hemagglutinin__InfluenzaA__AEM98418

SEQ ID NO: 190119 - RNA, 1701 nt, Artificial Sequence; identical to SEQ ID NO: 188557
  derived and/or modified sequence opt5 from hemagglutinin__InfluenzaA__AEM98429

SEQ ID NO: 190120 - RNA, 1701 nt, Artificial Sequence
  derived and/or modified sequence opt5 from hemagglutinin__InfluenzaA__AEN55398
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccggggaauuuuauugauuacgaagaacugcgggagcagcuuuccagcgucucuuccuucgaacgcuuugagaucuuccccaagaccagcucuuggccugaccacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggcgccucgguacgccuuugcuauggaacgcaacgccgggucuggaaucauuaucuccgauacccccgugcaugacugcaauacaaccugucaaaccccuaaaggcgcuaucaacacaagccuccccuuccagaauauucacccgaucacgauuggcaagugcccuaaguaugucaaaucuaccaagcugagacuugugacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacaagauuaccaauaaagucaacuccgugaucgagaagaugaauacgcaguuuacagcuguuggaaaggaguucaaccaccuugagaaaagaauugagaaucugaacaagaaaguggaugacggcuuccucgauaucuggaccuacaaugccgaacugcugguccuccuggagaacgaacggacccuugacuaucaugauagcaaugugaagaaccuguacgagaaaguccgcucucagcucaagaacaaugccaaggagauugggaacggauguuuugaguucuaucacaaaugcgacaauacauguauggaauccgugaagaacggcaccuacgauuauccuaaauacagcgaagaggcuaagcugaauagagaagagaucgacgggguuaaacuugagucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 190121 - RNA, 1701 nt, Artificial Sequence; identical to SEQ ID NO: 189944
  derived and/or modified sequence opt5 from hemagglutinin__InfluenzaA__AEN55408

SEQ ID NO: 190122 - RNA, 1701 nt, Artificial Sequence; identical to SEQ ID NO: 189459
  derived and/or modified sequence opt5 from hemagglutinin__InfluenzaA__AEN55418

SEQ ID NO: 190123 - RNA, 1701 nt, Artificial Sequence; identical to SEQ ID NO: 188608
  derived and/or modified sequence opt5 from hemagglutinin__InfluenzaA__AEN55463

SEQ ID NO: 190124 - RNA, 1701 nt, Artificial Sequence
  derived and/or modified sequence opt5 from hemagglutinin__InfluenzaA__AEN55473
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccacaaccgaucaacagucucucuaccagacggccgacacauacguguucgugggcaccagcagauauuccaagaaauuuaagccugagauugcuauccggccgaaaguccgcgaucaggaggggagaaugaacuacuauuggacacugguugaacccggagacaagauuaccuucgaggccaccggcaaucugguggugccucgguacgcuuuugccauggaacgcaacgcggggagcggaaucauuaucucugauacacccguccaugacugcaacacgaccugucaaacaccuaaaggcgccaucaauaccucccuccccuuccagaacauucacccgaucacaauuggcaagugcccuaaguaugugaaaagcaccaagcugagacuugcuacggggcugcggaauguucccucuauccagagccgcggacucuuuggcgccauugcuggguucaucgagggaggcuggacagggaugguggacggaugguacggcuaucaucaccagaacgaacaaggcuccggguacgccgccgaucugaaaucuacccagaaugcuaucgacaagauuaccaacaaagucaauagcgugaucgagaagaugaacacacaguuuaccgcgguuggaaaggaguucaaucaccuugagaaaagaauugagaaccugaauaagaaaguggaugacggcuuccucgauaucuggacauacaacgccgaacugcugguccuccuggagaaugaacggacgcuugacuaucaugauuccaacgugaagaaucuguacgagaaaguccgcaaccagcucaagaccaacgcuaaggagauugggaauggauguuuugaguucuaucacaaaugcgacaacacauguauggaaagcgugaagaauggcaccuacgauuauccuaaauacucugaagaggccaagcugaacagagaagagaucgacgggguuaaacuugaguccacacggaucuaucaaauucuggccaucuacagcaccguggcuucuucccucguccuggugguuagccugggcgccauuuccuuuuggaugugcucuaauggaagccuccagugccgcaucuguauuuga

SEQ ID NO: 190125 - RNA, 1701 nt, Artificial Sequence; identical to SEQ ID NO: 189459
  derived and/or modified sequence opt5 from hemagglutinin__InfluenzaA__AEN55483

SEQ ID NO: 190126 - RNA, 1701 nt, Artificial Sequence; identical to SEQ ID NO: 190066
  derived and/or modified sequence opt5 from hemagglutinin__InfluenzaA__AEN55493

SEQ ID NO: 190127 - RNA, 1701 nt, Artificial Sequence; identical to SEQ ID NO: 189459
  derived and/or modified sequence opt5 from hemagglutinin__InfluenzaA__AEN55503

SEQ ID NO: 190128 - RNA, 1701 nt, Artificial Sequence
  derived and/or modified sequence opt5 from hemagglutinin__InfluenzaA__AEN55513
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccacagccgaucaacagaaccucuaccagaaugcugacaccuacguguucgugggcacgucuagauauagcaagaaauuuaagccugagauugccauccggccgaaaguccgcgaucaggaggggagaaugaacuacuauuggacacugguugaacccggagacaagauuaccuucgaggcuacaggcaaccugguggugccucgguacgccuuugcgauggaacgcaaugccggguccggaaucauuaucagcgauacccccguccaugacugcaacaccacaugucaaacgccuaaaggcgcuaucaauaccucucuccccuuccagaacauucacccgaucacaauuggcaagugcccuaaguaugugaaauccaccaagcugagacuugccacagggcugcggaauguucccagcauccagucucgcggacucuuuggcgcuauugccggguucaucgagggaggcuggaccgggaugguggacggaugguacggcuaucaucaccagaacgaacaaggcagcggguacgccgcugaucugaaauccacgcagaaugcgaucgacaagauuacaaacaaagucaauucugugaucgagaagaugaacacccaguuuaccgccguuggaaaggaguucaaucaccuugagaaaagaauugagaaccugaauaagaaaguggaugacggcuuccucgauaucuggacauacaacgcugaacugcugguccuccuggagaaugaacggacccuugacuaucaugauagcaacgugaagaaccuguacgagaaaguccgcaaucagcucaagaacaaugccaaggagauugggaacggauguuuugaguucuaucacaaaugcgacaauacauguauggaauccgugaagaacggcacguacgauuauccuaaauacagcgaagaggccaagcugaauagagaagagaucgacgggguuaaacuugagucuacccggaucuaucaaauucuggcuaucuacuccacaguggccagcucucucguccuggugguuucccugggcgcgauuagcuuuuggaugugcuccaacggaucucuccagugccgcaucuguauuuga

SEQ ID NO: 190129 - RNA, 1701 nt, Artificial Sequence; identical to SEQ ID NO: 189459
  derived and/or modified sequence opt5 from hemagglutinin__InfluenzaA__AEN55523

SEQ ID NO: 190130 - RNA, 1701 nt, Artificial Sequence; identical to SEQ ID NO: 188248
  derived and/or modified sequence opt5 from hemagglutinin__InfluenzaA__AEN68904

SEQ ID NO: 190131 - RNA, 1701 nt, Artificial Sequence; identical to SEQ ID NO: 185693
  derived and/or modified sequence opt5 from hemagglutinin__InfluenzaA__AEN68905

SEQ ID NO: 190132 - RNA, 1701 nt, Artificial Sequence; identical to SEQ ID NO: 185693
  derived and/or modified sequence opt5 from hemagglutinin__InfluenzaA__AEN68906

SEQ ID NO: 190133 - RNA, 1701 nt, Artificial Sequence; identical to SEQ ID NO: 186795
  derived and/or modified sequence opt5 from hemagglutinin__InfluenzaA__AEN68907

SEQ ID NO: 190134 - RNA, 1701 nt, Artificial Sequence; identical to SEQ ID NO: 185693
  derived and/or modified sequence opt5 from hemagglutinin__InfluenzaA__AEN68908

SEQ ID NO: 190135 - RNA, 1701 nt, Artificial Sequence
  derived and/or modified sequence opt5 from hemagglutinin__InfluenzaA__AEN68909
augaaggccauccuggugguccuccuguacaccuucgcuacagccaacgcggacacgcuuugcguuggcuaucacgcuaauaacagcaccgauacaguggacaccgugcuggagaagaaugucacagugacccauuccguuaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauugucgagaccuccucuagcgacaacggcacgugcuauccgggggauuuuaucgacuacgaagaacugcgggagcagcuuuccagcgugucuuccuucgaacgcuuugagauuuuccccaagaccagcucuuggccuaaucacgauuccaacaagggaguuacagccgcuuguccccaugccggcgcgaaaucuuuuuauaagaaucugaucuggcucgugaaaaagggcaacagcuacccuaaacuguccaagagcuauaucaaugacaaggggaaagaaguccuugugcuguggggcauucaccaccccuccaccucugccgaucaacagagccucuaccagaacgcugacgccuacguguucgucggaacauccagauauagcaagaaauuuaagccugagaucgcuauucggccgaaaguucgcgaucaggaggggagaaugaauuacuauuggacccugguggaacccggagacaagaucacguucgaggccacaggcaaccugguggucccucgguacgcguuugccauggaacgcaacgcugggucuggaauuaucauuuccgauacccccgugcaugacugcaauacaaccugucaaaccccuaaaggcgccaucaacacaagccuccccuuccagaauauccacccgauuacgaucggcaagugcccuaaguauguuaaaucuaccaagcugagacuugcuacagggcugcggaacgugcccagcauucagucccgcggacucuuuggcgccaucgccggguucauugagggaggcuggaccgggauggucgacggaugguacggcuaucaucaccagaaugaacaaggcucuggguacgcugcggaucugaaaagcacacagaacgccaucgacgagaucaccaauaaggugaacuccguuauugagaaaaugaauacgcaguuuacagcugugggaaaggaguucaaccaccuugagaagagaaucgaaaaucugaacaaaaaggucgaugacggcuuccucgauauuuggaccuacaaugccgagcugcuggugcuccuggaaaacgagcggacccuugacuaucaugauagcaaugucaaaaaccuguacgagaaggugcgcucucagcucaaaaacaaugccaaggaaaucgggaacggauguuuugaguucuaucacaagugcgacaauacauguauggaauccguuaaaaacggcaccuacgauuauccuaaguacagcgaggaagcuaaacugaauagagaggagauugacggggugaaacuugaaucuacacggaucuaucaaauccuggccauuuacuccacggucgcgagcucccucgugcugguugugucucugggcgcuaucagcuuuuggaugugcuccaacggaucucuccagugccgcauuuguaucuga

SEQ ID NO: 190136 - RNA, 1701 nt, Artificial Sequence
  derived and/or modified sequence opt5 from hemagglutinin__InfluenzaA__AEN68910
augaaggccauccuggugguccuccuguacaccuucgcuacagccaacgcggacacgcuuugcguuggcuaucacgcuaauaacagcaccgauacaguggacaccgugcuggagaagaaugucacagugacccauuccguuaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauugucgagaccuccucuagcgacaacggcacgugcuauccgggggauuuuaucgacuacgaagaacugcgggagcagcuuuccagcgugucuuccuucgaacgcuuugagauuuuccccaagaccagcucuuggccuaaucacgauuccaacaagggaguuacagccgcuuguccccaugccggcgcgaaaucuuuuuauaagaaucugaucuggcucgugaaaaagggcaacagcuacccuaaacuguccaagagcuauaucaaugacaaggggaaagaaguccuugugcuguggggcauucaccaccccuccaccucugccgaucaacagagccucuaccagaacgcugacgccuacguguucgucggaacauccagauauagcaagaaauuuaagccugagaucgcuauucggccgaaaguucgcgaucaggaggggagaaugaauuacuauuggacccugguggaacccggagacaagaucacguucgaggccacaggcaaccugguggucccucgguacgcguuugccauggaacgcaacgcugggucuggaauuaucauuuccgauacccccgugcaugacugcaauacaaccugucaaaccccuaaaggcgccaucaacacaagccuccccuuccagaauauccacccgauuacgaucggcaagugcccuaaguauguuaaagggaccaagcugagacuugcuacaggacugcggaacgugcccucuauucagagccgcggccucuuuggggccaucgccggauucauugagggcggguggaccggaauggucgacggcugguacggcuaucaucaccagaaugaacaaggguccggauacgcugcggaucugaaaucuacacagaacgccaucgacgagaucaccaauaaggugaacagcguuauugagaaaaugaauacgcaguuuacagcugugggcaaggaguucaaccaccuugagaagagaaucgaaaaucugaacaaaaaggucgaugacggguuccucgauauuuggaccuacaaugccgagcugcuggugcuccuggaaaacgagcggacccuugacuaucaugauuccaaugucaaaaaccuguacgagaaggugcgcagccagcucaaaaacaaugccaaggaaaucggaaacggcuguuuugaguucuaucacaagugcgacaauacauguauggaaucuguuaaaaacgggaccuacgauuauccuaaguacuccgaggaagcuaaacugaauagagaggagauugacggcgugaaacuugaaagcacacggaucuaucaaauccuggccauuuacucuacggucgcguccagccucgugcugguugugucccugggagcuaucucuuuuuggaugugcagcaacggcucccuccagugccgcauuuguaucuga

SEQ ID NO: 190137 - RNA, 1701 nt, Artificial Sequence; identical to SEQ ID NO: 187809
  derived and/or modified sequence opt5 from hemagglutinin__InfluenzaA__AEN68911

SEQ ID NO: 190138 - RNA, 1701 nt, Artificial Sequence; identical to SEQ ID NO: 185693
  derived and/or modified sequence opt5 from hemagglutinin__InfluenzaA__AEN68912

SEQ ID NO: 190139 - RNA, 1701 nt, Artificial Sequence; identical to SEQ ID NO: 185784
  derived and/or modified sequence opt5 from hemagglutinin__InfluenzaA__AEN68913

SEQ ID NO: 190140 - RNA, 1701 nt, Artificial Sequence; identical to SEQ ID NO: 188359
  derived and/or modified sequence opt5 from hemagglutinin__InfluenzaA__AEN68914

SEQ ID NO: 190141 - RNA, 1701 nt, Artificial Sequence; identical to SEQ ID NO: 185693
  derived and/or modified sequence opt5 from hemagglutinin__InfluenzaA__AEN68915

SEQ ID NO: 190142 - RNA, 1701 nt, Artificial Sequence; identical to SEQ ID NO: 185693
  derived and/or modified sequence opt5 from hemagglutinin__InfluenzaA__AEN68916

SEQ ID NO: 190143 - RNA, 1701 nt, Artificial Sequence
  derived and/or modified sequence opt5 from hemagglutinin__InfluenzaA__AEN68917
augaaggccauccugggcgugcuccuguacaccuucgcuacagccaacgcggacacgcuuugcauuggguaucacgcuaauaacagcaccgauacagucgacaccguucuggagaaaaaugugacagugacccauuccgucaaccuccuggaagauaagcacaauggaaaacuuuguaagcugagaggcguggcuccccuccaucuggggaaaugcaacaucgccggauggauucugggcaauccugagugugaaucucucagcacagccuccucuuggagcuacaucguugagaccuccucuagcgacaacgggacgugcuauccgggagauuuuauugacuacgaagaacugcgggagcagcuuuccagcgugucuuccuucgaacgcuuugagaucuuccccaagaccagcucuuggccuaaucacgauuccaacaagggcgucacagccgcuuguccccaugccggcgcgaaaucuuuuuauaagaaucugaucuggcucgugaaaaaggggaacagcuacccuaaacuguccaagagcuauauuaaugacaagggaaaagaaguucuugugcuguggggcauccaccaccccuccaccucugccgaucaacagagccucuaccagaacgcugacgccuacgucuucguggggacauccagauauagcaagaaauuuaagccugagauugcuauccggccgaaagugcgcgaucaggagggaagaaugaauuacuauuggacccuggucgaacccggcgacaagauuacguucgaggccacagggaaccugguugugccucgguacgcguuugccauggaacgcaacgcuggaucuggcaucauuaucuccgauacccccgugcaugacugcaauacaaccugucaaaccccuaaaggcgccaucaacacaagccuccccuuccagaauauucacccggucacgaucgggaagugcccuaaguaugugaaaucuaccaagcugagacuugcuacaggacugcggaacguucccagcauucagucccgcggccucuuuggggccaucgccggauucauugagggcggguggaccggaaugguggacggcugguacggcuaucaucaccagaaugaacaagggucuggauacgcugcggaucugaaaagcacacagaacgccaucgacaagaucaccaauaaagucaacuccgugauugagaagaugaauacgcaguuuacagcuguuggcaaggaguucaaccaccuugagaaaagaaucgagaaucugaacaagaaaguggaugacggguuccucgauauuuggaccuacaaugccgaacugcugguccuccuggagaacgaacggacccuugacuaucaugauagcaaugugaagaaccuguacgagaaaguccgcucucagcucaagaacaaugccaaggagaucggaaacggcuguuuugaguucuaucacaaaugcgacaauacauguauggaauccgugaagaacgggaccuacgauuauccuaaauacagcgaagaggcuaagcugaauagagaagagauugacggcguuaaacuugagucuacacggaucuaucaaauccuggccauuuacuccacgguggcgagcucccucguccuggugguuucucugggagcuaucagcuuuuggaugugcuccaacggcucucuccagugccgcauuuguaucuga

SEQ ID NO: 190144 - RNA, 1701 nt, Artificial Sequence
  derived and/or modified sequence opt5 from hemagglutinin__InfluenzaA__AEN68918
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagaauaacgggaaacuuuguaagcugagaggaguugcuccccuccaccugggcaaaugcaauaucgccggguggauucugggaaacccugagugugaaucucucagcacagccuccucuuggagcuacaucguggagaccuccucuagcgacaauggcacgugcuauccgggggauuuuauugacuacgaagaacugcgggagcagcuuuccagcgucucuuccuucgaacgcuuugagauguuccccaagaccagcucuuggccuaaccaugauuccaauaagggagugacagccgcuuguccccacgccggcgcgaaaucuuuuuauaagaaccugaucuggcucguuaaaaagggcaauagcuacccuaaacuguccaagagcuauaucaacgacaaggggaaagaagugcuuguccuguggggcauucaucaccccuccaccucugccgaucaacagagccucuaccagaaugcugacgccuacguguucgugggaacauccagauauagcaagaaauuuaagccugagaucgcuauucggccgaaaguccgcgaucaggaggggagaaugaacuacuauuggacccugguugaacccggagacaagaucacguucgaggccacaggcaaccugguggugccucgguacgcguuugccauggaacgcaaugcugggucuggaauuaucauuuccgauacccccguccacgacugcaacacaaccugucaaaccccuaaaggcgccaucaauacaagccuccccuuccagaacauccauccgauuacgaucggcaagugcccuaaguaugugaaaucuaccaagcugagacuugcuacagggcugcggaauguucccagcauucagucccgcggacucuuuggcgccaucgccggguucauugagggaggcuggaccgggaugguggacggaugguacggcuaucaccaucagaacgaacaaggcucuggguacgcugcggaucugaaaagcacacagaaugccaucgacgagaucaccaacaaggucaauuccgugauugagaaaaugaacacgcaguuuacagcuguuggaaaggaguucaaucaccuugagaagagaaucgaaaaccugaauaaaaagguggaugacggcuuccucgauauuuggaccuacaacgccgagcugcugguccuccuggaaaaugagcggacccuugacuaucacgauagcaacgugaaaaaccuguacgagaagguccgcucucagcucaaaaauaacgccaaggaaguggggaauggauguuuugaguucuaucauaagugcgacaacacauguauggaauccguuaaaaauggcaccuacgauuauccuaaguacagcgaggaagcuaaacugaacagagaggagaucgacggggugaaacuugaaucuacacggauuuaucaaauccuggccaucuacuccacggucgcgagcucccucgugcugguugugucucugggcgcuauuagcuuuuggaugugcuccaauggaucucuccagugccgcaucuguauuuga

SEQ ID NO: 190145 - RNA, 1701 nt, Artificial Sequence; identical to SEQ ID NO: 188608
  derived and/or modified sequence opt5 from hemagglutinin__InfluenzaA__AEN68919

SEQ ID NO: 190146 - RNA, 1701 nt, Artificial Sequence; identical to SEQ ID NO: 187857
  derived and/or modified sequence opt5 from hemagglutinin__InfluenzaA__AEN68920

SEQ ID NO: 190147 - RNA, 1701 nt, Artificial Sequence; identical to SEQ ID NO: 186857
  derived and/or modified sequence opt5 from hemagglutinin__InfluenzaA__AEN68921

SEQ ID NO: 190148 - RNA, 1701 nt, Artificial Sequence; identical to SEQ ID NO: 186853
  derived and/or modified sequence opt5 from hemagglutinin__InfluenzaA__AEN68922

SEQ ID NO: 190149 - RNA, 1701 nt, Artificial Sequence; identical to SEQ ID NO: 186857
  derived and/or modified sequence opt5 from hemagglutinin__InfluenzaA__AEN68923

SEQ ID NO: 190150 - RNA, 1701 nt, Artificial Sequence; identical to SEQ ID NO: 186857
  derived and/or modified sequence opt5 from hemagglutinin__InfluenzaA__AEN68924

SEQ ID NO: 190151 - RNA, 1701 nt, Artificial Sequence
  derived and/or modified sequence opt5 from hemagglutinin__InfluenzaA__AEN68925
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucguggagacauccagauauagcaagaaauuuaagccugagauugcuauccggccgaaaguccgcgaucaggaaggcagaaugaauuacuauuggacccugguugagcccggggacaagauuacguucgaagccacaggaaaccugguggugccucgguacgcguuugccauggagcgcaacgcuggcucugggaucauuaucuccgauacccccguccaugacugcaauacaaccugucaaaccccuaaaggagccaucaacacaagccuccccuuccagaauauucacccgaucacgauuggcaagugcccuaaguaugugaaaucuaccaagcugagacuugcuacaggccugcggaacguucccagcauccagucccgcgggcucuuuggagccauugccggcuucaucgaagggggauggaccggcaugguggacgggugguacggauaucaucaccagaaugagcaaggcucuggcuacgcugcggaucugaaaagcacacagaacgccaucgacaagauuaccaauaaagucaacuccgugaucgagaagaugaauacgcaguuuacagcuguugggaaggaguucaaccaccuugagaaaagaauugaaaaucugaacaagaaaguggaugacggauuccucgauaucuggaccuacaaugccgagcugcugguccuccuggaaaacgagcggacccuugacuaucaugauagcaaugugaagaaccuguacgagaaaguccgcucucagcucaagaacaaugccaaggaaauuggcaacggguguuuugaguucuaucacaaaugcgacaauacauguauggaauccgugaagaacggaaccuacgauuauccuaaauacagcgaggaagcuaagcugaauagagaggagaucgacggcguuaaacuugaaucuacacggaucuaucaaauucuggccaucuacuccacgguggcgagcucccucguccuggugguuucucugggggcuauuagcuuuuggaugugcuccaacggcucucuccagugccgcaucuguauuuga

SEQ ID NO: 190152 - RNA, 1701 nt, Artificial Sequence
  derived and/or modified sequence opt5 from hemagglutinin__InfluenzaA__AEN68926
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucgccacagccagcuccuggucuuacaucguggagaccagcaacuccgacaauggcacgugcuauccgggggauuuuauugacuacgaagaacugcgggagcagcuuucuagcgucuccagcuucgaacgcuuugagaucuuccccaagaccucuuccuggccuaaccacgauagcaauaagggagugacagcugccuguccccaugcgggcgccaaaucuuuuuauaagaaccugaucuggcucguuaaaaagggcaauuccuacccuaaacugagcaagucuuauauuaacgacaaggggagagaagugcuuguccuguggggaauccaccaccccuccaccagcgcugaucaacagucccucuaccagaaugccgacacauacguguucgugggcaccucucgguauagcaaaaaguuuaaaccugagauugcuauccgcccgaaggucagagaucaggaggggcggaugaacuacuauuggacgcugguugaacccggagacaaaauuacauucgaggccaccggcaaccugguggugccucgcuacgcguuugccauggaaagaaaugcuggguccggaaucauuaucagcgauacacccguccaugacugcaacaccaccugucaaacaccuaagggcgccaucaauacgucucuccccuuccagaacauucacccgaucaccauuggcaaaugcccuaaguaugugaaguccacaaaacugcggcuugcuaccgggcugcgcaauguucccagcauccagucuagaggacucuuuggcgccauugccggguucaucgagggaggcuggacagggaugguggacggaugguacggcuaucaucaccagaacgaacaaggcagcggguacgcugcggaucugaaguccacccagaaugccaucgacgagauuacgaacaaagucaauucugugaucgagaagaugaacacacaguuuaccgcuguuggaaaagaguucaaucaccuugagaagcggauugaaaaccugaauaagaaaguggaugacggcuuccucgauaucuggaccuacaacgccgagcugcugguccuccuggaaaaugagcgcacacuugacuaucaugauagcaacgugaagaaccuguacgagaaagucagaucccagcucaagaauaacgccaaagaaauugggaauggauguuuugaguucuaucacaagugcgacaacaccuguauggaaagcgugaagaauggcacauacgauuauccuaaauacucugaggaagcuaagcugaaccgggaggagaucgacgggguuaaacuugaauccacgcgcaucuaucaaauucuggccaucuacagcaccguggcgucuucccucguccuggugguuagccugggcgcuauuuccuuuuggaugugcucuaauggaagccuccagugcagaaucuguauuuga

SEQ ID NO: 190153 - RNA, 1701 nt, Artificial Sequence
  derived and/or modified sequence opt5 from hemagglutinin__InfluenzaA__AEN68927
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccugaucacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaucugguggugccucgguacgcguuugccauggaacgcaacgcugggucuggaaucauuaucuccgacacccccguccaugacugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggauggaugguacggcuaucaucaccagaacgaacaaggcucuggguacgcugcggaccugaaaagcacacagaaugccaucgauaagauuaccaacaaagucaauuccgugaucgagaagaugaacacgcaguuuacagcuguuggaaaggaguucaaucaccuugagaaaagaauugagaaccugaauaagaaaguggacgauggcuuccucgacaucuggaccuacaacgccgaacugcugguccuccuggagaaugaacggacccuugauuaucaugacagcaacgugaagaaucuguacgagaaaguccgcaaccagcucaagaacaaugccaaggagauugggaacggauguuuugaguucuaucacaaaugcgauaauacauguauggaaucugugaagaacggcaccuacgacuauccuaaauacuccgaagaggcuaagcugaauagagaagagaucgaugggguuaaacuugagagcacacggaucuaucaaauucuggccaucuacucuacgguggcguccagccucguccuggugguuucccugggcgcuauuucuuuuuggaugugcagcaacggaucccuccagugccgcaucuguauuuga

SEQ ID NO: 190154 - RNA, 1701 nt, Artificial Sequence; identical to SEQ ID NO: 189279
  derived and/or modified sequence opt5 from hemagglutinin__InfluenzaA__AEN68928

SEQ ID NO: 190155 - RNA, 1701 nt, Artificial Sequence
  derived and/or modified sequence opt5 from hemagglutinin__InfluenzaA__AEN68929
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaaucgcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccaagagcuauaucaaugacaaggggaaagaaguucuugugcuguggggcauucaccaccccuccaccucugccgaucaacagagccucuaccagaacgcugacgccuacgucuucgugggaacauccagauauagcaagaaauuuaagccugagaucgcuauucggccgaaagugcgcgaucaggaggggagaaugaauuacuauuggacccuggucgaacccggagacaagaucacguucgaggccacaggcaaccugguugugccucgguacgcguuugccauggaacgcaacgcugggucuggaauuaucaucuccgauacccccgugcaugacugcaauacaaccugucaaaccccuaaaggcgccauuaacacaagccuccccuuccagaauauccacccgauuacgaucggcaagugcccuaaguaugucaaaucuaccaagcugagacuugcuacagggcugcggaacgugcccagcauucagucccgcggacucuuuggcgccaucgccggguucaucgagggaggcuggaccgggaugguugacggaugguacggcuaucaucaccagaaugaacaaggcucuggguacgcugcggaucugaaaagcacacagaacgccauugacaagaucaccaauaaagugaacuccgucauugagaagaugaauacgcaguuuacagcugugggaaaggaguucaaccaccuugagaaaagaaucgagaaucugaacaagaaaguugaugacggcuuccucgauauuuggaccuacaaugccgaacugcuggugcuccuggagaacgaacggacccuugacuaucaugauagcaaugucaagaaccuguacgagaaagugcgcucucagcucaagaacaaugccaaggagaucgggaacggauguuuugaguucuaucacaaaugcgacaauacauguauggaauccgucaagaacggcaccuacgauuauccuaaauacagcgaagaggcuaagcugaauagagaagagaucgacggggugaaacuugagucuacacggauuuaucaaauccuggccauuuacuccacgguugcgagcucccucgugcuggucgugucucugggcgcuaucagcuuuuggaugugcuccaacggaucucuccagugccgcauuuguaucuga

SEQ ID NO: 190156 - RNA, 1701 nt, Artificial Sequence; identical to SEQ ID NO: 188608
  derived and/or modified sequence opt5 from hemagglutinin__InfluenzaA__AEN68930

SEQ ID NO: 190157 - RNA, 1701 nt, Artificial Sequence; identical to SEQ ID NO: 188608
  derived and/or modified sequence opt5 from hemagglutinin__InfluenzaA__AEN68931

SEQ ID NO: 190158 - RNA, 1701 nt, Artificial Sequence; identical to SEQ ID NO: 188608
  derived and/or modified sequence opt5 from hemagglutinin__InfluenzaA__AEN68932

SEQ ID NO: 190159 - RNA, 1701 nt, Artificial Sequence
  derived and/or modified sequence opt5 from hemagglutinin__InfluenzaA__AEN69426
augaaggccauccuggugguccuccuguacaccuucgcuacaagcaacgccgacacgcuuugcauuggcuaucacgcgaauaacuccaccgauacaguugacaccgugcuggagaaaaaugugacagucacccauucugugaaccuccuggaagauaagcacaaugggaaacuuuguaagcugagaggaguugcuccccuccaucugggcaaaugcaacaucgccggguggauucugggaaauccugagugugaaagccucuccacagccucuagcugguccuacaucguggagaccucuagcuccgacaacggcacgugcuauccggggaauuuuauugauuacgaagaacugcgggagcagcuuagcucugucuccagcuucgaacgcuuugagaucuuccccaagaccucuuccuggccugaccacgauagcaacaagggagugacagcugccuguccccaugcuggcgccaaaucuuuuuauaagaaucugaucuggcucguuaaaaagggcaacuccuacccuaaacugagcaaguccuauauuaaugacaaggggaaagaagugcuuguccuguggggaauccaccaccccucuaccagcgcggaucaacagucccucuaccagaacgccgacgcuuacguguucgugggcacaagcagauauucuaagaaauuuaagccugagauugccauccggccgaaaguccgcgaucaggaggggagaaugaauuacuauuggacccugguugaacccggagacaagauuacguucgaggcuacaggcaaccugguggccccucgguacgcguuugccauggaacgcaacgcuggguccggaaucauuaucagcgauacccccgugcaugacugcaauacaaccugucaaaccccuaaaggcgccaucaacacaucucuccccuuccagaauauucacccgaucacgauuggcaagugcccuaaguaugucaaaagcaccaagcugagacuugcuacagggcugcggaacgugcccuccauccagucucgcggacucuuuggcgccauugccggguucaucgagggaggcuggaccgggaugguugacggaugguacggcuaucaucaccagaaugaacaaggcagcggguacgcugcggaucugaaauccacacagaacgccaucgacaagauuaccaauaaagugaacagcgucaucgagaagaugaauacgcaguuuacagcugugggaaaggaguucaaccaccuugagaaaagaauugagaaucugaacaagaaaguugaugacggcuuccucgauaucuggaccuacaaugccgaacugcuggugcuccuggagaacgaacggacccuugacuaucaugauucuaaugucaagaaccuguacgagaaagugcgcucccagcucaagaacaaugccaaggagauugggaacggauguuuugaguucuaucacaaaugcgacaauacauguauggaaagcgucaagaacggcaccuacgauuauccuaaauacucugaagaggcuaagcugaauagagaagagaucgacggggugaaacuugaguccacacggaucuaucaaauucuggccaucuacagcacgguugcguccucucucgugcuggucgugagccugggcgcuauuuccuuuuggaugugcucuaacggaagccuccagugccgcaucuguauuuga

SEQ ID NO: 190160 - RNA, 1701 nt, Artificial Sequence; identical to SEQ ID NO: 189944
  derived and/or modified sequence opt5 from hemagglutinin__InfluenzaA__AEN69475

SEQ ID NO: 190161 - RNA, 1701 nt, Artificial Sequence; identical to SEQ ID NO: 189944
  derived and/or modified sequence opt5 from hemagglutinin__InfluenzaA__AEN69481

SEQ ID NO: 190162 - RNA, 1701 nt, Artificial Sequence; identical to SEQ ID NO: 185946
  derived and/or modified sequence opt5 from hemagglutinin__InfluenzaA__AEO01032

SEQ ID NO: 190163 - RNA, 1701 nt, Artificial Sequence; identical to SEQ ID NO: 186046
  derived and/or modified sequence opt5 from hemagglutinin__InfluenzaA__AEO01033

SEQ ID NO: 190164 - RNA, 1701 nt, Artificial Sequence; identical to SEQ ID NO: 186046
  derived and/or modified sequence opt5 from hemagglutinin__InfluenzaA__AEO01034

SEQ ID NO: 190165 - RNA, 1701 nt, Artificial Sequence; identical to SEQ ID NO: 185680
  derived and/or modified sequence opt5 from hemagglutinin__InfluenzaA__AEO01035

SEQ ID NO: 190166 - RNA, 1701 nt, Artificial Sequence; identical to SEQ ID NO: 186046
  derived and/or modified sequence opt5 from hemagglutinin__InfluenzaA__AEO01036

SEQ ID NO: 190167 - RNA, 1701 nt, Artificial Sequence; identical to SEQ ID NO: 185935
  derived and/or modified sequence opt5 from hemagglutinin__InfluenzaA__AEO01037

SEQ ID NO: 190168 - RNA, 1701 nt, Artificial Sequence; identical to SEQ ID NO: 186046
  derived and/or modified sequence opt5 from hemagglutinin__InfluenzaA__AEO01038

SEQ ID NO: 190169 - RNA, 1701 nt, Artificial Sequence; identical to SEQ ID NO: 185873
  derived and/or modified sequence opt5 from hemagglutinin__InfluenzaA__AEO01039

SEQ ID NO: 190170 - RNA, 1701 nt, Artificial Sequence
  derived and/or modified sequence opt5 from hemagglutinin__InfluenzaA__AEO01040
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaaaaggugcuuguccuguggggaauccaccaccccuccaccucugccgaucaacagagccucuaccagaacgcugacgccuacguguucgugggcacauccagauauagcaaaaaguuuaaaccugaaauugcuauccggccgaagguccgcgaucaggaggggagaaugaauuacuauuggacccugauugagcccggagacaaaaucacguucgaagccacaggcaaccugguugugccucgguacgcguuuaccauggagcgcaacgccgggucuggaauuaucaucuccgauacacccgugcaugacugcaauaccaccugucaaacaccuaagggcgcuauuaacacgagccuccccuuccagaauauccacccgauuaccaucggcaagugcccuaaauaugucaagucuacaaaacugagacuugccaccgggcugcggaacgugcccagcauucagucccgcggacucuuuggcgcuaucgccggguucaucgaaggaggcuggacagggaugguugacggaugguacggcuaucaucaccagaaugagcaaggcucuggguacgccgcugaucugaaaagcacccagaacgcgauugacgaaaucacgaauaaagugaacuccgucauugagaagaugaauacacaguuuaccgccgugggaaaggaguucaaccaccuugaaaagagaaucgagaaucugaacaagaaaguugaugacggcuuccucgauauuuggaccuacaaugcugaacugcuggugcuccuggagaacgaacggacacuugacuaucaugauagcaaugucaagaaccuguacgagaaagugcgcucucagcucaagaacaaugccaaggagaucgggaacggauguuuugaguucuaucacaaaugcgacaauaccuguauggaguccgucaagaacggcacauacgauuauccuaaauacagcgaagaggccaagcugaauagagaagagaucgacggggugaaacuugagucuacgcggauuuaucaaauccuggcuauuuacuccaccguugccagcucccucgugcuggucgugucucugggcgcgaucagcuuuuggaugugcuccaacggaucucuccagugccgcauuuguaucuga

SEQ ID NO: 190171 - RNA, 1701 nt, Artificial Sequence; identical to SEQ ID NO: 185693
  derived and/or modified sequence opt5 from hemagglutinin__InfluenzaA__AEO01041

SEQ ID NO: 190172 - RNA, 1701 nt, Artificial Sequence; identical to SEQ ID NO: 186046
  derived and/or modified sequence opt5 from hemagglutinin__InfluenzaA__AEO01042

SEQ ID NO: 190173 - RNA, 1701 nt, Artificial Sequence
  derived and/or modified sequence opt5 from hemagglutinin__InfluenzaA__AEO01043
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcaacaauggcacgugcuauccgggggacuuuauugauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgagcaggaagggagaaugaacuacuauuggacccugguugagcccggagacaagauuacguucgaagccacaggcaaccugguggugccucgguacgcguuugccauggagcgcaaugcugggucuggaaucauuaucuccgauacccccguccaugacugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgaaggaggcuggaccgggaugguggauggaugguacggcuaucaucaccagaacgagcaaggcucuggguacgcugcggaccugaaaagcacacagaaugccaucgacgagauuaccaacaaggucaauuccgugaucgaaaagaugaacacgcaguuuacagcuguuggaaaggaguucaaucaccuugaaaagagaauugagaaccugaauaaaaagguggaugacggcuuccucgauaucuggaccuacaacgccgaacugcugguccuccuggagaaugagcggacccuugacuaucaugauagcaacgugaaaaaccuguacgaaaagguccgcucucagcucaaaaauaacgccaaggagauugggaauggauguuuugaguucuaucacaagugcgacaacacauguauggaguccgugaaaaauggcaccuacgauuauccuaaguacagcgaagaggcuaaacugaacagagaggaaaucgacgggguuaaacuugagucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 190174 - RNA, 1701 nt, Artificial Sequence; identical to SEQ ID NO: 185693
  derived and/or modified sequence opt5 from hemagglutinin__InfluenzaA__AEO01044

SEQ ID NO: 190175 - RNA, 1701 nt, Artificial Sequence
  derived and/or modified sequence opt5 from hemagglutinin__InfluenzaA__AEO01045
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaaucucgagugugaaucucugagcacagccuccucuuggagcuacaucguggagaccuccucuagcgacaacggcacgugcuauccuggggauuuuauugacuacgaagaacuucgggagcagcuguccagcgucucuuccuucgaacgcuuugagaucuucccgaagaccagcucuuggcccaaucacgauuccaacaagggagugacagccgcuuguccucaugccggcgcgaaaucuuuuuauaagaaucucaucuggcugguuaaaaagggcaacagcuaccccaaacuuuccaagagcuauauuaaugacaaggggaaagaagugcugguccucuggggaauccaccacccuuccaccucugccgaucaacagagccuguaccagaacgcugacgccuacguguucgugggcacauccagauauagcaagaaauuuaagcccgagauugcuauccggccuaaaguccgcgaucaggaggggagaaugaauuacuauuggacccugguugaaccgggagacaagauuacguucgaggccacaggcaaccucguggugccccgguacgcguuugccauggaacgcaacgcugggucuggaaucauuaucuccgauaccccuguccaugacugcaauacaaccugucaaacccccaaaggcgccaucaacacaagccugccuuuccagaauauucaccccaucacgauuggcaagugcccgaaguaugugaaaucuaccaaacuuagacuggcuacagggcuccggaacguuccuagcauccagucccgcggacuguuuggcgccauugccggguucaucgagggaggcuggaccgggaugguggacggaugguacggcuaucaucaccagaaugaacaaggcucuggguacgcugcggaucuuaagagcacacagaacgccaucgacgagauuaccaauaaggucaacuccgugaucgagaaaaugaauacgcaguuuacagcuguuggaaaggaguucaaccaccuggagaagagaauugaaaaucucaacaaaaagguggaugacggcuuccuggauaucuggaccuacaaugccgagcugcucguccugcuugaaaacgagcggacccuggacuaucaugauagcaaugugaaaaaccucuacgagaagguccgcucucagcugaaaaacaaugccaaggaaauugggaacggauguuuugaguucuaucacaagugcgacaauacauguauggaauccgugaaaaacggcaccuacgauuaucccaaguacagcgaggaagcuaaacuuaauagagaggagaucgacgggguuaagcuggaaucuacacggaucuaucaaauucucgccaucuacuccacgguggcgagcucccugguccuggugguuucucucggcgcuauuagcuuuuggaugugcuccaacggaucucugcagugccgcaucuguauuuga

SEQ ID NO: 190176 - RNA, 1701 nt, Artificial Sequence; identical to SEQ ID NO: 185693
  derived and/or modified sequence opt5 from hemagglutinin__InfluenzaA__AEO01046

SEQ ID NO: 190177 - RNA, 1701 nt, Artificial Sequence; identical to SEQ ID NO: 185693
  derived and/or modified sequence opt5 from hemagglutinin__InfluenzaA__AEO01047

SEQ ID NO: 190178 - RNA, 1701 nt, Artificial Sequence
  derived and/or modified sequence opt5 from hemagglutinin__InfluenzaA__AEO01048
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggaucuaucaaauucuggccaucuacuccacgguggcgagcucccucguccuggugguuucucugggcgcuauuagcuuuuggaugugcuccaacggaucucuccagugcaagaucuguauuuga

SEQ ID NO: 190179 - RNA, 1701 nt, Artificial Sequence; identical to SEQ ID NO: 186591
  derived and/or modified sequence opt5 from hemagglutinin__InfluenzaA__AEO01049

SEQ ID NO: 190180 - RNA, 1701 nt, Artificial Sequence; identical to SEQ ID NO: 185693
  derived and/or modified sequence opt5 from hemagglutinin__InfluenzaA__AEO01050

SEQ ID NO: 190181 - RNA, 1701 nt, Artificial Sequence; identical to SEQ ID NO: 186046
  derived and/or modified sequence opt5 from hemagglutinin__InfluenzaA__AEO01051

SEQ ID NO: 190182 - RNA, 1701 nt, Artificial Sequence
  derived and/or modified sequence opt5 from hemagglutinin__InfluenzaA__AEO01052
augaaggccaucauugugguccugcucuacaccuucgcuacagccaacgcggacacgcugugcaucggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaaaugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggaacauccagauauagcaagaaauuuaagccugagaucgcuauucggccgaaaguccgcgaucaggaggggagaaugaauuacuauuggacccucguugaacccggagacaagaucacguucgaggccacaggcaaccugguggugccucgguacgcguuugccauggaacgcaacgcugggucuggaauuaucaucuccgauacccccguccaugacugcaauacaaccugucaaaccccuaaaggcgccauuaacacaagccugcccuuccagaauauccacccgauuacgaucggcaagugcccuaaguaugugaaaucuaccaagcucagacuggcuacagggcuucggaacguucccagcauucagucccgcggacuguuuggcgccaucgccggguucaucgagggaggcuggaccgggaugguggacggaugguacggcuaucaucaccagaaugaacaaggcucuggguacgcugcggaucucaaaagcacacagaacgccauugacaagaucaccaauaaagucaacuccgugauugagaagaugaauacgcaguuuacagcuguuggaaaggaguucaaccaccuggaaaagagaaucgagaaucuuaacaagaaaguggaugacggcuuccuggauauuuggaccuacaaugccgaacuccugguccugcucgagaacgaacggacccuggacuaucaugauagcaaugugaagaaccuuuacgagaaaguccgcucucagcugaagaacaaugccaaggagaucgggaacggauguuuugaguucuaucacaaaugcgacaauacauguauggaguccgugaagaacggcaccuacgauuauccuaaauacagcgaagaggcuaagcucaauagagaagagaucgacgggguuaaacuggagucuacacggauuuaucaaauccuugccauuuacuccacgguggcgagcucccugguccucgugguuucucugggcgcuaucagcuuuuggaugugcuccaacggaucucugcagugccgcauuuguaucuga

SEQ ID NO: 190183 - RNA, 1701 nt, Artificial Sequence; identical to SEQ ID NO: 186046
  derived and/or modified sequence opt5 from hemagglutinin__InfluenzaA__AEO01053

SEQ ID NO: 190184 - RNA, 1701 nt, Artificial Sequence; identical to SEQ ID NO: 185693
  derived and/or modified sequence opt5 from hemagglutinin__InfluenzaA__AEO01054

SEQ ID NO: 190185 - RNA, 1701 nt, Artificial Sequence; identical to SEQ ID NO: 186505
  derived and/or modified sequence opt5 from hemagglutinin__InfluenzaA__AEO01055

SEQ ID NO: 190186 - RNA, 1701 nt, Artificial Sequence; identical to SEQ ID NO: 186046
  derived and/or modified sequence opt5 from hemagglutinin__InfluenzaA__AEO01056

SEQ ID NO: 190187 - RNA, 1701 nt, Artificial Sequence; identical to SEQ ID NO: 185693
  derived and/or modified sequence opt5 from hemagglutinin__InfluenzaA__AEO01057

SEQ ID NO: 190188 - RNA, 1701 nt, Artificial Sequence; identical to SEQ ID NO: 185693
  derived and/or modified sequence opt5 from hemagglutinin__InfluenzaA__AEO01058

SEQ ID NO: 190189 - RNA, 1701 nt, Artificial Sequence; identical to SEQ ID NO: 185693
  derived and/or modified sequence opt5 from hemagglutinin__InfluenzaA__AEO01059

SEQ ID NO: 190190 - RNA, 1701 nt, Artificial Sequence; identical to SEQ ID NO: 185693
  derived and/or modified sequence opt5 from hemagglutinin__InfluenzaA__AEO01060

SEQ ID NO: 190191 - RNA, 1701 nt, Artificial Sequence; identical to SEQ ID NO: 185693
  derived and/or modified sequence opt5 from hemagglutinin__InfluenzaA__AEO01061

SEQ ID NO: 190192 - RNA, 1701 nt, Artificial Sequence; identical to SEQ ID NO: 185693
  derived and/or modified sequence opt5 from hemagglutinin__InfluenzaA__AEO01062

SEQ ID NO: 190193 - RNA, 1701 nt, Artificial Sequence; identical to SEQ ID NO: 185693
  derived and/or modified sequence opt5 from hemagglutinin__InfluenzaA__AEO01063

SEQ ID NO: 190194 - RNA, 1701 nt, Artificial Sequence; identical to SEQ ID NO: 185693
  derived and/or modified sequence opt5 from hemagglutinin__InfluenzaA__AEO01064

SEQ ID NO: 190195 - RNA, 1701 nt, Artificial Sequence; identical to SEQ ID NO: 185935
  derived and/or modified sequence opt5 from hemagglutinin__InfluenzaA__AEO01065

SEQ ID NO: 190196 - RNA, 1701 nt, Artificial Sequence; identical to SEQ ID NO: 186046
  derived and/or modified sequence opt5 from hemagglutinin__InfluenzaA__AEO01066

SEQ ID NO: 190197 - RNA, 1701 nt, Artificial Sequence
  derived and/or modified sequence opt5 from hemagglutinin__InfluenzaA__AEO01067
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauggcuauucggccgaaaguccgcgaucaggaggggagaaugaauuacuauuggacccugguugaacccggagacaagaucacguucgaggccacaggcaaccugguggugccucgguacgcguuugccauggaacgcaacgcugggucuggaauuaucauuuccgauacccccguccaugacugcaauacaaccugucaaaccccuaaaggcgccaucaacacaagccuccccuuccagaauauccacccgauuacgaucggcaagugcccuaaguaugugaaaucuaccaagcugagacuugcuacagggcugcggaacguucccagcauucagucccgcggacucuuuggcgccaucgccggguucauugagggaggcuggaccgggaugguggacggaugguacggcuaucaucaccagaaugaacaaggcucuggguacgcugcggaucugaaaagcacacagaacgccaucgacgagaucaccaauaaggucaacuccgugauugagaaaaugaauacgcaguuuacagcuguuggaaaggaguucaaccaccuugagaagagaaucgaaaaucugaacaaaaagguggaugacggcuuccucgauauuuggaccuacaaugccgagcugcugguccuccuggaaaacgagcggacccuugacuaucaugauagcaaugugaaaaaccuguacgagaagguccgcucucagcucaaaaacaaugccaaggaaaucgggaacggauguuuugaguucuaucacaagugcgacaauacauguauggaauccgugaaaaacggcaccuacgauuauccuaaguacagcgaggaagcuaaacugaauagagaggagauugacgggguuaaacuugaaucuacacggaucuaucaaauccuggccauuuacuccacgguggcgagcucccucguccuggugguuucucugggcgcuaucagcuuuuggaugugcuccaacggaucucuccagugccgcauuuguaucuga

SEQ ID NO: 190198 - RNA, 1701 nt, Artificial Sequence; identical to SEQ ID NO: 186046
  derived and/or modified sequence opt5 from hemagglutinin__InfluenzaA__AEO01068

SEQ ID NO: 190199 - RNA, 1701 nt, Artificial Sequence; identical to SEQ ID NO: 185693
  derived and/or modified sequence opt5 from hemagglutinin__InfluenzaA__AEO01069

SEQ ID NO: 190200 - RNA, 1701 nt, Artificial Sequence; identical to SEQ ID NO: 186046
  derived and/or modified sequence opt5 from hemagglutinin__InfluenzaA__AEO01070

SEQ ID NO: 190201 - RNA, 1701 nt, Artificial Sequence; identical to SEQ ID NO: 185693
  derived and/or modified sequence opt5 from hemagglutinin__InfluenzaA__AEO01071

SEQ ID NO: 190202 - RNA, 1701 nt, Artificial Sequence
  derived and/or modified sequence opt5 from hemagglutinin__InfluenzaA__AEO01073
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccgugaacacaagccuccccuuccagaauauccacccgauuacgaucggcaagugcccuaaguauguuaaaucuaccaagcugagacuugcuacagggcugcggaacgugcccagcauucagucccgcggacucuuuggcgccaucgccggguucauugagggaggcuggaccgggauggucgacggaugguacggcuaucaucaccagaaugaacaaggcucuggguacgcugcggaucugaaaagcacacagaacgccaucgacgagaucaccaauaaggugaacuccguuauugagaaaaugaauacgcaguuuacagcugugggaaaggaguucaaccaccuugagaagagaaucgaaaaucugaacaaaaaggucgaugacggcuuccucgauauuuggaccuacaaugccgagcugcuggugcuccuggaaaacgagcggacccuugacuaucaugauagcaaugucaaaaaccuguacgagaaggugcgcucucagcucaaaaacaaugccaaggaaaucgggaacggauguuuugaguucuaucacaagugcgacaauacauguauggaauccguuaaaaacggcaccuacgauuauccuaaguacagcgaggaagcuaaacugaauagagaggagauugacggggugaaacuugaaucuacacggaucuaucaaauccuggccauuuacuccacggucgcgagcucccucgugcugguugugucucugggcgcuaucagcuuuuggaugugcuccaacggaucucuccagugccgcauuuguaucuga

SEQ ID NO: 190203 - RNA, 1701 nt, Artificial Sequence; identical to SEQ ID NO: 185935
  derived and/or modified sequence opt5 from hemagglutinin__InfluenzaA__AEO01074

SEQ ID NO: 190204 - RNA, 1701 nt, Artificial Sequence; identical to SEQ ID NO: 186046
  derived and/or modified sequence opt5 from hemagglutinin__InfluenzaA__AEO01075

SEQ ID NO: 190205 - RNA, 1701 nt, Artificial Sequence; identical to SEQ ID NO: 186046
  derived and/or modified sequence opt5 from hemagglutinin__InfluenzaA__AEO01076

SEQ ID NO: 190206 - RNA, 1701 nt, Artificial Sequence
  derived and/or modified sequence opt5 from hemagglutinin__InfluenzaA__AEO01077
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaccugaaaagcacacagaacgccaucgaugagauuaccaauaaggucaacuccgugaucgaaaagaugaauacgcaguuuacagcuguuggaaaggaguucaaccaccuugaaaagagaauugagaaucugaacaaaaagguggacgauggcuuccucgacaucuggaccuacaaugccgaacugcugguccuccuggagaacgagcggacccuugauuaucaugacagcaaugugaaaaaccuguacgaaaagguccgcucucagcucaaaaacaaugccaaggagauugggaacggauguuuugaguucuaucacaagugcgauaauacauguauggagaacgugaaaaauggcaccuacgacuauccuaaguacuccgaagaggcuaaacugaacagagaggaaaucgaugggguuaaacuugagagcacacggaucuaucaaauucuggccaucuacucuacgguggcguccagccucguccuggugguuucccugggcgcuauuucuuuuuggaugugcagcaauggaucccuccagugccgcaucuguauuuga

SEQ ID NO: 190207 - RNA, 1701 nt, Artificial Sequence; identical to SEQ ID NO: 185693
  derived and/or modified sequence opt5 from hemagglutinin__InfluenzaA__AEO01078

SEQ ID NO: 190208 - RNA, 1701 nt, Artificial Sequence; identical to SEQ ID NO: 185693
  derived and/or modified sequence opt5 from hemagglutinin__InfluenzaA__AEO01079

SEQ ID NO: 190209 - RNA, 1701 nt, Artificial Sequence; identical to SEQ ID NO: 185693
  derived and/or modified sequence opt5 from hemagglutinin__InfluenzaA__AEO01080

SEQ ID NO: 190210 - RNA, 1701 nt, Artificial Sequence; identical to SEQ ID NO: 186046
  derived and/or modified sequence opt5 from hemagglutinin__InfluenzaA__AEO01081

SEQ ID NO: 190211 - RNA, 1701 nt, Artificial Sequence; identical to SEQ ID NO: 185693
  derived and/or modified sequence opt5 from hemagglutinin__InfluenzaA__AEO01082

SEQ ID NO: 190212 - RNA, 1701 nt, Artificial Sequence; identical to SEQ ID NO: 185693
  derived and/or modified sequence opt5 from hemagglutinin__InfluenzaA__AEO01083

SEQ ID NO: 190213 - RNA, 1701 nt, Artificial Sequence; identical to SEQ ID NO: 185693
  derived and/or modified sequence opt5 from hemagglutinin__InfluenzaA__AEO01084

SEQ ID NO: 190214 - RNA, 1701 nt, Artificial Sequence; identical to SEQ ID NO: 186046
  derived and/or modified sequence opt5 from hemagglutinin__InfluenzaA__AEO01085

SEQ ID NO: 190215 - RNA, 1701 nt, Artificial Sequence; identical to SEQ ID NO: 185693
  derived and/or modified sequence opt5 from hemagglutinin__InfluenzaA__AEO01086

SEQ ID NO: 190216 - RNA, 1701 nt, Artificial Sequence; identical to SEQ ID NO: 186046
  derived and/or modified sequence opt5 from hemagglutinin__InfluenzaA__AEO01087

SEQ ID NO: 190217 - RNA, 1701 nt, Artificial Sequence; identical to SEQ ID NO: 185873
  derived and/or modified sequence opt5 from hemagglutinin__InfluenzaA__AEO01088

SEQ ID NO: 190218 - RNA, 1701 nt, Artificial Sequence; identical to SEQ ID NO: 186046
  derived and/or modified sequence opt5 from hemagglutinin__InfluenzaA__AEO01089

SEQ ID NO: 190219 - RNA, 1701 nt, Artificial Sequence; identical to SEQ ID NO: 186046
  derived and/or modified sequence opt5 from hemagglutinin__InfluenzaA__AEO01090

SEQ ID NO: 190220 - RNA, 1701 nt, Artificial Sequence; identical to SEQ ID NO: 186046
  derived and/or modified sequence opt5 from hemagglutinin__InfluenzaA__AEO01091

SEQ ID NO: 190221 - RNA, 1701 nt, Artificial Sequence
  derived and/or modified sequence opt5 from hemagglutinin__InfluenzaA__AEO01092
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagcgcgucagaucucagcucaagaacaaugccaaagaaauugggaacggauguuuugaguucuaucacaagugcgacaauacauguauggaauccgugaagaacggcaccuacgauuauccuaaauacagcgaggaagcuaagcugaaucgggaggagaucgacgggguuaaacuugaaucuacacgcaucuaucaaauucuggccaucuacuccacgguggcgagcucccucguccuggugguuucucugggcgcuauuagcuuuuggaugugcuccaacggaucucuccagugcagaaucuguauuuga

SEQ ID NO: 190222 - RNA, 1701 nt, Artificial Sequence; identical to SEQ ID NO: 185693
  derived and/or modified sequence opt5 from hemagglutinin__InfluenzaA__AEO01093

SEQ ID NO: 190223 - RNA, 1701 nt, Artificial Sequence; identical to SEQ ID NO: 185693
  derived and/or modified sequence opt5 from hemagglutinin__InfluenzaA__AEO01094

SEQ ID NO: 190224 - RNA, 1701 nt, Artificial Sequence; identical to SEQ ID NO: 188900
  derived and/or modified sequence opt5 from hemagglutinin__InfluenzaA__AEO01095

SEQ ID NO: 190225 - RNA, 1701 nt, Artificial Sequence; identical to SEQ ID NO: 186046
  derived and/or modified sequence opt5 from hemagglutinin__InfluenzaA__AEO01096

SEQ ID NO: 190226 - RNA, 1701 nt, Artificial Sequence; identical to SEQ ID NO: 186046
  derived and/or modified sequence opt5 from hemagglutinin__InfluenzaA__AEO01097

SEQ ID NO: 190227 - RNA, 1701 nt, Artificial Sequence; identical to SEQ ID NO: 186046
  derived and/or modified sequence opt5 from hemagglutinin__InfluenzaA__AEO01098

SEQ ID NO: 190228 - RNA, 1701 nt, Artificial Sequence; identical to SEQ ID NO: 185693
  derived and/or modified sequence opt5 from hemagglutinin__InfluenzaA__AEO01099

SEQ ID NO: 190229 - RNA, 1701 nt, Artificial Sequence; identical to SEQ ID NO: 185935
  derived and/or modified sequence opt5 from hemagglutinin__InfluenzaA__AEO01100

SEQ ID NO: 190230 - RNA, 1701 nt, Artificial Sequence; identical to SEQ ID NO: 185693
  derived and/or modified sequence opt5 from hemagglutinin__InfluenzaA__AEO01101

SEQ ID NO: 190231 - RNA, 1701 nt, Artificial Sequence; identical to SEQ ID NO: 185693
  derived and/or modified sequence opt5 from hemagglutinin__InfluenzaA__AEO01102

SEQ ID NO: 190232 - RNA, 1701 nt, Artificial Sequence; identical to SEQ ID NO: 186046
  derived and/or modified sequence opt5 from hemagglutinin__InfluenzaA__AEO01103

SEQ ID NO: 190233 - RNA, 1701 nt, Artificial Sequence; identical to SEQ ID NO: 186046
  derived and/or modified sequence opt5 from hemagglutinin__InfluenzaA__AEO01104

SEQ ID NO: 190234 - RNA, 1701 nt, Artificial Sequence
  derived and/or modified sequence opt5 from hemagglutinin__InfluenzaA__AEO01105
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccagcaagggagugacagccgcuuguccccaugccggcgcgaaaucuuuuuauaagaaccugaucuggcucguuaaaaagggcaauuccuacccuaaacugagcaaguccuauauuaacgacaaggggaaagaagugcuuguccuguggggaauccaccaccccucuaccagcgccgaucaacagucccucuaccagaaugcugacgccuacguguucgugggcacaagcagauauucuaagaaauuuaagccugagauugcuauccggccgaaaguccgcgaucaggaggggagaaugaacuacuauuggacccugguugaacccggagacaagauuacguucgaggccacaggcaaucugguggugccucgguacgcguuugccauggaacgcaacgcuggguccggaaucauuaucagcgauacccccguccaugacugcaacacaaccugucaaaccccuaaaggcgccaucaauacaucucuccccuuccagaacauucacccgaucacgauuggcaagugcccuaaguaugugaaaagcaccaagcugagacuugcuacagggcugcggaauguucccuccauccagucucgcggacucuuuggcgccauugccggguucaucgagggaggcuggaccgggaugguggacggaugguacggcuaucaucaccagaacgaacaaggcagcggguacgcugcggaucugaaauccacacagaaugccaucgacgagauuaccaacaaggucaauagcgugaucgagaaaaugaacacgcaguuuacagcuguuggaaaggaguucaaucaccuugagaagagaauugaaaaccugaauaaaaagguggaugacggcuuccucgauaucuggaccuacaacgccgagcugcugguccuccuggaaaaugagcggacccuugacuaucaugauucuaacgugaaaaaucuguacgagaagguccgcucccagcucaaaaacaacgccaaggaaauugggaauggauguuuugaguucuaucacaagugcgacaacacauguauggaaagcgugaaaaauggcaccuacgauuauccuaaguacucugaggaagcuaaacugaacagagaggagaucgacgggguuaaacuugaauccacacggaucuaucaaauucuggccaucuacagcacgguggcguccucucucguccuggugguuagccugggcgcuauuuccuuuuggaugugcucuaauggaagccuccagugccgcaucuguauuuga

SEQ ID NO: 190235 - RNA, 1701 nt, Artificial Sequence; identical to SEQ ID NO: 186046
  derived and/or modified sequence opt5 from hemagglutinin__InfluenzaA__AEO01106

SEQ ID NO: 190236 - RNA, 1701 nt, Artificial Sequence; identical to SEQ ID NO: 185693
  derived and/or modified sequence opt5 from hemagglutinin__InfluenzaA__AEO01107

SEQ ID NO: 190237 - RNA, 1701 nt, Artificial Sequence; identical to SEQ ID NO: 185693
  derived and/or modified sequence opt5 from hemagglutinin__InfluenzaA__AEO01108

SEQ ID NO: 190238 - RNA, 1701 nt, Artificial Sequence; identical to SEQ ID NO: 185693
  derived and/or modified sequence opt5 from hemagglutinin__InfluenzaA__AEO01109

SEQ ID NO: 190239 - RNA, 1701 nt, Artificial Sequence; identical to SEQ ID NO: 185693
  derived and/or modified sequence opt5 from hemagglutinin__InfluenzaA__AEO01110

SEQ ID NO: 190240 - RNA, 1701 nt, Artificial Sequence; identical to SEQ ID NO: 185693
  derived and/or modified sequence opt5 from hemagglutinin__InfluenzaA__AEO01111

SEQ ID NO: 190241 - RNA, 1701 nt, Artificial Sequence; identical to SEQ ID NO: 185693
  derived and/or modified sequence opt5 from hemagglutinin__InfluenzaA__AEO01112

SEQ ID NO: 190242 - RNA, 1701 nt, Artificial Sequence
  derived and/or modified sequence opt5 from hemagglutinin__InfluenzaA__AEO01113
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuugucugcaugccggcgcgaaaucuuuuuauaagaaucucaucuggcugguuaaaaagggcaacagcuaccccaaacuuuccaagagcuauauuaaugacaaggggaaagaagugcugguccucuggggaauccaccacccuuccaccucugccgaucaacagagccuguaccagaacgcugacgccuacguguucgugggcacauccagauauagcaagaaauuuaagcccgagauugcuauccggccuaaaguccgcgaucaggaggggagaaugaauuacuauuggacccugguugaaccgggagacaagauuacguucgaggccacaggcaaccucguggugccccgguacgcguuugccauggaacgcaacgcugggucuggaaucauuaucuccgauaccccuguccaugacugcaauacaaccugucaaacccccaaaggcgccaucaacacaagccugccuuuccagaauauucaccccaucacgauuggcaagugcccgaaguaugugaaaucuaccaaacuuagacuggcuacagggcuccggaacguuccuagcauccagucccgcggacuguuuggcgccauugccggguucaucgagggaggcuggaccgggaugguggacggaugguacggcuaucaucaccagaaugaacaaggcucuggguacgcugcggaucuuaagagcacacagaacgccaucgacgagauuaccaauaaggucaacuccgugaucgagaaaaugaauacgcaguuuacagcuguuggaaaggaguucaaccaccuggagaagagaauugaaaaucucaacaaaaagguggaugacggcuuccuggauaucuggaccuacaaugccgagcugcucguccugcuugaaaacgagcggacccuggacuaucaugauagcaaugugaaaaaccucuacgagaagguccgcucucagcugaaaaacaaugccaaggaaauugggaacggauguuuugaguucuaucacaagugcgacaauacauguauggaauccgugaaaaacggcaccuacgauuaucccaaguacagcgaggaagcuaaacuuaauagagaggagaucgacgggguuaagcuggaaucuacacggaucuaucaaauucucgccaucuacuccacgguggcgagcucccugguccuggugguuucucucggcgcuauuagcuuuuggaugugcuccaacggaucucugcagugccgcaucuguauuuga

SEQ ID NO: 190243 - RNA, 1701 nt, Artificial Sequence; identical to SEQ ID NO: 185935
  derived and/or modified sequence opt5 from hemagglutinin__InfluenzaA__AEO01114

SEQ ID NO: 190244 - RNA, 1701 nt, Artificial Sequence
  derived and/or modified sequence opt5 from hemagglutinin__InfluenzaA__AEO01115
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuugucugcaugccggcgccaagagcuuuuauaaaaaucucaucuggcugguuaagaaaggcaacucuuaccccaaacuuuccaagagcuauauuaaugacaaggggaaggaggugcugguccucuggggaauccaccacccuuccaccucugccgaucaacagagccuguaccagaacgcugacgccuacguguucgugggcacauccagauauagcaaaaaguuuaaacccgagauugcuauccggccuaagguccgcgaucaggaagggagaaugaauuacuauuggacccugguugagccgggagacaaaauuacguucgaagccacaggcaaccucguggugccccgguacgcguuugccauggagcgcaacgcugggucuggaaucauuaucuccgauaccccuguccaugacugcaauacaaccugucaaacccccaagggcgccaucaacacaagccugccuuuccacaauauucaucccaucacgauuggcaaaugcccgaaguaugugaagucuaccaaacuuagacuggcuacagggcuccggaacguuccuagcauccagucccgcggacuguuuggcgccauugccggguucaucgaaggaggcuggaccgggaugguggacggaugguacggcuaucaccaccagaaugagcagggcucuggguacgcugcggaucuuaagagcacacaaaacgccaucgacgagauuaccaauaaagucaacuccgugaucgaaaagaugaauacgcaguuuacagcuguuggaaaagaguucaaccaucuggaaaagagaauugagaaucucaacaagaaaguggaugacggcuuccuggauaucuggaccuacaaugccgaacugcucguccugcuugagaacgagcggacccuggacuaucacgauagcaaugugaagaaccucuacgaaaaaguccgcucucagcugaagaacaaugccaaagagauugggaacggauguuuugaguucuaucauaagugcgacaauacauguauggaauccgugaagaacggcaccuacgauuaucccaaauacagcgaagaggcuaaacuuaauagagaggaaaucgacgggguuaagcuggagucuacacggaucuaucagauucucgccaucuacuccacgguggcgagcucccugguccuggugguuucucucggcgcuauuagcuuuuggaugugcuccaacggaucucugcaaugccgcaucuguauuuga

SEQ ID NO: 190245 - RNA, 1701 nt, Artificial Sequence; identical to SEQ ID NO: 185693
  derived and/or modified sequence opt5 from hemagglutinin__InfluenzaA__AEO01116

SEQ ID NO: 190246 - RNA, 1701 nt, Artificial Sequence; identical to SEQ ID NO: 185693
  derived and/or modified sequence opt5 from hemagglutinin__InfluenzaA__AEO01117

SEQ ID NO: 190247 - RNA, 1701 nt, Artificial Sequence; identical to SEQ ID NO: 186559
  derived and/or modified sequence opt5 from hemagglutinin__InfluenzaA__AEO01118

SEQ ID NO: 190248 - RNA, 1701 nt, Artificial Sequence; identical to SEQ ID NO: 185693
  derived and/or modified sequence opt5 from hemagglutinin__InfluenzaA__AEO01119

SEQ ID NO: 190249 - RNA, 1701 nt, Artificial Sequence
  derived and/or modified sequence opt5 from hemagglutinin__InfluenzaA__AEO01120
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacauccccagcauucagucccgcggacucuuuggcgccaucgccggguucaucgaaggaggcuggaccgggaugguugacggaugguacggcuaucaucaccagaaugagcaaggcucuggguacgcugcggaccugaaaagcacacagaacgccauugaugagaucaccaauaaggugaacuccgucauugaaaagaugaauacgcaguuuacagcugugggaaaggaguucaaccaccuugaaaagagaaucgagaaucugaacaaaaagguugacgauggcuuccucgacguguggaccuacaaugccgaacugcugguccuccuggagaacgagcggacccuugauuaucaugacagcaaugugaaaaaccuguacgaaaagguccgcucucagcucaaaaacaaugccaaggagauugggaacggauguuuugaguucuaucacaagugcgauaauacauguauggaguccgugaaaaacggcaccuacgacuauccuaaguacagcgaagaggcuaaacugaauagagaggaaaucgaugggguuaaacuugagucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 190250 - RNA, 1701 nt, Artificial Sequence; identical to SEQ ID NO: 185693
  derived and/or modified sequence opt5 from hemagglutinin__InfluenzaA__AEO01121

SEQ ID NO: 190251 - RNA, 1701 nt, Artificial Sequence; identical to SEQ ID NO: 186046
  derived and/or modified sequence opt5 from hemagglutinin__InfluenzaA__AEO01122

SEQ ID NO: 190252 - RNA, 1701 nt, Artificial Sequence; identical to SEQ ID NO: 185693
  derived and/or modified sequence opt5 from hemagglutinin__InfluenzaA__AEO01123

SEQ ID NO: 190253 - RNA, 1701 nt, Artificial Sequence; identical to SEQ ID NO: 185693
  derived and/or modified sequence opt5 from hemagglutinin__InfluenzaA__AEO01124

SEQ ID NO: 190254 - RNA, 1701 nt, Artificial Sequence; identical to SEQ ID NO: 186046
  derived and/or modified sequence opt5 from hemagglutinin__InfluenzaA__AEO01125

SEQ ID NO: 190255 - RNA, 1701 nt, Artificial Sequence
  derived and/or modified sequence opt5 from hemagglutinin__InfluenzaA__AEO01126
augaaggccacccuggugguccuccuguacacauucgcuacggccaacgcggacacccuuugcaucggcuaucacgcuaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacguccucuagcgacaacggaaccugcuauccgggggauuuuaucgacuacgaagaacugcgggagcagcuuuccagcgucucuuccuucgaacgcuuugagauuuuccccaagacaagcucuuggccuaaucacgauuccaacaagggagugaccgccgcuuguccccaugccggcgcgaaaucuuuuuauaagaaucugaucuggcucguuaaaaagggcaacagcuacccuaaacuguccaagagcuauaucaaugacaaggggaaagaagugcuuguccuguggggcauucaccaccccuccacaucugccgaucaacagagccucuaccagaacgcugacgccuacguguucgugggcaccuccagauauagcaagaaauuuaagccugagaucgcuauucggccgaaaguccgcgagcaggaagggagaaugaauuacuauuggacgcugguugagcccggagauaagaucacauucgaagccaccggcaaccugguggugccucgguacgcguuugccauggagcgcaacgcugggucuggaauuaucauuuccgacacacccguccaugauugcaauaccaccugucaaacaccuaaaggcgccaucaacacgagccuccccuuccagaauauccacccgauuaccaucggcaagugcccuaaguaugugaaaucuacaaagcugagacuugcuaccgggcugcggaacguucccagcauucagucccgcggacucuuuggcgccaucgccggguucauugaaggaggcuggacagggaugguggacggaugguacggcuaucaucaccagaaugagcaaggcucuggguacgcugcggaccugaaaagcacccagaacgccaucgaugagaucacgaauaaggucaacuccgugauugaaaagaugaauacacaguuuaccgcuguuggaaaggaguucaaccaccuugaaaagagaaucgagaaucugaacaaaaagguggacgauggcuuccucgacauuuggaccuacaaugccgaacugcugguccuccuggagaacgagcggacacuugauuaucaugacagcaaugugaaaaaccuguacgaaaagguccgcucucagcucaaaaacaaugccaaggagaucgggaacggauguuuugaguucuaucacaagugcgauaauaccuguauggaguccgugaaaaacggcacauacgacuauccuaaguacagcgaagaggcuaaacugaauagagaggaaauugaugggguuaaacuugagucuacgcggaucuaucaaauccuggccauuuacuccaccguggcgagcucccucguccuggugguuucucugggcgcuaucagcuuuuggaugugcuccaacggaucucuccagugccgcauuuguaucuga

SEQ ID NO: 190256 - RNA, 1701 nt, Artificial Sequence; identical to SEQ ID NO: 185693
  derived and/or modified sequence opt5 from hemagglutinin__InfluenzaA__AEO01127

SEQ ID NO: 190257 - RNA, 1701 nt, Artificial Sequence; identical to SEQ ID NO: 185693
  derived and/or modified sequence opt5 from hemagglutinin__InfluenzaA__AEO01128

SEQ ID NO: 190258 - RNA, 1701 nt, Artificial Sequence; identical to SEQ ID NO: 186046
  derived and/or modified sequence opt5 from hemagglutinin__InfluenzaA__AEO01129

SEQ ID NO: 190259 - RNA, 1701 nt, Artificial Sequence; identical to SEQ ID NO: 185693
  derived and/or modified sequence opt5 from hemagglutinin__InfluenzaA__AEO01130

SEQ ID NO: 190260 - RNA, 1701 nt, Artificial Sequence; identical to SEQ ID NO: 186046
  derived and/or modified sequence opt5 from hemagglutinin__InfluenzaA__AEO01131

SEQ ID NO: 190261 - RNA, 1701 nt, Artificial Sequence; identical to SEQ ID NO: 185693
  derived and/or modified sequence opt5 from hemagglutinin__InfluenzaA__AEO01132

SEQ ID NO: 190262 - RNA, 1701 nt, Artificial Sequence
  derived and/or modified sequence opt5 from hemagglutinin__InfluenzaA__AEO01133
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggauccagcagauauucuaagaaauuuaagccugagaucgcuauucggccgaaaguccgcgaucaggaggggagaaugaauuacuauuggacacucguugaacccggagacaagaucaccuucgaggccacgggcaaccugguggugccucgguacgcguuugccauggaacgcaacgcuggguccggaauuaucaucagcgauacacccguccaugacugcaauaccacaugucaaaccccuaaaggcgccauuaacaccucucugcccuuccagaauauccacccgauuacaaucggcaagugcccuaaguaugugaaaagcacgaagcucagacuggcuaccgggcuucggaacguucccuccauucagucucgcggacuguuuggcgccaucgccggguucaucgagggaggcuggacagggaugguggacggaugguacggcuaucaucaccagaaugaacaaggcagcggguacgcugcggaucucaaauccacccagaacgccauugacgagaucacaaauaaggucaacagcgugauugagaaaaugaauacccaguuuacggcuguuggaaaggaguucaaccaccuggagaagagaaucgaaaaucuuaacaaaaagguggaugacggcuuccuggauauuuggacauacaaugccgagcuccugguccugcucgaaaacgagcggacccuggacuaucaugauucuaaugugaaaaaccuuuacgagaagguccgcucccagcugaaaaacaaugccaaggaaaucgggaacggauguuuugaguucuaucacaagugcgacaauaccuguauggaaagcgugaaaaacggcacauacgauuauccuaaguacucugaggaagcuaaacucaauagagaggagaucgacgggguuaagcuggaauccaccaugauuuaucaaauccuugccauuuacagcacaguggcguccucucugguccucgugguuagccugggcgcuaucuccuuuuggaugugcucuaacggaagccugcagugccggauuuguaucuga

SEQ ID NO: 190263 - RNA, 1701 nt, Artificial Sequence; identical to SEQ ID NO: 186046
  derived and/or modified sequence opt5 from hemagglutinin__InfluenzaA__AEO01134

SEQ ID NO: 190264 - RNA, 1701 nt, Artificial Sequence; identical to SEQ ID NO: 186046
  derived and/or modified sequence opt5 from hemagglutinin__InfluenzaA__AEO01135

SEQ ID NO: 190265 - RNA, 1701 nt, Artificial Sequence; identical to SEQ ID NO: 185693
  derived and/or modified sequence opt5 from hemagglutinin__InfluenzaA__AEO01136

SEQ ID NO: 190266 - RNA, 1701 nt, Artificial Sequence; identical to SEQ ID NO: 186140
  derived and/or modified sequence opt5 from hemagglutinin__InfluenzaA__AEO01137

SEQ ID NO: 190267 - RNA, 1701 nt, Artificial Sequence; identical to SEQ ID NO: 186140
  derived and/or modified sequence opt5 from hemagglutinin__InfluenzaA__AEO01138

SEQ ID NO: 190268 - RNA, 1701 nt, Artificial Sequence; identical to SEQ ID NO: 185693
  derived and/or modified sequence opt5 from hemagglutinin__InfluenzaA__AEO01139

SEQ ID NO: 190269 - RNA, 1701 nt, Artificial Sequence; identical to SEQ ID NO: 185693
  derived and/or modified sequence opt5 from hemagglutinin__InfluenzaA__AEO01140

SEQ ID NO: 190270 - RNA, 1701 nt, Artificial Sequence; identical to SEQ ID NO: 185693
  derived and/or modified sequence opt5 from hemagglutinin__InfluenzaA__AEO01141

SEQ ID NO: 190271 - RNA, 1701 nt, Artificial Sequence; identical to SEQ ID NO: 185693
  derived and/or modified sequence opt5 from hemagglutinin__InfluenzaA__AEO01142

SEQ ID NO: 190272 - RNA, 1701 nt, Artificial Sequence
  derived and/or modified sequence opt5 from hemagglutinin__InfluenzaA__AEO01144
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccauuucugacaacggcacgugcuauccgggggauuuuaucgacuacgaagaacugcgggagcagcuuagcuccgucagcucuuucgaacgcuuugagaucuuccccaagaccuccagcuggccuaaucacgauucuaacaagggagugacagccgcuuguccccaugccggcgcgaaaggcuuuuauaagaaucugauuuggcucguuaaaaaggggaacuccuacccuaaacugagcaagucuuauaucaaugacaagggaaaagaagugcuuguccuguggggcauucaccaccccuccaccagcgccgaucaacagucccucuaccagaacgcugacgccuacguguucguggggacaucuagauauagcaagaaauuuaagccugagaucgcuauucggccgaaaguccgcgaucaggagggaagaaugaauuacuauuggacccugguugaacccggcgacaagaucacguucgaggccacagggaaccugguggugccucgguacgcguuugccauggaacgcaacgcuggauccggcauuaucaucagcgauacccccguccaugacugcaauacaaccugucaaaccccuaaaggcgccauuaacacaucucuccccuuccagaauauccacccgauuacgaucgggaagugcccuaaguaugugaaauccaccaagcugagacuugcuacaggacugcggaacguucccagcauucagucucgcggccucuuuggggccaucgccggauucaucgagggcggguggaccggaaugguggacggcugguacggcuaucaucaccagaaugaacaagggagcggauacgcugcggaucugaaauccacacagaacgccauugacgagaucaccaauaaggucaacucugugauugagaaaaugaauacgcaguuuacagcuguuggcaaggaguucaaccaccuugagaagagaaucgaaaaucugaacaaaaagguggaugacggguuccucgauauuuggaccuacaaugccgagcugcugguccuccuggaaaacgagcggacccuugacuaucaugauagcaaugugaaaaaccuguacgagaagguccgcucccagcucaaaaacaaugccaaggaaaucggaaacggcuguuuugaguucuaucacaagugcgacaauacauguauggaaagcgugaaaaacgggaccuacgauuauccuaaguacucugaggaagcuaaacugaauagagaggagaucgacggcguuaaacuugaauccacacggauuuaucaaauccuggccauuuacagcacgguggcgucuucccucguccuggugguuagccugggagcuaucuccuuuuggaugugcucuaacggcagccuccagugccgcauuuguaucuga

SEQ ID NO: 190273 - RNA, 1701 nt, Artificial Sequence; identical to SEQ ID NO: 185873
  derived and/or modified sequence opt5 from hemagglutinin__InfluenzaA__AEO01145

SEQ ID NO: 190274 - RNA, 1701 nt, Artificial Sequence
  derived and/or modified sequence opt5 from hemagglutinin__InfluenzaA__AEO01146
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaauccugagauugcuauccggccgaagguccgcgaucaggaggggagaaugaacuacuauuggacccugguugaacccggagacaaaauuacguucgaggccacaggcaaccugguggugccucgguacgcguuugccauggaacgcaaugcugggucuggaaucauuaucuccgauacccccguccaugacugcaacacaaccugucaaaccccuaagggcgccaucaauacaagccuccccuuccagaacauucacccgaucacgauuggcaaaugcccuaaguaugugaagucuaccaaacugagacuugcuacagggcugcggaauguucccagcauccagucccgcggacucuuuggcgccauugccggguucaucgagggaggcuggaccgggaugguggacggaugguacggcuaucaucaccagaacgaacaaggcucuggguacgcugcggaucuuaagagcacacagaaugccaucgacgagauuaccaacaaagucaauuccgugaucgagaagaugaacacgcaguuuacagcuguuggaaaagaguucaaucaccuggagaagagaauugaaaaccugaauaagaaaguggaugacggcuuccucgauaucuggaccuacaacgccgagcugcugguccuccuggaaaaugagcggacccuugacuaucaugauagcaacgugaagaaccuguacgagaaaguccgcucucagcucaagaauaacgccaaagaaauugggaauggauguuuugaguucuaucacaagugcgacaacacauguauggaauccgugaagaauggcaccuacgauuauccuaaauacagcgaggaagcuaagcugaacagagaggagaucgacgggguuaaacuugaaucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 190275 - RNA, 1701 nt, Artificial Sequence; identical to SEQ ID NO: 185693
  derived and/or modified sequence opt5 from hemagglutinin__InfluenzaA__AEO01147

SEQ ID NO: 190276 - RNA, 1701 nt, Artificial Sequence; identical to SEQ ID NO: 186046
  derived and/or modified sequence opt5 from hemagglutinin__InfluenzaA__AEO01148

SEQ ID NO: 190277 - RNA, 1701 nt, Artificial Sequence; identical to SEQ ID NO: 186046
  derived and/or modified sequence opt5 from hemagglutinin__InfluenzaA__AEO01149

SEQ ID NO: 190278 - RNA, 1701 nt, Artificial Sequence; identical to SEQ ID NO: 188900
  derived and/or modified sequence opt5 from hemagglutinin__InfluenzaA__AEO01150

SEQ ID NO: 190279 - RNA, 1701 nt, Artificial Sequence; identical to SEQ ID NO: 185693
  derived and/or modified sequence opt5 from hemagglutinin__InfluenzaA__AEO01151

SEQ ID NO: 190280 - RNA, 1701 nt, Artificial Sequence
  derived and/or modified sequence opt5 from hemagglutinin__InfluenzaA__AEO01152
augaaggccauccugauugugcuccuguacaccuucgcuacagccaacgcggacacgcuuugcaucggcuaucacgcuaauaacagcaccgauacagucgacaccguucuggagaagaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccaagagcuauaucaaugacaaggggaaagaaguucuugugcuguggggcauucaccaccccuccaccucugccgaucaacagagccucuaccagaacgcugacgccuacgucuucgugggaacauccagauauagcaagaaauuuaagccugagaucgcuauucggccgaaagugcgcgggcaggagggaagaaugaauuacuauuggacccuggucgaacccggcgauaagaucacguucgaggccacagggaaccugguugugccucgguacgcguuugccauggaacgcaacgcuggaucuggcauuaucaucuccgacacccccgugcaugauugcaauacaaccugucaaaccccuaaaggcgccauuaacacaagccuccccuuccagaauauccacccgauuacgaucgggaagugcccuaaguaugucaaaucuaccaagcugagacuugcuacaggacugcggaacgugcccagcauucagucccgcggccucuuuggggccaucgccggauucaucgagggcggguggaccggaaugguugacggcugguacggcuaucaucaccagaaugaacaagggucuggauacgcugcggaccugaaaagcacacagaacgccauugaugagaucaccaauaaggugaacuccgucauugagaaaaugaauacgcaguuuacagcugugggcaaggaguucaaccaccuugagaagagaaucgaaaaucugaacaaaaagguugacgauggguuccucgacauuuggaccuacaaugccgagcugcuggugcuccuggaaaacgagcggacccuugauuaucaugacagcaaugucaaaaaccuguacgagaaggugcgcucucagcucaaaaacaaugccaaggaaaucggaaacggcuguuuugaguucuaucacaagugcgauaauacauguauggaauccgucaaaaacgggaccuacgacuauccuaaguacagcgaggaagcuaaacugaauagagaggagaucgauggcgugaaacuugaaucuacacggauuuaucaaauccuggccauuuacuccacgguugcgagcucccucgugcuggucgugucucugggagcuaucagcuuuuggaugugcuccaacggcucucuccagugccgcauuuguaucuga

SEQ ID NO: 190281 - RNA, 1701 nt, Artificial Sequence
  derived and/or modified sequence opt5 from hemagglutinin__InfluenzaA__AEO01153
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaauaacaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaccugguggugccucgguacgcguuugccauggaacgcaaugcugggucuggaaucauuaucuccaacacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggauggaugguacggcuaucaucaccagaaugaacaaggcucuggguacgcugcggaccugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaacgugaaaaaucuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 190282 - RNA, 1701 nt, Artificial Sequence; identical to SEQ ID NO: 185693
  derived and/or modified sequence opt5 from hemagglutinin__InfluenzaA__AEO01154

SEQ ID NO: 190283 - RNA, 1701 nt, Artificial Sequence; identical to SEQ ID NO: 186046
  derived and/or modified sequence opt5 from hemagglutinin__InfluenzaA__AEO01155

SEQ ID NO: 190284 - RNA, 1701 nt, Artificial Sequence; identical to SEQ ID NO: 186046
  derived and/or modified sequence opt5 from hemagglutinin__InfluenzaA__AEO01156

SEQ ID NO: 190285 - RNA, 1701 nt, Artificial Sequence; identical to SEQ ID NO: 185693
  derived and/or modified sequence opt5 from hemagglutinin__InfluenzaA__AEO01157

SEQ ID NO: 190286 - RNA, 1701 nt, Artificial Sequence; identical to SEQ ID NO: 185693
  derived and/or modified sequence opt5 from hemagglutinin__InfluenzaA__AEO01158

SEQ ID NO: 190287 - RNA, 1701 nt, Artificial Sequence; identical to SEQ ID NO: 185693
  derived and/or modified sequence opt5 from hemagglutinin__InfluenzaA__AEO01159

SEQ ID NO: 190288 - RNA, 1701 nt, Artificial Sequence
  derived and/or modified sequence opt5 from hemagglutinin__InfluenzaA__AEO01160
augaaggccauccugguggcucuccuguacaccuucgccacagcgaacgcugacacgcuuugcauuggcuaucacgccaauaacagcaccgauacagucgacaccguucuggagaaaaaugugacagugacccauuccgucaaccuccuggaagauaagcacaaugggaaacuuuguaagcugagaggaguggcuccccuccaucugggcaaaugcaacaucgccggguggauucugggaaauccugagugugaaucucucagcacagccuccucuuggagcuacaucguugagaccuccucuagcgacaacggcacgugcuauccgggggauuuuauugacuacgaagaacugcgggagcagcuuuccagcgugucuuccuucgaacgcuuugagaucuuccccaagaccagcucuuggccuaaucacgauuccaacaagggagucacagcugccuguccccaugcgggcgccaagagcuuuuauaagaaucugaucuggcucgugaaaaagggcaacucuuacccuaaacuguccaagagcuauauuaaugacaaggggaaagaaguucuugugcuguggggaauccaccaccccuccaccucugcugaucaacagagccucuaccagaacgccgacgcuuacgucuucgugggcacauccagauauagcaagaaauuuaagccugagauugccauccggccgaaagugcgcgagcaggaagggagaaugaauuacuauuggacccuggucgagcccggagauaagauuacguucgaagcgacaggcaaccugguugugccucgguacgccuuugcuauggagcgcaacgccgggucuggaaucauuaucuccgacacccccgugcaugauugcaauacaaccugucaaaccccuaaaggcgcuaucaacacaagccuccccuuccagaauauucacccgaucacgauuggcaagugcccuaaguaugucaaaucuaccaagcugagacuugccacagggcugcggaacgugcccagcauccagucccgcggacucuuuggcgccauugcuggguucaucgaaggaggcuggaccgggaugguugacggaugguacggcuaucaucaccagaaugagcaaggcucuggguacgcggccgaccugaaaagcacacagaacgcuaucgaugagauuaccaauaaggugaacuccgucaucgagaaaaugaauacgcaguuuacagccgugggaaaggaguucaaccaccuugaaaagagaauugagaaucugaacaaaaagguugacgauggcuuccucgacaucuggaccuacaaugccgaacugcuggugcuccuggagaacgagcggacccuugauuaucaugacagcaaugucaaaaaccuguacgaaaaggugcgcucucagcucaaaaacaaugcuaaggagauugggaacggauguuuugaguucuaucacaagugcgauaauacauguauggaauccgucaaaaacggcaccuacgacuauccuaaguacagcgaagaggccaaacugaauagagaggaaaucgauggggugaaacuugagucuacacggaucuaucaaauucuggcgaucuacuccacgguugcuagcucccucgugcuggucgugucucugggcgccauuagcuuuuggaugugcuccaacggaucucuccagugccgcaucuguauuuga

SEQ ID NO: 190289 - RNA, 1701 nt, Artificial Sequence; identical to SEQ ID NO: 185693
  derived and/or modified sequence opt5 from hemagglutinin__InfluenzaA__AEO01161

SEQ ID NO: 190290 - RNA, 1701 nt, Artificial Sequence; identical to SEQ ID NO: 186046
  derived and/or modified sequence opt5 from hemagglutinin__InfluenzaA__AEO01162

SEQ ID NO: 190291 - RNA, 1701 nt, Artificial Sequence; identical to SEQ ID NO: 186046
  derived and/or modified sequence opt5 from hemagglutinin__InfluenzaA__AEO01163

SEQ ID NO: 190292 - RNA, 1701 nt, Artificial Sequence; identical to SEQ ID NO: 186046
  derived and/or modified sequence opt5 from hemagglutinin__InfluenzaA__AEO01164

SEQ ID NO: 190293 - RNA, 1701 nt, Artificial Sequence
  derived and/or modified sequence opt5 from hemagglutinin__InfluenzaA__AEO01165
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaauucuccaagagcuauauuaaugacaaggggaaagaagugcugguccuuuggggaauccaccaccccuccaccucugccgaucaacagagccuguaccagaacgcugacgccuacguguuugugggcacauccagauauagcaagaaauucaagccugagauugcuauccggccgaaaguccgcgaucaggaggggagaaugaauuacuauuggacccucguugaacccggagacaagauuacguuugaggccacaggcaaccugguggugccucgguacgcguucgccauggaacgcaacgcugggucuggaaucauuaucuccgauacccccguccaugacugcaauacaaccugucaaaccccuaaaggcgccaucaacacaagccugcccuuucagaauauucacccgaucacgauuggcaagugcccuaaguaugugaaaucuaccaagcucagacuggcuacagggcuucggaacguucccagcauccagucccgcggacuguucggcgccauugccggguuuaucgagggaggcuggaccgggaugguggacggaugguacggcuaucaucaccagaaugaacaaggcucuggguacgcugcggaucucaaaagcacacagaacgccaucgacgagauuaccaauaaggucaacuccgugaucgagaaaaugaauacgcaguucacagcuguuggaaaggaguucaaccaccuggagaagagaauugaaaaucuuaacaaaaagguggaugacggcuuucuggauaucuggaccuacaaugccgagcuccugguccugcucgaaaacgagcggacccuggacuaucaugauagcaaugugaaaaaccuuuacgagaagguccgcucucagcugaaaaacaaugccaaggaaauugggaacggauguuucgaguuuuaucacaagugcgacaauacauguauggaauccgugaaaaacggcaccuacgauuauccuaaguacagcgaggaagcuaaacucaauagagaggagaucgacgggguuaagcuggaaucuacacggaucuaucaaauucuugccaucuacuccacgguggcgagcucccugguccucgugguuucucugggcgcuauuagcuucuggaugugcuccaacggaucucugcagugccgcaucuguauuuga

SEQ ID NO: 190294 - RNA, 1701 nt, Artificial Sequence; identical to SEQ ID NO: 186046
  derived and/or modified sequence opt5 from hemagglutinin__InfluenzaA__AEO01166

SEQ ID NO: 190295 - RNA, 1701 nt, Artificial Sequence
  derived and/or modified sequence opt5 from hemagglutinin__InfluenzaA__AEO01167
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugguggugccucgguacgcguuugccauggagcgcaacgcugggucuggaaucauuaucuccgacaccagcguccaugauugcaauacaaccugucaaacccccaaaggcgccaucaacacaucucucccuuuccagaauauucaccccaucacgauuggcaagugcccgaaguaugugaaaagcaccaagcugagacuugcuacagggcugcggaacguuccuuccauccagucucgcggacucuuuggcgccauugccggguucaucgaaggaggcuggaccgggaugguggacggaugguacggcuaucaucaccagaaugagcaaggcagcggguacgcugcggaccugaaauccacacagaacgccaucgaugagauuaccaauaaggucaacagcgugaucgaaaagaugaauacgcaguuuacagcuguuggaaaggaguucaaccaccuugaaaagagaauugagaaucugaacaaaaagguggacgauggcuuccucgacaucuggaccuacaaugccgaacugcugguccuccuggagaacgagcggacccuugauuaucaugacucuaaugugaaaaaccuguacgaaaagguccgcucccagcucaaaaacaaugccaaggagauugggaacggauguuuugaguucuaucacaagugcgauaauacauguauggagagcgugaaaaacggcaccuacgacuaucccaaguacucugaagaggcuaaacugaauagagaggaaaucgaugggguuaaacuugaguccacacggaucuaucaaauucuggccaucuacagcacgguggcguccucucucguccuggugguuagccugggcgcuauuuccuuuuggaugugcucuaacggaagccuccagugccgcaucuguauuuga

SEQ ID NO: 190296 - RNA, 1701 nt, Artificial Sequence; identical to SEQ ID NO: 185693
  derived and/or modified sequence opt5 from hemagglutinin__InfluenzaA__AEO01168

SEQ ID NO: 190297 - RNA, 1701 nt, Artificial Sequence; identical to SEQ ID NO: 186046
  derived and/or modified sequence opt5 from hemagglutinin__InfluenzaA__AEO01169

SEQ ID NO: 190298 - RNA, 1701 nt, Artificial Sequence; identical to SEQ ID NO: 186046
  derived and/or modified sequence opt5 from hemagglutinin__InfluenzaA__AEO01170

SEQ ID NO: 190299 - RNA, 1701 nt, Artificial Sequence; identical to SEQ ID NO: 186046
  derived and/or modified sequence opt5 from hemagglutinin__InfluenzaA__AEO01171

SEQ ID NO: 190300 - RNA, 1701 nt, Artificial Sequence; identical to SEQ ID NO: 185693
  derived and/or modified sequence opt5 from hemagglutinin__InfluenzaA__AEO01172

SEQ ID NO: 190301 - RNA, 1701 nt, Artificial Sequence
  derived and/or modified sequence opt5 from hemagglutinin__InfluenzaA__AEO01173
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggaggcaagauuacguucgaggccacagggaaccugguggugccucgguacgcguuugccauggaacgcaacgcuggaucuggcaucauuaucuccgacacccccguccaugauugcaauacaaccugucaaaccccuaaaggcgccaucaacacaagccuccccuuccagaauauucacccgaucacgauugggaagugcccuaaguaugugaaaucuaccaagcugagacuugcuacaggacugcggaacguucccagcauccagucccgcggccucuuuggggccauugccggauucaucgagggcggguggaccggaaugguggacggcugguacggcuaucaucaccagaaugaacaagggucuggauacgcugcggaccugaaaagcacacagaacgccaucgaugagauuaccaauaaggucaacuccgugaucgagaaaaugaauacgcaguuuacagcuguuggcaaggaguucaaccaccuugagaagagaauugaaaaucugaacaaaaagguggacgauggguuccucgacaucuggaccuacaaugccgagcugcugguccuccuggaaaacgagcggacccuugauuaucaugacagcaaugugaaaaaccuguacgagaagguccgcucucagcucaaaaacaaugccaaggaaauuggaaacggcuguuuugaguucuaucacaagugcgauaauacauguauggaauccgugaaaaacgggaccuacgacuauccuaaguacagcgaggaagcuaaacugaauagagaggagaucgauggcguuaaacuugaaucuacacggaucuaucaaauucuggccaucuacuccacgguggcgagcucccucguccuggugguuucucugggagcuauuagcuuuuggaugugcuccaacggcucucuccagugccgcaucuguauuuga

SEQ ID NO: 190302 - RNA, 1701 nt, Artificial Sequence
  derived and/or modified sequence opt5 from hemagglutinin__InfluenzaA__AEO01174
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcggcaacgggacgugcuauccgggagacuuuauugauuacgaagaacugcgggagcagcuuuccagcgucucuuccuucgaacgcuuugagaucuuccccaagaccagcucuuggccuaaucacgacuccaacaagggcgugacagccgcuuguccccaugccggcgcgaaaucuuuuuauaagaaucugaucuggcucguuaaaaaggggaacagcuacccuaaacuguccaagagcuauauuaaugauaagggaaaagaagugcuuguccuguggggcauccaccaccccuccaccucugccgaccaacagagccucuaccagaacgcugaugccuacguguucguggggacauccagauauagcaagaaauuuaagccugagauugcuauccggccgaaaguccgcgagcaggaaggaagaaugaauuacuauuggacccugguugagcccggcgacaagauuacguucgaagccacagggaaccugguggugccucgguacgcguuugccauggagcgcaacgcuggaucuggcaucauuaucuccgauacccccguccaugacugcaauacaaccugucaaaccccuaaaggcgccaucaacacaagccuccccuuccagaauauucacccgaucacgauugggaagugcccuaaguaugugaaaucuaccaagcugagacuugcuacaggacugcggaacguucccagcauccagucccgcggccucuuuggggccauugccggauucaucgaaggcggguggaccggaaugguggauggcugguacggcuaucaucaccagaaugagcaagggucuggauacgcugcggaccugaaaagcacacagaacgccaucgacgagauuaccaauaaggucaacuccgugaucgaaaagaugaauacgcaguuuacagcuguuggcaaggaguucaaccaccuugaaaagagaauugagaaucugaacaaaaagguggaugacggguuccucgauaucuggaccuacaaugccgaacugcugguccuccuggagaacgagcggacccuugacuaucaugauagcaaugugaaaaaccuguacgaaaagguccgcucucagcucaaaaacaaugccaaggagauuggaaacggcuguuuugaguucuaucacaagugcgacaauacauguauggaguccgugaaaaacgggaccuacgauuauccuaaguacagcgaagaggcuaaacugaauagagaggaaaucgacggcguuaaacuugagucuacacggaucuaucaaauucuggccaucuacuccacgguggcgagcucccucguccuggugguuucucugggagcuauuagcuuuuggaugugcuccaacggcucucuccagugccgcaucuguauuuga

SEQ ID NO: 190303 - RNA, 1701 nt, Artificial Sequence; identical to SEQ ID NO: 185693
  derived and/or modified sequence opt5 from hemagglutinin__InfluenzaA__AEO01176

SEQ ID NO: 190304 - RNA, 1701 nt, Artificial Sequence; identical to SEQ ID NO: 185693
  derived and/or modified sequence opt5 from hemagglutinin__InfluenzaA__AEO01177

SEQ ID NO: 190305 - RNA, 1701 nt, Artificial Sequence; identical to SEQ ID NO: 186046
  derived and/or modified sequence opt5 from hemagglutinin__InfluenzaA__AEO01179

SEQ ID NO: 190306 - RNA, 1701 nt, Artificial Sequence; identical to SEQ ID NO: 186046
  derived and/or modified sequence opt5 from hemagglutinin__InfluenzaA__AEO01180

SEQ ID NO: 190307 - RNA, 1701 nt, Artificial Sequence; identical to SEQ ID NO: 186046
  derived and/or modified sequence opt5 from hemagglutinin__InfluenzaA__AEO01181

SEQ ID NO: 190308 - RNA, 1701 nt, Artificial Sequence; identical to SEQ ID NO: 186046
  derived and/or modified sequence opt5 from hemagglutinin__InfluenzaA__AEO01182

SEQ ID NO: 190309 - RNA, 1701 nt, Artificial Sequence; identical to SEQ ID NO: 185693
  derived and/or modified sequence opt5 from hemagglutinin__InfluenzaA__AEO01183

SEQ ID NO: 190310 - RNA, 1701 nt, Artificial Sequence; identical to SEQ ID NO: 186046
  derived and/or modified sequence opt5 from hemagglutinin__InfluenzaA__AEO01184

SEQ ID NO: 190311 - RNA, 1701 nt, Artificial Sequence; identical to SEQ ID NO: 185693
  derived and/or modified sequence opt5 from hemagglutinin__InfluenzaA__AEO01185

SEQ ID NO: 190312 - RNA, 1701 nt, Artificial Sequence; identical to SEQ ID NO: 185693
  derived and/or modified sequence opt5 from hemagglutinin__InfluenzaA__AEO01186

SEQ ID NO: 190313 - RNA, 1701 nt, Artificial Sequence; identical to SEQ ID NO: 185693
  derived and/or modified sequence opt5 from hemagglutinin__InfluenzaA__AEO01187

SEQ ID NO: 190314 - RNA, 1701 nt, Artificial Sequence; identical to SEQ ID NO: 185693
  derived and/or modified sequence opt5 from hemagglutinin__InfluenzaA__AEO01188

SEQ ID NO: 190315 - RNA, 1701 nt, Artificial Sequence; identical to SEQ ID NO: 185693
  derived and/or modified sequence opt5 from hemagglutinin__InfluenzaA__AEO01189

SEQ ID NO: 190316 - RNA, 1701 nt, Artificial Sequence; identical to SEQ ID NO: 185693
  derived and/or modified sequence opt5 from hemagglutinin__InfluenzaA__AEO01191

SEQ ID NO: 190317 - RNA, 1701 nt, Artificial Sequence; identical to SEQ ID NO: 185693
  derived and/or modified sequence opt5 from hemagglutinin__InfluenzaA__AEO01192

SEQ ID NO: 190318 - RNA, 1701 nt, Artificial Sequence; identical to SEQ ID NO: 187007
  derived and/or modified sequence opt5 from hemagglutinin__InfluenzaA__AEO01193

SEQ ID NO: 190319 - RNA, 1701 nt, Artificial Sequence; identical to SEQ ID NO: 186046
  derived and/or modified sequence opt5 from hemagglutinin__InfluenzaA__AEO01194

SEQ ID NO: 190320 - RNA, 1701 nt, Artificial Sequence; identical to SEQ ID NO: 186046
  derived and/or modified sequence opt5 from hemagglutinin__InfluenzaA__AEO01195

SEQ ID NO: 190321 - RNA, 1701 nt, Artificial Sequence; identical to SEQ ID NO: 185693
  derived and/or modified sequence opt5 from hemagglutinin__InfluenzaA__AEO01196

SEQ ID NO: 190322 - RNA, 1701 nt, Artificial Sequence; identical to SEQ ID NO: 185693
  derived and/or modified sequence opt5 from hemagglutinin__InfluenzaA__AEO01197

SEQ ID NO: 190323 - RNA, 1701 nt, Artificial Sequence; identical to SEQ ID NO: 186046
  derived and/or modified sequence opt5 from hemagglutinin__InfluenzaA__AEO01198

SEQ ID NO: 190324 - RNA, 1701 nt, Artificial Sequence; identical to SEQ ID NO: 186559
  derived and/or modified sequence opt5 from hemagglutinin__InfluenzaA__AEO01200

SEQ ID NO: 190325 - RNA, 1701 nt, Artificial Sequence
  derived and/or modified sequence opt5 from hemagglutinin__InfluenzaA__AEO01201
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagagaagcacaaugggaaacuuuguaagcugagaggaguugcuccccuccaucugggcaaaugcaacaucgccggguggauucugggaaauccugaaugugagucucucagcacagccuccucuuggagcuacaucguggaaaccuccucuagcgauaacggcacgugcuauccgggggacuuuauugauuacgaggagcugcgggaacagcuuuccagcgucucuuccuucgagcgcuuugaaaucuuccccaagaccagcucuuggccuaaucacgacuccaacaagggagugacagccgcuuguccccaugccggcgcgaaaucuuuuuauaagaaucugaucuggcucguuaaaaagggcaacagcuacccuaaacuguccaagagcuauauuaaugauaaggggaaagaggugcuuguccuguggggaauccaccaccccuccaccucugccgaccaacagagccucuaccagaacgcugaugccuacguguucgugggcacauccagauauagcaagaaauuuaagccugagauugcuauccggccgaaaguccgcgaacaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggauggaugguacggcuaucaucaccagaaugagcaaggcucuggguacgcugcggaccugaaaagcacacagaacgccaucgacgaaauuaccaauaaggucaacuccgugaucgagaaaaugaauacgcaguuuacagcuguuggaaaggaguucaaccaccuugaaaagagaauugaaaaucugaacaaaaagguggaugacggcuuccucgauaucuggaccuacaaugccgagcugcugguccuccuggagaacgaacggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaggcuaaacugaauagagaagagaucgacgggguuaaacuugaaucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 190326 - RNA, 1701 nt, Artificial Sequence; identical to SEQ ID NO: 185693
  derived and/or modified sequence opt5 from hemagglutinin__InfluenzaA__AEO01202

SEQ ID NO: 190327 - RNA, 1701 nt, Artificial Sequence; identical to SEQ ID NO: 187329
  derived and/or modified sequence opt5 from hemagglutinin__InfluenzaA__AEO01203

SEQ ID NO: 190328 - RNA, 1701 nt, Artificial Sequence; identical to SEQ ID NO: 185693
  derived and/or modified sequence opt5 from hemagglutinin__InfluenzaA__AEO01204

SEQ ID NO: 190329 - RNA, 1701 nt, Artificial Sequence; identical to SEQ ID NO: 185693
  derived and/or modified sequence opt5 from hemagglutinin__InfluenzaA__AEO01205

SEQ ID NO: 190330 - RNA, 1701 nt, Artificial Sequence; identical to SEQ ID NO: 185693
  derived and/or modified sequence opt5 from hemagglutinin__InfluenzaA__AEO01206

SEQ ID NO: 190331 - RNA, 1701 nt, Artificial Sequence; identical to SEQ ID NO: 185693
  derived and/or modified sequence opt5 from hemagglutinin__InfluenzaA__AEO01207

SEQ ID NO: 190332 - RNA, 1701 nt, Artificial Sequence; identical to SEQ ID NO: 185693
  derived and/or modified sequence opt5 from hemagglutinin__InfluenzaA__AEO01208

SEQ ID NO: 190333 - RNA, 1701 nt, Artificial Sequence; identical to SEQ ID NO: 186046
  derived and/or modified sequence opt5 from hemagglutinin__InfluenzaA__AEO01209

SEQ ID NO: 190334 - RNA, 1701 nt, Artificial Sequence; identical to SEQ ID NO: 185693
  derived and/or modified sequence opt5 from hemagglutinin__InfluenzaA__AEO01210

SEQ ID NO: 190335 - RNA, 1701 nt, Artificial Sequence; identical to SEQ ID NO: 186046
  derived and/or modified sequence opt5 from hemagglutinin__InfluenzaA__AEO01211

SEQ ID NO: 190336 - RNA, 1701 nt, Artificial Sequence; identical to SEQ ID NO: 185693
  derived and/or modified sequence opt5 from hemagglutinin__InfluenzaA__AEO01212

SEQ ID NO: 190337 - RNA, 1701 nt, Artificial Sequence; identical to SEQ ID NO: 185693
  derived and/or modified sequence opt5 from hemagglutinin__InfluenzaA__AEO01213

SEQ ID NO: 190338 - RNA, 1701 nt, Artificial Sequence
  derived and/or modified sequence opt5 from hemagglutinin__InfluenzaA__AEO01214
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggcgccucgguacgccuuugcuauggaacgcaacgccgggucuggaaucauuaucuccgauacccccgugcaugacugcaauacaaccugucaaaccccuaaaggcgcuaucaacacaagccuccccuuccagaauauucacccgaucacgauuggcaagugcccuaaguaugucaaaucuaccaagcugagacuugccacagggcugcggaacgugcccagcauccagucccgcggacucuuuggcgccauugcuggguucaucgagggaggcuggaccgggaugguugacggaugguacggcuaucaucaccagaaugaacaaggcucuggguacgcggccgaucugaaaagcacacagaacgcuaucgacgagauuaccaauaaggugaacuccgucaucgagaaaaugaauacgcaguuuacagccgugggaaaggaguucaaccaccuugagaagagaauugaaaaucugaacaaaaagguugaugacggcuuccucgauaucuggaccuacaaugccgagcugcuggugcuccuggaaaacgagcggacccuugacuaucaugauagcaaugucaaaaaccuguacgagaaggugcgcucucagcucaaaaacaaugcuaaggaaauugggaacggauguuuugaguucuaucacaagugcgacaauacauguauggaauccgucaaaaacggcaccuacgauuauccuaaguacagcgaggaagccaaacugaauagagaggagaucgacggggugaaacuugaaucuacacggaucuaucaaauucuggcgaucuacuccacgguugcuagcucccucgugcuggucgugucucugggcgccauuagcuuuuggaugugcuccaacggaucucuccagugccgcaucuguauuuga

SEQ ID NO: 190339 - RNA, 1701 nt, Artificial Sequence; identical to SEQ ID NO: 186046
  derived and/or modified sequence opt5 from hemagglutinin__InfluenzaA__AEO01215
